United States Patent 10,724,096 (METHODS AND COMPOSITIONS FOR INHIBITING AND TREATING NEUROLOGICAL CONDITIONS) - sequence listing, part 132

SEQ ID NO: 2412 - DNA, 1460669 bp, Homo sapiens
acaggactggagggcttgaggaatgtggtggtccctctcttcgttgtttctgccccctgaggttgtgctttctcagggatatgcactctgcacttccattcctgcagtgaaattaactcgagcttggcaggtaagtctttcggctcacctttaaaaagaaaagatatgtgagctgcggtgggggtgggctgttccccatttgccttacattggatgtattttattggtgcaaagtggtatttggaagcttaaatgtggggcagaggtttgaagtagccaaatgaactctgtggccctgagagaagagaaaggataaccaaaagaaagggaaggggactcaggcatttttctcctaataaatctctaatttttcttggaaattttgcctccaggccgatgcctggccccagaacagggtctttggcatgagttatagctgtgatgttccctattttcctttttttttttttttttaagttgtcgctgcatgggagcaggcagacagaaacagggttgcatgttgtcaatacaggctgcagaagtcaataagcagccagacagggaatgaaattggaggaggcagctatagatttcttaggttatttcttgtgagtttttcagaacttgtgtgattcaggcttgtcagatactattttgagctgggctgagacaaacacattcccctagtgcaccagatattgcctgcagcctcccaatttctggaggcacctgggtcggctttcttgggggcaagggaatgtccaaggaaaggtcaggaatgagggaattggaaactatgatgggaaaaacaactgttttactgctctagaatctaacagaaatcataatgtcaccctggagataattattatgctgttagtgatcggcttgagaccagggactgtgcctcattcaattcactgcttggatcagagtgaatactcaataaatgtacaatgattaaatgttagtatcaaaatacatacttttgggataagctcggattgatattctgggttctgcttagaatgataagatggagtaataagggagagtaatgttgattggtagataattatgaagaaatgagttctgttaaatagtagattaatatctgcaagtggaattattagacaaggacacacaaacacagggtctctctgcctgcctatcgtctgtctactttcatctctgtcttgtgtttcacttgattccagaagaatttcaggcagcttatgggacaagtttaatgaaaattaacatcattagggataaaaatgacaaaatatataggcttcatccagcaattgatcttctgtggttctacagtgacatggactacagataactgaaatgtaagggttactgtaacttcatttaagcatttattttaacctcttcttccactaatctcatgcttgatgctacaaacctagagtaaagtagatgaatgttctggccctgctgtgggtcccagtgaggtaaaactagcaaagggcagataacagtcatgcaggggattgagtcatacatggagggttgaatgttttgccctttggaggtgataaagcagataattgggtggctcttctccattccataggctgggctgctctgtcatagcttcacagtgctttgcttactttttctttcccctatttgaaactgaatcaggaagatcatatttcccttccgatcctgcttaataaaatattctattattttctcagctgcaaaagtacactattatcactgatcattccctcctcatctcagagtgtttgtcactggccacagtttatatacaagctatacaggctgcctggaacttgaattggctttagagtggatgctggggaaggggcgggggggttccgggtatctgatgaattcctgcaactgcagggctgggagcctggcggggagccaaggggattgtggacagatgctatgcttgctgggtcgacctggctcagctaatattcccagacttggagctgggggacacattcatttcattcaacccatacaaaaatatggacttaatatcaactatgtgtacggcatggaattcttggcatactcagggtgtcaaacccaggagtccctgttccccaagtagctgactctgctacccacatagcaggtgctgttacattgtctagtttatttctcttggatgggaaaataattttatcctattcacaaatgaggaaaccgagactcacatattatgcaccatgcctaacattgcaggtagtgaatggatgaatcatgagggaaactgtttacttcaactgtactgcacatctgtaagaaaagacattcaggaaagacttttacaagacagtgcatgctaagggctaggaagtttggtgagagatggctcccatggagaagtagaaattaagatgggctttgaagcatgagcagatgacaaaaaagcccaatccaaactggcttaaacagcaagggggtggttattggctcatgtgattgagaagatcaatgtgaccaaggtctggatatttctgtcttgtgtctcctaccgagttggctttatcctcaattcagctacctaaagtcctctggaccctacccccccggaagctgaaggatgactgcgggagtttcagtcccctacatagttcctggggccactttctctcattagccacaactgtggctgggggtagacaggagacagtttattctgtaccctctactaaacagcataggtaagactaatagagaataaattttgcaaaaggaaaatctgggtagaagaaggggaacgaatggttggtagcccactaatgtcccatagcagaggatttagagaggcaaggggagcagaaatcctcacagcacaagcactggtagcagtggagggtgggtaggcctgagttagaagttaagatgccagtcttctgatgttcctgggaatagatgttttggccagctatgtcttattaccagtgcccactgatcccaaaactaccttgctgcatgctgatagcgtcctcctagacctcagaggttggaggtgggggtgagagggtcttagtttactaaggtagaaatcagtgaactggtagggtcagatcatgtcagtggaaatgatcccaagattccctgactggtctgaggctgcatataccctgcactctaatagcccattgatgtcagctcttggctacctgctccagtgaaactcgggtcctaaaagtcaacaggtgctcagtgataaagcagggtacaaggagacaaagagagggtcttagggactgggatccttttgaatggtcctaagaagatatgacatttgttgtttcactaactcctaccaactcatgcctaggtttgctcaaagggcttttgtttctggaggcatatcctgaggtcctgagtgggaagcttagagcttggcccattaaaacagagagctcatttttctttcttttccagaaaagcaaagaagcatcatgggtaatgaaaaaaaaatactgcactaggaggaaccaggagacatgagtttggcctgggatctacatgtactgattcctgtttgactttgtataagcttctttaatttctgctactaagccccctatcaaggtgtttttgttgttgttgttttttctcttatttcctcagatagaattattttatagtcaagctttgttattctagcaaagaaacctggggttatgctttggaaggccatttttttcctgtgtttgaaccaaattgaatttagcaggtgcaaagggctgcagaagagacttggcaattgatagaattatagccaggattcagagggccctcaggagtcctaggcattgactctttgagccctgtgctgaaatcacctctcaagctttcctctatccaggctcttctcttgtgtgtgtaacaccatgccatgcccagccacacttgggaataatctcagattccgtatctttacctctctttttaattttgctgctcagcctctctgtgctgccttcacacatcccattagtcaacgaagtcgtattgattttatatccaaattcctcttaaacccacaccatcttgttcatccccatgttccagtgctgctcctccctcactggactcttataattgctgctttactgtgcatgggatatgagaggtcctccataaatagcatttgaacaaatgcagaatgagataataacacaagtgaaatgacgtgaaacaggcctgagttctcaatcttctacttatatgggatagacatgggttggtatttctagaaataattataggaaagaactaggttcttttgtagtcaactcaccacgtgtctgaagttaccttatttccatctcatgaagatgtttaacaagttcatgtgaaacaaactgtttctactgggaagaccatgtccaagtcttcccacattctgatggaggtgccacaccctcccctgcttctctagggtctcattttaccatcctcattttgccagcctctgggaaacctgatctaagcctatgcaatgctaaaagtgcctgcttaacagcttggaagggaggagaggcaatttatttgctcaactgaattacctgtttacacttctgatctccaaagcatatgtcagaacaagaagagaatagaagaaattgttaacattgcatggaactagggagtccacatataagagaaatttatcacatgaaaatgcttgctttctttggtggtgaatctctttcaccatcagaattgcctccctcctgtcatttaccttgcaacaaattttcctttacaatatctttactcagggtgcctttcctctgaaaacagaaacacctagttgacatctcaccactttgctgctttggttgcagcctagtgatggaatgacaagcccactccataggtgcctctgaatagcttatttcagggagctgcaagacaactatttgctcagaaaattctcacgagggtgatggttttcaaagcaggaaggagagggaattcctggtacacttcccctctgcattgctggagaaatgaagaaacacttgaaggcaaagtcataagtcaggttgaagatggtttctggtggagtggtttggagatttcatctcaagttgagagctgtcctggaatagcttctacctgacttgtttatttctcagctattaatagaaactaacagagtgaggatggtccaggaatctctcccataatgtcctacttcaggacttgaaattctgttagaaattcaattttaatatcatgggataaaacataaatgcatgaatctctttgcagaacccctgccaagggacagccttcaataaatacttacgaagctggacactaggctggttgctacaaatacaaagaaaagcaagtcatatcatttcctaccaaggagctcacaacctggatgatgatgccaattctaagactaacaagaacaggtactagcgtagatggtggtttctatatgctaggtaccattctatgtgctttatgtgctgaagtcattgcattatcacaacaagcctataagactcttaaccctgttttacaggtgaggaaactgggacactgtcttgttaagtgtcttgcctgaagtcacaggattaacatgtacaaggcactatgagagcagagagaaaagaggcgtggtcagggagtaagggagatacatgtacagaccactgatgtggactcatcatctccataactgcccctttgcccttcctttgcattcaaaattattatctctctctcgttcaatttagctatttctatgaaggggtgaaaatccctaacctcttgatatgaatttagcattcaaaggcacctgagatgaggaaggcagaaagtgttcagtataatttgggtctgcttcctgatttttctcaggtttggtcaagaggctgaaaagcaaatagaatgcaatggcaggcacacacacataaggagcttattgaaaagatagatctcaatttctagtatttccaccaggcattatgaccctgacacctttttcagttatggtactctatcagggttactttgattataagtgacaggaaaacccaacccaaactgccttaagccaaaggaaattttagagggtcccataaggagaaagtctaggggttgctctgggtctaggaataccttgatacaagatctcatgtaatattgccgggttttctgttctcttctttgaacttagttctcctcctcttgcctcatgatcacaaaattgatgcagcagctccaacccttactttacttagcttctgtctagggggagatataacagttacttttctgaattatcagaaagagtcctgggcttttctatcgttggccctattaagttacctgcctgtttctagatcagtaactgtgcccatggaaataaactacactgattagcttaggccaatgggtataagaataaatgaaagtggagaaccagtaagtctctgaggaaattcagtttacgctggagaatggtagtgacatcttcaatggaagcttcttgagtgacctatgttatagctctgttagatggcgtggtccctccagggctaacagcatctataatacctatgtttccttattctcctccttacctatcagtatgtctgctctatgctcaggagtattccacagtggctcagtggcatgaataataggaaataatgtctaaatggactataagacataagctggctttttcaatggcccttaagtttcttaactcctgagccagggttcttcttcagaccagagggacctggaacatctttggtcctacagatggtgttggttgggtatcagcatatggggagatacgtgggtgggaggagctgatgtcagaaggcctgagttggaacattggattacaatcaaaggaaaaatcttgagccttcaattgatgaaaaaacctccttagttgaaaaatgcaaaactctggcagactccttctgaggatgatgaagaaaagacaaaactctctgaaataattaaaactccgcaggagggatattattatatatggggttactagaaggggagtcaggattagggttgggattaggggagttattagacagggagtcagggcctcctgccatgggaacttcttgtcagtgatttcttcccttggccctgagataggcagcttggtggagaaggcttatacttcttagctgggtgaccttggataattcacttaatctcgctgggtctagatttcataatctgtaaatgaggataataggaagaccaagttcatgaagaaattatgaaaattaaatgaaaatgttaggtagttatgttcaaactcatgcaagcttggccaatagccaaccatttggtcaacattagtttcagttattttctccctgtctgtaaactctagagtttacaaactcaacaatttggaggtttttcttcccacgcagcacatgacttcacaacactaagcatgtcgatagtgaattaacttgtcattattgtatgggttttattattatgtttgcttttgaattagtattttgagcagttgcatcaaatcacagaacagtggaggggttctgattaagctgagcctttccctgctgcagcacaggccctgggtgagggccatttgtattaggatccctgccttgcccctgactagccagatcactttggtctctgacctcagtgtcctgattagtccacatggggataataataccttcccacaaggttattgtgagaatttgagacaattcctagaaagcctggttcttttatgagctgtgtattcattcattgtcagtgcccactctgtgggattttgcaatttaaaacatcacttccatgcatggctgtctctggaagggtataggcccagaggacctcatctggtgatggggaagccccctaaattgctcatacgtatacatgtaaaatcaaaatccaccagtgcagttctccctgcacctccccctatccaagcatggggccagggtggctgccagattgttttttccaagggttgaccctgttttcatgctcctgtgatttacttacagaagggattatcacattggatgagaggctgaatttcatagacctcaaatgtccttttccaactctgagattttatgtgtctatgttttcatttccaaatagaaaataacccttatcattgctaatggtattcccttaaggaagttacttaatctttctatttctcaatttcttatttgtagaatagaatggattatattccctacatcctaggatgggtgtgagatttaaacaaagaatgcatgtaagatgttcagcacagtgtagtaagacgttaatggtgctcactgatagacatttcttatttgggacataatagagtgacatttcctgactcacttgccattggaaggggctatgtgactaagtctggccagtgagctgtgagcccaataaggtctgtgacttctggatcagggcactgaagtgtgcatgtgtgacttctggcacagcaaccataacattcaacatggtggctgctcagtcagcctgggtcccgagcatcccagccaacataatggcaggtactgtgagagggaaataacttgtggtgtactaaggcacttgaaatttggaggtgtttttttactgttctgtaacttcatctacattgattgatacgcacattgttttatccaagataataataactaatagtacttgggcatttgctatgtgccaggtgagtattggttcacattttgcaataccctagaacatacatattattattaatctcatatttagatggggaaactaaggttagaaatgttaagtaacttacccaaggtcacccagccagtaaggggaagggtggggatttaaacccaggtcacgtgacttcagagcttgagctcttaaccgctgctcacccgactccatagaccaaacctgtggtttcatggtatgatcaactaacattaattctgctttccctttctcttgaactgcatcccctgtagtttcatttggaagtgatttcctttgttggccattactcttcagagtggtggtgaggttgggaagccagcagagtggcctgctgtgggtattgaatgctgatgttgtcataggaagtctctcatttgctttgctttgcttgactactttttggtttttaacctgttatttaagccaaagtatttgatatgggaacaggaagcctcttaagggtaaggaaggcattttgtcttcttacctttgcttgaaggcatcaagatgattgtcttgggtcagagtcagagcctgagatggggattcttctttaagtgatttgttgagggagttcttttggggaaaagctacaaggaagtgagggaggaagagcagggccagggaagctaagcaaagatgtggtatagctgaggtctagctcagcctgatccacagaggagctgagcatgacttgtgacacagagtttgctctgcattgaggcaacagggctaagtttgtttgtttgtttttttggacagagttttactcttgttgcccaggctggagtgcaatggcataatcttggctcaccacaacctccacctactgggttcaagcgattctcctgcctcagctgctggagtagctgggattacaggcatgtgccaccacgcccggctaattttctattttcagtagagacgaggtttctccatgttggtcaggctggtcttgaactcccgacctcaggtggtccggccgaggcctcccaaattgctgggattacaggcatgagccaccgcacctggcctgggctaagcttttatactcctgcatcaggtggttattggccttgggtgtaacctcccagatgtctccaggtgaagtggctcccattagctaaagacaattctgcagagaaggatgaggtgcagcgtaattagcagccaacacctgcagcagttgggggatgagtgcacttgccaggtaaaggagacctggaaggggcaccaaaaacatccactatagtgtttgaggtcagtggcccatctgatacggcttagctctgtgtccccacccaaatttcaccttgaattgtaataatccccatgtgtccatgagagggaccctgtgggaggtaactgaatcatgggggcaggtttttgccatgctgtttttgtgacagtgagtaagtcttatgagatctagtcgttttataaaagagagttcccctgcacatgccctcttgcctgtcagcatgtaagacatgcctttgctcttcctttgccttctgccatgatagtgaggcctccccagccatgtggaactgtgaatccattaaacctttttcctttataaattacccagtcttgggtacgtctttattagcagcatgagaacaggctaatacaccatcctttttggatttgtgatttttttttttctgggggtgatattgtcaagttgagaggaggtagcgaagtgtgtaaggtgtaagtgtagtggtggcatgtggccttgtcagggcctcagcacatgccttttattgacactgaagtgttgtgtgtaggactgtgtaagggcagggtggttgttgtgcacactgtcctgatctttggacctagaactgatacattgtgtctagtcaccaggggagttgtccctttctatctttttagacgggcaagttggctgccaaaaatgtttaggcaattctggtggtgttttcctttctcatgaaataggcggcttcaacctcatagaataagaatcagccactctgcctaacaatattaatactaacaccaatgccctttattaagtgccaggggatttacttgtattaccagatctattcctctccatgaccctgcaagatgggaatcataggatccatttgatggtccagaataataaatattaggaagagtcagcattttgtccaagggcacaccattaaaacagtttgcgtcaaagtagcaaagaaaataaatcacagcatcaaagaacaggagattaagagaaactgaggaaaaaccacacgatctcggaggggtagagaatactatatttataatgaagaagtctgactctttggattaatataaaaatcttgccatgtagcatgtgggagaggagagcaagggaggctcacatgctggagacaggatttggttccaatgctatctgactctaaggctgatacatctttctgtgccatggtgttttaataagcatgtaatttagaaatgtccacccacttacttcggaaccatagatttcattaaaggagagtaaaaacccaggctttggatacagacagacttgagaaacagctctaagatttgggcaaggctggtcttgaactcctgacctctctattcatcctctctatgcctcagtttcctatttgttaaatggggatgatatttagcttgcatgactgtcatatggatgagatgacagcatgtatacaaaatgcctatcatgtaaaaagcacttagtctttaccagttattttaatatattcatgaagaagtttcagttttgtcgaggagaaaagaggctgtgtcagttctttattctctcataacaaactgtcacaacatttggcagcttaaacaataacaatttgttatttcccatgagttgaggggttgactgggtaagccgtccagttagttatatttcatgtaatgttagcttagtcatttatgtggttgcattcagctgtgaacttagctgggcctgggatgtacaggaaggctccttcacaagaccttcacaactcctctccttgctcaattgtctaacccagattcttacatggtgactagatttcaagttctccaaagtggaagcatccctgctgctatggactgaatgtttgtgtccccttgaaattgctatgtcgaagcccttatccccagggtgatggtgtttggaggtaggacatctgggggtcattagagtttgatgaagtcatgacattggagcacttatgatgaaattaatgcttatgaaacgaggaagagatgagatctctgcatgcatgcaccaaggaaggccatgggaggacaaatccagaaacacagctctcaccaagaacccaactatgccggcacactgatctcagacttccaacctgtagaaacatgagatataaatgttcatggtctaatctccatctgctgtactctgttatagcagcctgaactaagacacttgtcttcttaaggtttagcctggaattggtgcaccgtcaattctataagtaaagcaagtcacatggacaatgcggattcaaggggagggaaattaaactcagagtattgttggcagaatggcatgcatgtacttgaaggggaggagtgattggcagccatatttgaagactatctctcttggatacattcatcctagatcattcataaacaaggtgattttatgagaagtttaattcttactgttctgcatttgcagtgcagacatttaccatgatgacttattccctgtagagtgggttaatgttttcagacatggcttcagaggacctggggcttcagttgagccctgaataaaggataggaaattgctatggaaggaaaagaaaagggtctgttgtatgctttgtttttttcactcacatgaaccaggacaaactcagtgtgccttgggtaaggagggtggcgacactgattttaactgtcaaattgatctagagttgtcagatgggataatttaaccctcaaatgaaggtgatttatcctatgtattgtaatcaaatagtcatctaagtcactccccatgagctctggtaaatcacttttagtacatattgaaagtgaccgtattgtattttattgcagaattgcgtcttatagtaataactaatgcatgccattggcttttgctctagcaccgaattacactcacttggaggcacatggatccaggtgggcactgttgcttccatttgcttgtccacagtcagaactgagaggcaggtaggaaaactgtactgctgcagtctttgtagattagctcaattcagagacacctgtggtcttgtgaaatgccaaactttactccagtggcatttgggtcaatgtgaactaggatgggcctagcaattctattaggtgaatgacaagtgctttgtaatgaaacagaaggactttatttaaacagatataaggactggacagaaatcaggcttaaattataccttatctgggctcctgctgtaaccttgtaactggtcttaccacttgtggtctcaagactattttgtcctgcagcccccagagcaatctccctgaaatgcaaggtcaactatgctggcccccggcttaaagccatcatggcttcccaatgcctgtgggatgttgtccacactcttagcttagcttacaaggctctccatagtctggctcctgcccacctgtccagcttcatcttgcgccactgcccattttgaactttccatgctacctacataccgtgattcacttctccacactgttgttcatgtccttctgtctgcctgagatgtgctctcccagcttcctgactctgacctcctttgcctggccaactccttctggtgctggaagatgcaccacaaacatgcccccatgggagcatgcgcagatgctctcaggctgtgctcataatttcctgagtctctcccctcatcatttcacttctcacatagcattattatgacttatttaggcctgtagctctactactagatggactgtgagctccttgaaggcaggaacccatcttaataatatgggtatcccaagaaaccagcacaataactggttggcccagaggagatgctcaataaatgtttgtggtattagtaaatttatgaaaatacctctttgggttgtcacagaagcacatgagcagtggagacaagattctcatcttgaatctgagtctcctttgatctgaggagcttcctgttttgaggttacacatttattttagagacagagtctcactcttgtcccccaggctggagtgcaatggcacgatctggtctcactgcaacctgcacctcctgggttcaagcgattctcctctcttagcctcctgagtagctggaattacaggtgcatgccaccacgcccagctaatttttgtatttttagtagagacagtgttttgccacattggccaggctggtctcaaactcctgacctcagatgatccacccatctcagcctcccaaagtgctgggattacaggcatgagcccccaagcctggcctgaggttgcatatttaggttggaattagtgtgcatgttctccatgaaggtgaaatttgtatggctctgggacctaaaagcctaggcaagggcatagagatatattagcctggggtggactggggaatgttttactagttagcattacgtgagaaattaagcaagtcttacacacatggatttgagacccagaatctgctccatttctggggcttttgtgtgttagaaataagtacagctgattatttcatttatgttggtggatttggggctgccaagcttctctgaagggcccacattttcctttggtactctatttctcattttgcccttagaaataaggaatcttggagtaaattccagaggtggtaggagaagggagaatgcattcccacattggtagctaaggttcataagctcctagaaaagaagggaaagatctctgagcctagaacatgggactcccctttcttactgtaatttgcagacagattggggcaagaaactccatgcagcttggaaacatgtcagagtgtgccttacaaggaaacaaggcaaatacaggaggaaaaaggtaggctgctgtttggtctttagaaacaagcattttcttacatccttttattcccggtatatgtcctatgaaagtcattctggtagcaatggtaatagtactattaataataatgatgtacatatattggatgtgttcaacatgccaggcaccatgccaagctttttacctggcttacttcatttcaatttataactttatgaggcagatacattttcatttctatgttacagatgaggcacagagaggcatagaaacttgcccaagcttggaggagctgggatttcaacttaatctaacacagcactgtatgttctcaagttgtcactatattacctcccaaacaacatttacactaacaagtgcagccaatgtttattgagtgctaactctgtgctgggcacattgccaacctttacatgaagagcctcagttacccctcagcaccatctttggggtgggttattattatccttatttcaaagatcaaacaactgagacttagagattcagtaacatgtccaaggtcacacagctagttcatggtgggacctgagttcattcttaggctgcttgtctcctaagcctctagtccaactttttaatttttttattttattttattttttgatagggtctcactctgtcacccaggctggagtacagtggtgtgatcttggctcactacaactctgcctctcaggcccaagcgattctcctgcctcagcctcctgagtagctgggattacaggtgcttgcctctaccacctggctaatttttgtatttttagtagagatggggtttcaccatgttggccaggcttctcggcctccctgagttctgggattacaggcatgagccaccatgcctggccatagtccaacttttaaattttggtttaggaagtgttttttatcccatccatccagatctccctctcatagtcagttttcacctcttccctggggatacggctcaaggagaactttcatcatcttcaaatgcaaagaccacgtggcaattagagtgtgggggattccaagccccttctggtgattgtggacttgaaaaacagtagtggtaatgaataattaaaggttaaacaaagggaatagttctagagactgggtgaaggggagcctgttttattccactgagtttgaagccagaacaccatgtcttggcactgacatgccttggagacttcgtattgatgatcatggctaactgactctttctcagctctcagtatcattcatagtcaggactttacatgtgtgtgtgtaatgtatatatatctgtgtgcacgtgtgtgcgcgcgcgcgcgcacgcacacacacacacacacacacacacgtaaagtcctgactaccagtgataataatacatagttttttgggggaagaagggatgcctcttgtatgcacagcactcaacttctgcttttgggcagggaagatggaaaaaaaaggtaaaatggggttatttgtcccaagttgacttgacagtctaagcagggggataaggcagatgaatatgtgaacaatgttttggtagattagcttggttagaggattttcaaactttttgaaattataaaacctacaaatatatattttttaaatcacaaaacaaaaccttaatgaatcagtaaaattctcataatctttatacaggaaaggtagtagagaaaagtttatatcagtttgcaactacagatttatgcccttacatatgagtggtagatatgtgaaatatgattattagtaataaagtgaagaggatgttatagagagggatgcaataaaatttatctttttcatcatgttcctcatctgggttaccatgaaactaatgtgaacagtttccagctccaggcaaaacatttacactcctcacctttcagtgctatcatttgttgcatttgggaacaaatgtgcagcttcagggtgagaatggaagaatatataggcaaaagaagagctatgaaatatattaataacgaatattctcacctgaaaactatgaatttcaagatcacacttaaggtccacttcaatttaaaaaatgtcctgaggatctgaataatgacaattggaaaattaaaagagcattgatagcttaagtgccaatgaactcaaggccaagatctcagttttcatgcaaactggtggctctgacttcgttccactgctatagccttggctgaggatcttacaagtgggtttttgaaatggattcgggtggaggctcagggagtgcacctgttacctccatggggcaaaggctcaatgtagggaacttatgagagttggagagcatgatgtgtgctgtgtagacagcacagcatggggacccagcactgccctcatcgacatttctcttagaaaatgtgattacaaggcaggcagatcacaaggtcaagggatcaagaccatcctggccaacatggtgaaaccctgtctctactaaaaatacaaaaattagctgggtgtggtggcatgtgcctgtagtcccagctactcagtaggctgaggcaggagaatctcttgaacccgggaggcggagcttgcagtgagccgagattgtgccattgcactctagcctggtgacagactgagactccatctcaaaaaaaaaaaaaagaaaaaaaagaaaagaaaacgtgattacattgtaggagctggaggattgttactaaatcattcaaaacagcaaaagttaaaaataaaatagcgaccagttaaaaatattccactggtctaacaaggaggatataaataaattatgatgccttatagatataatattaggaatatttttcagccattaaaaactacgttttaggagagtatttaataatggggatattatagataaatacagatagatttaggtataaaatggagactatttctttctttaaagtactttcttgatttttttaagtcagtatatccatctctctttccctagcaaatattctccagagaaacagacaaacatttttcattggccatctctggatataaggtaattttagttttctttctttctttcattttattttttaaaaaagagatggagtctcactatattgctcaggctggcatcaaacttgtgagctcatgcgatctgccctctcagcctaccaatgtgctaggattacaggcacgagccaccacgcctggcctgattttaattttcctatttacatctttctgattaactttttcccttataatcacatattgtctttgcaaccataaaaaaaaagcaacaagcgccagctatttctctagtggcatgttaatcttatgcagtattggaatgggagcaggcagagggcttggtcctagatgctccgtttattagttggctcatggaggataagcctgagcttctgagagtctggggtaaacaagtggccatgccttcctcacaggtccctggaggatcggagaagtgatgtgtgctgtgcaaaggtgaaggtttctagccaaggccactgctggacttgcacttctgcctttctcctgggggtcactttttcactcttcagggcttggctcaaatggtacttccccaggtaaccttccctggcccccacatacgatcaggtttcctctttgaatgcccttgtaacacttcagaactcttatcattgttgcaattttgcattcattcttgaggttattggatgaatgtgtggctcctcctctgaatggtctgtttcgtcacttttgaacatccctccattactggcagatagtagtctctcacaaatgtttggtaaacgaatgaactcttcaatgcaaaggtttagaatcagctggtggggagacagatctagtattttgaggtggttggagggatcatggtgttaaccaagagaaagctcttagcagagtcactgtataatttttttctttgggaaagagtgtgtgcttcaacataccagagagctaaggctttgcactgtaatatgggttaatcaatcaagaaatcaatcaacacctacttatccagtgcagaccatgtgcccagcacaatgctagaggcactaagacttttgggaagtggctttgcctctttctttcagttcacaaaatgaagtggttaagacttgcagaaatcagaagtggaagaatgcaaactgatcagtgattgcaatgactggaaaagggctatgaaacgccagtgcatttgagaccaagcattatggtgatggagtctcacatcctgaaacccagggctaatcctccccaagagagacgtggataggaaaattcccctgataattattgcaaaagtgtcatcttaaaaacaaacaaatatcacaagatgcctccccaaacttgaaagcatgaaacaaaaaagcaaactattcctaatcaggctaattgtagagttagtggctctaaattgtgttggttttgccagttctgccttttggaggtggggacaggggagatttggtttaacttaattagcatttccaactggaaatgtgacaatataactaccctaaactgttgctcagtaaaaatgcagaaggagaattcctcctcagtcacatttatacagaaaccaaggacaggaagagaaagaagacataggctattaggggaaggaatatgtgggctacagatacattcagacgccaaaacttgctgctcattttcaacctctcacctaattttttttctcctcctggaatctatgactataaattcacttctaaggggaaaaaatcagcccatgctcacagcctgctaggagcgcttatacctcccctcctccaaccttccactgcccggtacattattttggaaatttgagcagagttgtctttggaatgacggcgcctcatcaatacagaatttgtgataatctggtccttgggtgggcttgagtttatccacataatggaggtggagtggggagacagaagtatgttaattaagactaaaggcccacaaactcttttcaagtaaagtagccttagctacagctgattcttttctcttagtaaaaacattgataagtttaccaagaccccttgcatgttccctgtctccacatgtgctagaaagtattacgttggtgcaaaagtaattgtaccaataatgcatctgcatttattaagtgtcctttaatgcccacttcactgtagcagtccagttagggactattagcaagggtttatagtattattatgaaagaatctggatactagcagtgagaggaagactttccgcttaaggaaatattgttcccgtaggggcacaaatatatgaacaagcgtctgcaaaaactccaggctagggtcagagcatcttaagtgaattccaggaaagtggtttatagtctagatgaaagagagaaatgcatttagcgggggttcttgaccaaactcaaggctccctctttggatcagagtatggggcctaccttggcgggtgcaggggttcctaggcaggtgggaggtctctatttgtgttgaggttgcagctctcttctccttctacattttatctcctacgtttttgctaccatctggttgttttcttaccacattgttcttgcctctggcctgcagtgggcacccttaagaaaagtccatttagatgtcttctttccttgctagtcttcatgtttgtcagttctgaatttgcatccaatgcctgtcctcagtccctgggccttccccttgatgtcttcaatgtgaaagctattcagccatggggactgtgctcctcccttcaccctcctgtcctccaaggaaaatcaggaagtatctggacagactgttggaacaaagcaaaatatttaagttcctgtcatcgtcccactgtggcttttgatcatttctttcagtagccagtttagtttaattatttatagaaagacattcatagtgctagaggaaatgtcctataaagcatttatcaaagaatgagtctttgtaatctgagacatccccagagcaaaagcaaagtatctgggctgatgattcaggtattacctttggagggaagcaggatgagatttctagagttgctggagtttgaatctctgggttgactcagtagataagcctaaaatctgtaggaggtacaatgcctgtgcacggtcccagtccttccaacaacaaaatgagggggtcattcccatatcatcattatacatggagaaactgaggcacagagaaataaagtacattgcccaaagtttctaaaatacatagtgaagtggaatctagatttagagagaggcagtctggtgtaattgctgtgttcttaatactctggactcctgttgtggacatgctggtcccttggttgttcagtgtctgaggacagtggcttgtctgattttctcagcttcctcgagatggatctacaaattggactgaactacagcctcagaagtttataaggagtttcatcttgataatttggtgggactggaagatgtctttgaccaatagaccagtatccaatgtactcaagatggatcagcctgcttctgccacttcctcgatctttaacttacccaagctatttaatttttgaaagtctctgttttctcacttgtagtttcacagtggtctctcattctgtgttgtgaggataaaagagaagagggagcatgtggaaggcacttggtacatagttaagtgtttcagaaatgtttctagattttagctgaggtcctgtggcatcttagagtattgtccaggaatcttggtggcagtatttcccaaattttagcatgtacaggaatgatctgtgggggaagtgtcaaatctgcatattcccaagccccacccaagtgattcagattggaccaggtggtgctacagtggatgcagccatccagatggcaccactgagaaagctggctcacaggccagcaggggcccctcccaccccttgactaaaccctctgcattccttcagactcttcttaccctgaatggagagtgctagaaacgttcttagtagctttctaaaggctttataaggccaacgagtaataatttggtgatttcagaagcagccctcagaataatatattttctaccccttcccccacccactcttggctcctggccctacctccttcacccctcttcgatttgtaccacagttcgtggcattttctgaacctcagggctcctgtctggctagttatttatttagctgaggaactgcagcacctaattaataggaaattagctgtgagtgtaacatttggcccgtagtcaaggcccaagaagttataaatacgcaccacgtgagtggcctgggcacctgattcttggaagatccagaagtggcacttcctgtgcagttccaggaagtgaagtatgtgctgcataggttgtgggtagccaggagcaggcatcacctgccctgaggccagcaggaccatcctggggagcacaggggcctgtctgcttctccccatttcccagagagctcattgactcttctcaacttagctgtcttttcaaaggccaggtgggagaggacacatcaaggaaatgagagcagaggctggaggggacttaggagagggtatagggtcccttacagggtggcccaagcaccgtgatcctccaaagacactaggtctgctgttgtttcagacacttgcattggcttcttccaggggcacgtgaggtacagcttcatctaacaccttgacagtagggactctgcattgaaggggatctcactgccattcacaggttgcagaggaaggggaaaaatcttttccttctactcttctaggttcctggctggggcccctataacaaaagatggattaagaagagaatagcacacaaaattatttactatgttttatgtaacaggggagccttcataaggtaaccaagatttgaagaacagttaaccctgggtgttttttatggcagtcttgatgaagagtgaaaaggcatggagaaacttgatagggcaaacagtgtgaggtaagcatagtgaactccaggaaatgtagctgggcctgtctggattcctccctgggtccctagtcttggcagataagtatgctcccttcctctgggcacctctcatgtgacctgcttcaggggaaggtcagaaaattcttcctgggttttctcaaatttttttagattaaaatattcaacatgccaaagtgctgtattttggggtagtgtgttctgaaccccatcacagaccatgggaactgagcctagaggaggttagagatcctgcccaaaccagagagaggcagagttcagatttggaataaacatgttcagccctcaagtttgatgctgtttgcagaatctcatagtttcctgattacttcaaaaggaaaatcaggctgggaggagaaaaatgtttttaaaagccccaaggaggaaaagactgagggggaaggaggagcaaaagggtcaaggggaaggtaagggcaagtctaggagttccttaggaggcagcggtgcccccacggaaggaggaggcggtgtctgtgggtcagaggcaaagctattttctctagatttgcttgatttcagttatctcactttcttttttctcaacttcccctgcagggaaataggaactgggcaacctgtctattcccttgtgcgagttaaaaatctgctgataaaagtacctattccaattctaagtgtgtttgttatgagccaaaccctggagggtgggaggagggaggtgcctggttccatggcagagcagggccaggaggtaaagctggttggaggacatcagggaacagaaagcacagagtaagtgaaatattttgccagctttatttaaaagatcgatcgaagcctctttaacacaggcttctacctgagaactggtataatgaatctggcatttatgtgactctggaaggagccttccgaaggaggagaaaaatgtaaaagaaattgcatctttgggtgggtcccagaaggggttgatatgaagaaagaaaataactcattgctgatgtcacagagcagaagatggacatggaggctgcatatcacttagactaagtgggacagagtctcccttggaaagaaaaaatgcctctagtctcactcagggaagcaagttatcaatcagagcccaggctaagaacacagatatcactgatgccctgaaagaaagataatacatcttccttttcccacctctacccattagccagaggcatttcctgaccttccactgaagaagaaaggggtccctcctgatttcttgtcctttgggggatgttaccaattctttactatcccaggcagtgcttaggcaccaaatgactttggagtcagaaagagctgagttcaaacatcacattcctgcctgtgagtttggacatgtttgattatctcttgatgacctcagttttctgatttgtttaaaaatataagataatatctactttacagggtttttaaaaggactaaatgaggtaaaagtcaaaaccacaaacatagcacctgccatgtagttgagacttaagaataataagtattgctgttattgttatgcaaataaaagaatcaagaataatacttggtagccactcaataatcagtttctgttcccttgttaaaggtcacatcagtaatagtgatgctagacattttgtctccctccacaactctcccctaattcaaccctaagccaaaacttaggccaacatcaaccctattcccaacaatatgcccagctgtattccccaatcctaaccccaacctagactaaactataaccccaactctatctcaatttccaactctatcccaactatattattcagggttcttcggagaaacagaaccaataggatgtgtatgtataatatgcctctctcctattgagagagagtgaaagagggagaggggagagagacagtgagagaggacagaagagagatttttattaaaagaaattggctcacgtgattatggaggctgaaaagtcccaagctctacagggtgagttggcaagctggagacccaggaaagctgatgttgtagttctagtctaaagactggcaggtctgagattgaggaagagccagtgtttcagttcaaaggccattagacaggacagattctgtcttactgcgggaggtcagcctttgtgttctattctgctcttcacccaattgcatgaagcctatgcacagtcaatctgttttattcaacctacaaatttaactgttaatctcacccaaaaaaacgccctaacagaaacaactagaataatgtttgttcaagtatctgggtacctgatagcccaatcaactttgcacctaaaattaatcattttaatcatcacaccaatcttatccttaaccctattcccagtgatattacaaccctaaccctaagtctaaccccaacctcagaccaataattactattattattattattttttgagacagagtcttgctctgtcacccaggctagagtacagtggcataatcttggctcactgcaaccctccacctcttgggttcaagcaattctcgtgcctctgcctcctgagtagctggaattaaaagtgtgtgcaaacatatatatatatattttttgtatatttagtagagatggggttttgctatgttggtcaggctggtcttgaactcctgacctcaagcaatccacccgcctcggcctcccaaagtgctgggattacaggcatgagccaccacgcccagtcagtaattactattaaatatgcaacatgtgctagatattgttagttcctcagctttcttctttttagtgtggatacaaatcctactctagttgccaaaacttattaatcaatgtgatgaatccgcatcataaagtcaacttaataatatatctccagagtatggacttgaaagggagctgtgcttggaatagattttactcagatagtcacacaagatgatcagcacctgctttggcatgaggagccactcaggcacacagagggagttctatttgttgtgccagctcctgctccattctcctgaccaagccctgctttaatagggtctgtgtggagttaagatggccagtgatggaggcctgggcacaacaccccagagatgtcttaactcagagaagatagatttgtagaccattaggagctgaaaatatgtgttagtattattactcatatagatcacttagttttctgtcagatttttgtctcagacttatcccctatgatgaaaaggaaacttcttgatttctacaaagattcctactgaatcaatgagcattagaattgaaagggatgggctgagcatggtgggtcatgcctgtaatcccagcactttgggaggccaaggcaggaagattgcttgaggccagatgtttgagagcagcgtaggcaacatagcaagaccccacctctaaaacaaatgtttaaaaaaattagctgggtatggtgttgcacgtctacagtcccagccactcgggaggctaaggtgggaagaccacatgagcccaggaggtcaaggctgcagtgagcagtgatcacaccactgcactctagcctgggtgacagagcaacaccctgtctcaatttttgaaaaatgaaaaagaataattattttatcccattgttctcaactttaaaatcactgatgcttgagtcttgtcttggagcaatccatccatctgtggggtgaaccctgggaattagtatttttagaggcactcttctagcgttactatggctaaatgtttccaccagtctggctaaaacttctcatttcatggatggaaaaagtgagactcaaagaggctaagtgactttcataaaagcagacttgcagggacaaagccagcacctaaggttttataaatactagtccagtgctcttgttcagacaccacattccttctcatcttgtttcctcagatttatagccaaaaacaatgggaccatcagggacccaccttaggaccctcatagcgagtggtcctccagctcagcccatgtgcatccagctgaaaggctttcatacctctgccctgcataggtcttgttcagagaagtgggtgcactgtggcagaaacaattctctactaacccatttggaacaataaagaaataaatcctaatccaccaaccttgaccagacagctgaaggttgtgctcacttggtactgaccttgtaaagatggattgcaattttggggagtcgattttattttgtttttatgtttatttttccttctgggtacctagagttcatattcatcctagagagttctgggaattgcaggtccaatgctattagcatctgcttcattcctctgcctttctgcccaactcccttgttttctaattcttaaaaaatttttctattttttaagacaatttatactgaatgaattgttattttaaaataggtgagtgaaatccaccttaagtactgatttgatgtatttagaaaatatggaggcctctgaagcagaccagcaaggcagcctgtgtatttcccctaggtgtggttccctctttattaccagagggtacataggagattctgcattcatttagtcattcattcaaataatgtttatggatttaattttctttaggtccagggaacttgataggcactaagggaaactaaggtgaattactgtcatcgcttgacctcaagaagcttaaatctaatgggaagggaagaagagtatcctcgaacacccgtactgtatgcaatgtgatgttccctaagggtatggcaataggagtataggaatgagtgggattatttctagctgaggatcagggaaggttctgttgatgatttgacattttagctcagttttggaaaattgatgtgattttgacagaaataagtataaatcttttgtgtaggcaaaggaacagctggagcaaagaaagacaaaggggagggaaagtatgtgcttgtgtgttggggagtatatctttggtcttcatatgataggtaggagggagcatctgaaaaaaaaattatgtgtagacctcacggatgcttatgggttgaaactggctttagtgactggtctacttcctcagttttacagattataaagtaataataataatagcaatatttgaacttaactctcattgcatgctttctataggcagttactgaactacagccattacatgaattttctcattattttcttacaacattccttggaggtaagtattattattatccccactttgcagatgaggaatctaaggctcataggtcagtaagccagtaaaaggcagagttgggatttgaacccaaggctacactctttccgtggccaggattttaaccggggtattcagtactggtgccattatgggggaggaaaagatgatggattcattttggacatgttgagttagaggggcccatgagacctccaggagaagaggtgagtctgaagcttgaagatggaataatttgaaataaaatgaatttgtttctgaaagttgtatcctaacgttggcatattcagaacaccagtcacattgacttgccctgcagaatttccagatgggaattctagcagctcacatgccaaggctgctccttagtgtgtgtatggcttgccagacccatcttccaaagctgcactcaggttttttttttttttgacatgtctcagctcctttctccaccatgtgtgcctgcagtactgtctccttttatctaaaggtgttttgcaacttgaccccttgctgcctgccaaggtttacctctgagaagtatcaagctgttcagcattggctagaacaagctcttctgaccctgtcgacccaacagtgaaaaagtgtcagtgtagggaagcggaagatgttaagcatgtgcatgaggaaggaaatagtttctttccagcaggtgagaagcccagagagttttggtggcctgggcaagctcctatgcctcaggtgaaaaagagaagttcagtaaagctgccttgcctggttttaagttatattgtcttctaattccttcttccctcaccttcctcttgtcctaataccttcaactccaagtctcttgtcatttcctgacagactggcaggtatacctgacagactggtataattgttggaatcaggaatgtctgaccaatggggaaactgtggcagtaaggagtggagaaaacttagtgaagggcttgcagtccatgactaagaacacagacttcacgtgatcctgtaagaagacccgtcagggaagagatctaagggttggagtctgtattattcttctattgctgctgtcacaaattacctcaaacttagtggcttaaaacaagatacgtttattagctcacggttctgtaggtcagaagcaaaagcaggctttgatgagtccccctccttagggtcttacaaggctgcaatcaaggtgttgcctgggtgggctcttatctgcagattctgggaagaacccctatccaagctcaggcctattgttggccaaattctatgcctcacagttatgggattgaagtccccattttttttcttgttgtcagccaagagctactcttagctcctaagggtctcttggattccttgtcacgttgcctacatctttgagtgtagcaatggttcatcaaatcctacttatgcttcaaatctctgatttctgctacttgctggtgaaaatgctctgccttttaaaggctcatgtgattctattgggcccacctagataatcttccttttgccatgtacgttagcttgctaggactgccgtaacaagctgggtggctactgtgtttgaatgtgtcccccaaagtttatatgttgggtacttagtccccaatgcaacaatgtgagagttgggacctttaagaggtgattaggtcacgtgggctgtaccctatgaatggatttgtgtcattatcaagggagaacattagttatcattgaagtaggttcctgatgaaaggatgagtttagctcccttcccttttcttgcgtgcatgctctcttctatcttccactatgggatgatgcagcaagaaggccctcccaagatgtgggctccttgaccttggacttcttagcttccagaaacggtaagaaataaatctctgctctttataaattacccagtctccagtattctattatagcagtacaaaatggactaaaacagtggctcggacaacaaaattttgttgcctcccagttctgaaggctagaagtctgaagtgaagttactgatgctccttgacttacaacgaggtgatgtcctgacaaacccatggtaagttgaaaatattgtaagttgaaaatacatttaatacaccaaacctaccaaacatcatagcttagcccagcctacgttaaacatgctcagaacccttatgttaccttacaattgggcaaaatcataaggcaaatcctgttttacagtaaaatgttgaatatctcatgtaatttatcgaaatgttgtactgaaagtgaaaaacagaatggttgtatgggtgctcaaagtaaggtgactactgaatgcgtaacactttcacaccatcgtaaagctgaaaaattgtcagtcaaatcttcccaagtcagggaccgtctgtattggcaagattgattccttctgagggttgtgagggagggatctgttccaggcctctctttggcttgtagatagatgactgtcttcatatttgtatggtgttttccttgtccaaatttccttttttatcaggacatctagtcatattggatttaggccaaccctaatgaccccatcataactaattacatctgttaccatgtttccaagtaaggacacagcatcctgagatactggggtttaggacttcagcatatgaatttagggggatgcaattaaactcatagcaccatatatcatacataatcataacagtcacatcttatttgctcatactcaaaagggagggatttggacaaaggtgagggtcattggaggtcattcttagaattctgcttgtcaccctgcctctgagtcaggatacctgctcagagggatgtgaggacagctatgatgaataaaaagaatactgctgaccatggtgagaacagctacagaggagtgggtgaaggccatgatcaatgggttgcaagtgaacaagaagtgaagaaaatgcagagactgctccactcaagaagcagctgtggccaagaggaggccaggtggtgagaagagagggaaacagaggtgaataacagttccactaaaatccaagagacctgagcttgctagttgtctagagacaactgacagagaggggcttgcaggcggctaaagccattcaacaatttctggttgtccacatgccccttctatgggaacttgacttggtaccaggtagaggattttgtagaactccacatgttattaaatggcctttgcaaagagacttgtgtgcaatctggctgaattatagttcctttggagattcatgtttgcttacttgtggctctgtaactctcagccttaatatcacagaaatgcatttctatctggtcttcacttccctgattctttaaaaattttatgtgattgttcttggaaggaaagctttggtggaatccagacatagtattggccactattgattgagggtctgctgtatgacaggccctgtgagaagggtgcatgtatattagtccttatttcctttttaccaggtagattgttaccttcatttcacaaatggggaaactgagtctcagaaagcttcagggctgtggctgaggttatagcattgctaagcagtattgctctgcctcctgggttagtcaccgcactcacattaaagacctttttcttctgaaagttggcaattttcttttgtcttgataaatgttattttcctaggatgtacttagagcaataaatgttctgtgaaaacaaaagtgtagtgttcactttctattcccctcccagtcccaaacttctgggcttcccagttcacctatttgagaaattacttagtgaaacattttcatctcccacccagaataattcattgccaggcaaagaacaatgcagagacattacagccagtgagactttttccaaaggtcacacatcgacgtccagggatttgtgatggacacagtgcccaaggcacaacatcacatttgcttctctttctggatgcgtttcatcatgaaagggtttgcaagcctccatctgctgacttgcagtgggctgttccccaaaatgcatgccttgttctcatttccaaggagaattgcaaatcttagaaggtattttaagggaatatgacaggagcaggaacccagagcaattggaattcagagtggtggagtgaagaatcagcaggcatggctgccagagtttgtaggcttgagaagcaatgaattctgccaggagtgagagtgcttggtgaaaaccctggaaagaaaatcacaggttaactgggttttagaggcagtgtaggaatctgtcaggtgggcagcaggtagaaggtgggagagaagaacatctcaggtataggagagatacacaggtttaaatgtcagtgctgtggtgccaagtggctcaagtataattgagtatattagtaatgatgccaaccgcccccgtaataataaacacatacatttttatgtcacctactgtatgtcagggtacattaattatattctaagcacattaattatattaactcgtatattcctcagtgcaaccacacaaggtgaatactgttattatccttgctttacagatcaggaaactgaggcacaaggaggaaaataatcatgccaaagaactatcaatgagcagattggggattttattccagcagtttactctacagcagctctgtccagtggaaatttcagtgatgatggaaatgttttgaatccttgcttttagcaaggaagccaccacccacatgtgctattgagcacttgaaatgtggctcgtgagacacatgaattttacattttaattttgatttattatatttaaatgtagacaggcacatgcggctagtgaggacagtattggacaacacagttagttagagtctgcttatctataaccccctgctgcctttcaaattggggagtgtcaagttgattctgtcatgatagttctagcattaaaaaccaccacaggaatcatggccatcatttatttagctcttatgtgcagggcaacatgctcagtgcttcctgtgggttatttcatgtaatatccatgacaaccttatgggtgatggctaagagcatgaactctggcaggtttgaactaccagtgttcaaaacccagctctgctatttgttagttctgcagccttcagcaagttgcttatcctttctatgcctcagtttcctcatttggaaaatggagtaaataatagcatccccttcatgtggttgttatgatgatcaagaggctgtcctttggaagacagcacagtgcctgacatgggacaaattcagtatctgaaggtattgttattattacccttatactttagatgaagaaaccaaggcatggaaaggtaaagtatcatgctgaaaggtacagctaactgagggagagttggaattcaacccacaggtagcctgatttcaaagttcaggttcttaacaattatatggtggtttatttttttcttttcttttctttttctttttttttttttatttttgagacagagtctcactctgttgcccaggctggagtgcagtggcatgatctcagctcactgcaacctctgcctcctgggttcaagtgattcccttgtctcagtctcctgagtagctgggattacaggcatgcgccatgatgcccggctaagttttgtagttttagtagagacagggtttcctcatgttggccaggctggtcttgaactcctgacctcaagtgatccacctgccttggcctctcaaagtgctgagattacaggtgtgatgagcccagcccatcctgtggtttccgatcacagtttctaaaattgtggtttgtggagaactggtactaaaatgcttcagagtgcttgttgaaaatatgattgcctagactcactaaaaactgttcaattagacttttggggtcagagacctgggaatctgcattttaataaatttcccaggtgatttttcatgaacaccttaactaataataaatcaattaaaaaatttaacggtaagagaagtagaaggagagaccaggttttcagatgtagaagataccctggagagtagggttattctgcaaacagacttaattttagaaagatctttctggtggctggtgttgaagatggacttgataaagaacgtcctgggggtagatgtggggtgtggtgatggggctcattagtacagtgacagagtggacagggagggagggacagattctttggatgttttatagtaaaattgacaggatatggtagattactagaaactgaggagaaggaaaattaattgagaatcaaaaataatcctcaggtttctatgacacctgagtgggtaatgatattattaaccaagatggacaaggaattttggagattcagataaacttgaggacttctttggacatccaggtggagagaatcattaagcagctggaaatttggttttgagttcaaaagaggaatatatagcaaaaataaagtttggtgtcctgtcaacactaggggtggtatgtgacctgtgcagtgggtgagattgtcttggagaaactaagtggcaaggctcagcaactcaaatattgccaagggtgaggggttgaaacaagtgtgtgtagtggcctggtataagagaacaggtgttaagctgcttttattgcagctaatctaataactgcccaatcacacagcttttgaaaacactctatcagccacttagctgtacgacactgccccaagctcttagcctctacacacctggcacctcggggtctaagcctactgggtctgaccctattgagagcactcgggtgctgcccatgccagaagagaaggtcaccaaagcctagcccctgagggacaataacactcgagggctaagaacaggagctagtgaaagaggcataggaaaagtagatagaaaagaagtaggagaacaaggacacagctgtgttggagaggctgaaagaaagaaggatttcaatgagagggttgtcagcaagccacatgccaccaagagctcaagctgaagcctggggagaagttttggcatagacttgacaagctggacgtgcttggtgtcttttgccaccagtagagtaatgggggatggagccagggagggaatgagagtcgcaagtggaggcaaagaacatagattactttcttcagtggggaaaggaatgtgaaggtcacttgcttgagggggagacatggttggcacggggttgtttgtaggataagtggggcttgatcatgtttgtagggagagggaacacagagccagtggggtagaaggatctgaagatagttaaaaaaaatgacttttggatcaaaaccccagaggagggaagaatagtttgtatcttgaaaaaaaccagggtacctctttctttgggctaggaggaaaaggtagagaaaagcttagatctaggggcaagaatttgtaattggaattcttgcaagtgtaaatctaggttgtctgtttaaaacaagggcattggtgaagaacaaggataaacgtggtaatgtctacagcacattgagcatctgcacctgtgtgccaggcattgtttagcgctctttgggaattgtcttttttattcctgaaaggcaaatgtaattggcatacccattttacagcccacaaagagaagttaattgcctgtggtcacgcagctagtaagtggttgagctgagatcagatcccaggaagtctgagttcagagcttgctgtagctgctatacagtgtaataaagcagcaataatgatgacttgcattctcatagtactttttttcttaaaactttatccctattttacaggtgtggaaaccaaggcagaatttttacaggtgtggaaaccaaggcgaaatttgctcaactcatcacgcatcttggtagggtcagagctaggactggagctggggtctcttactttctagtcctgttctgcttcccaggaagcgaacacccacaagtagctcctgagtaaattatgttgcatttctgacatctcattccctctcttcctccttctattccagtctgcctactcctaccctgatctggaccccaggccccaaatgccaggaaggtggcctggcacctgctccttccttttggctggaatctttgtcctcccacatgagggcattgcccgcattccccaccaccactgccttgccttagtatgaggggcctcatgcaggcaagcagtggagtagaaggccgcatttgttttgcttttattgttaaataatataaatctcttggctgcaccaccggccagtacgtgagttgtgtgtcttcctgcatagttgctaatgagacagttaatcatttgtttattttgtatgaagagaggtggcagccatatctctcaaaccagacattgggctccaggaccctcagggaagctgcccacccctggcacatgagtcacccacagtcccagcacaatcctgccctgcaggccccatcaccttcttccctgaggaatggccaagatgcaggcatcagctgatgatgatgatgattactgttattgcagctattatttttataaatactcccttccttgagatgcaaaaaaaaaaaaatgtaatttgcaaagatgctttgttgggagataagtaggcttcctcttgggcacggagtttatctcactcgtgcataggttcctagaggtcgtgcaactcacgagataaagctccaggatcctccccagggaaggccagagtcagtgttcagctgttttcctagatccagggttaaagaggtgaaatcaactatgttcgtcctgtaggctccctggggccgaggctgcttttattagagcaaatcaggcctgtccagaagctgtgctatgggggaggagagagccaggaggaggtgaggaggggttggggtggggtgtgctgcagggattgctgtctgcacctgggctgcccaaactgaatgattgtcttaaagggctcccatctcatcgatttgcatgctgtcagcatcctcctgctattttcttggtgtttgtacaaatcctattgcccgaagcttaaatttcaattaactgggtccaactgtctgtgtcctgaggcacagggaatgggctggggttgctttgttttctgctgcggcactccatccttggcagtctgtctgtctgtcttgaacctcctgtcctgaaggctgcacctctctgtgaattgcttgcattccacagtcaggggcagaattacccagggcagggcttatgttttaggagtagttgatggctagatcaagaaacaggagcatgcagtggagtggaatcatccccttaccatggttgatttctagctttctgcttccccctgtgacatggtgagatgcttttatttttacttcctcatccagatatattcttgatctcatccttctttctcctccctattttcttcttctaaatatgtctttttaacctctgcatctttgttcttgcaatttccttcatcagaattttcttcccttccttttcctaccaatccttatcaaaatccatccttcacagctcaattcaagcgtcactccctccaggaagccctcccactgtccttcccagaagacttgaccttgctttctgtgcttccgattccttggatctcacagttctcccttcttagagtcagagctagcatctcattctgtacatcccacagtacagtatcacaccattcatattattttttttttttggttttgagtttgttctggttgagttttgttgtggattgaatggtggttcccccaaaagatatgttacatcttaattgctggaacttgtcaatgttaccttattggaaaaaatggtcatagcagatgtaatgaagttaaggatcttgagaagatggagagatcatcctggattagccagacggccctacatttaatgagaagcgtttatgtaagaaatacatagctgggtgcagtggctcacacctgtaatcccagcactttgggaggcccaggcaggtgggtcatctgaggtcaggagttcaagcagcctggccagcatggtgaaaccctgtctctactaaaaatacaaaaaattagccaggcgtggtggcggggacctgtagtcccagctactcgggaggctgaggcaggagaatggtgtgaactcaggaggtggagcttgcagtgagctgagatcttgccactgcactccatcctgcgtgacagagcgagactctgtctcaaaaagaaaaaaaaaaaaaaaaggttaggtgattgtggtggtgcatgactgtagtcccaactttgggaggctgggacaggagaatcgcttaaacctgggaggcagacgtcacggtaagcagagatcatgccaccgtactccagcctgggcaacagagggagaccctgtcaccccccagaaaaaaaggaaaaaaaaaaaaagaaatacacagggaagatttgacagaaagaggaggagacagtgatatgaagatggagacagagatgagaacgatgtggccacaggccaaggaattctggcagccaccagaagctggaagaagccaggaaggattatccccaagagccttcagagggagcatggccctgccaacacctagatttcagactgttggcctccagaactgtaagacaataagtttctgctgttctaagccatccagtctgtggcaatttgttacagtagccctaggaaagaaagggttctccttctctgaaagggaagacagggagaggcaggaagaaaacaaaataccagcatgaggaacctgtacccttccttccagattttattatcagcttgggtccttctgttttatttcatacaatccaagtcctgttactcccacaccaggccttgggttgtctaggcagctgggtgaaaggccacatttgttttgcttttattgttaaacaacataaggacagggccttgtcatgtgagaacatcaatactgaataaataatatatttataataccaataagagcaattgacatttgtatagcctttacaacttacagattactctgacttacctcattgcgttttgtatttatggtaaacctgagaggtggttgttgagatcctcattttacatttgaggaaatggacagaggtgggaaggggcttgtgtatgaccatacagcagatgtggttgggccaacgctaaaccatcttttggttccaaatctatttcctttaactgtgcacataatattctttgattatgagacccagtaggtcaaatctgtttttaaaattcttttcaaaatgggaatatcctttgcctgagctagggatacctggtttccttcttttcctcaaggtgtgctcaaactcagcagggtttggtagtagtggagaggctgagagaaagccctgcttattcaggggtctttgttttacaagttgtctctgtatgttgatcctctgttattgtttgggtaggcactggggaacctctgtgcttgcatgtgggcatgtacacacatgcactgtgcgctctgccagctgttatccccctctggtgctcactggcataaatctgccacctgatcatctaaaatcccagtgaaaggaaaattgccaggccaggagggtccaggggagaatcaatatatctagtatagtttatatttgtaccttctctccttaagagttacagtgagtgactctactcctcaaatggagcacctctctccaggagagtaagaagatcacataaatagaaagtgagctttggactctaacagacataggttcatattcaactctgctacttaatatccatattggtttgagttatttaaccttgacaatccacactgtaaaatgggtaaataataaataccctcctctcagaagtgttacaaagtttatatgaaataatgtgcttaaaaagctgggtacatagtaggagcttagtcattgtttattttctccctcatacccatacatgattcattctactgttaaaattatgcttctattgtaaccacactgtcatcagggaacagttagtagcattaggttggtgcaaaagtaattgtgtttttttgtcattacttttaaaggcaaaaacagcaatgactttttcaccaacctaatagttttgtcacattgtcctctagtaatgatgccctttttgcaaaggggaagccaagggcttgaagagaggaactgaaatattaagatttcacatcaaatcagagttagggcttaaatagaagtaaaggcactcattttcccactttagtgggaagggaaataaaccaacatttattgacctcctaatataagccatgtccttccctcaaatattttattctcacaagaacatgatgacatgaatagtgatattatccccattttacagatgaggaaacaggcttagaggatttcagttgctgtaggttacttagcagagaggctgccctccttcccagggttcctggccccagggtgcccagctcctgtgtttttctgctccatcatgcggctttcctcggagtcctggggaaaatacagctcaaggagggtccatgtgtaaggatgaatcaagaggagcatctcattatcacccctagttgtcaaagaacagaatctacagccccttgttgcttgtttcctcccagtcattcagctctcaggagtggagttaagatggaacctgactggtaatgtaatgcaggacccaaggtgtttcccataggtcatgttgtttatggatctgatgtccattatcatttgaaggagtgtttggccaggcgcagtggctcatgcctgtaatcccagcactttgggaggctgaggcgggtggatgatctgaggtcaggagtttgagaccagcttggccaacatagtgaaactgcgtctctactaaaaatacaaaatgagccgggcctcatggtggatacctgtaatcccagctactcgggaggctgaggcagaagaaccacgtgaacccgggaggcagaggttgcagtgagccgagatcgcaccactgcactccagcctgggcaataagggcaaaactctgtctcaaaaaaaaaaaaaaaaaaaaaaaaaaaaaggagtgtttgagtaagggagtaaggccacccaagatatttaatacaaggcaggttgtaagtttaagtgagtatagttggagtaaaaatagaagaaattatatctgttcttaaattaaactccagggctgtgttttgcgaaccaattaactaaaacttggagtcatcctgttaggctttgctgagcagtggagggacttgtggggaaatgtggttgcaaaggagacaggagggaagctgaggaggctgaggagccacagatgagctagggagatgcttgcagcatagcacgtcttcctgtttggttattggaaaacctgggtcctagttcttgatctactagctctgcagcataggagtcattatctctccggaactcaggttgtaaaataaaaaggtccaaccagatgatatctagggttccattcagatataagcgtgtgctgttttttgaatgttagtgcagccagagggcctgaaaagtgacggggaggcagagagccttatcagatagaacaagcagcatttcagcagggtgcagaaggagctttggtggctgtctctgtatgtgcactgggtggagaaatgagtgtgggcattgtggttgcattaggcccctccccatgttctctgttctacagtgccttgagcacagctttattatcttaaagcatttaccaagttctagtgtctttgggcagcaagtccctcaacagactgtgagctccatgatgggaaagaccaactattgttcactgtgatagttgaaaaaatgaatgcatccaaatgcttttggattccagtttctctagagatgtcttttatgtgtcatttttgtagtttggtctcttctcaatggaataatagatactaaatatcatattaggatgggcaggtgaaagtgagtcagtgcttgcagagatagatgaacattggaagctgttcttgaggttctgttcagaaagcctgctcgctcttagtccctttcctgcttgtgggagagtgggggtaaagcttcccggcaaagtgtgagtggcaggcaagcctagctattcattggctcacagcttcggcatagaccccatgcccattgctggcctatggcaaggcacagcaagcttgacagtgcgtgcacctgaccttgcccataaccattaatcagccatcatgtccacagtcttccccacttctataaactactgggacagtcactggaggaactgtcattttttaactcagcgcaagttttgttcgctttagatttttgggctactcccacaatttagcctattccctctcttttttccccaaattttatttttatcttggtaccaggtcaatgagttgagtggggcctggggaaggatgataaaaaagaccaaagatacacatgcaagatgggggcgtgcttatgaaactgtccactggacacccactatgtgcttaacattatgctctaggcttttttttttttccattataacatcatcatttcccggatgctttcctcatggcctctctatgtaaggtatacttcatacttgctattatagttaaagttgatgacataacatttaagtgtctaggccaggacctggcacaaagtaagaacttagtagacattaattgatgttgttgctactgtgttcacatttgatagtttaagggtcttcatgatattctgcaatgtaaaaggagaaaacaaacttggttagttggagatagtccatcatttgtagagcaggataaatattgctgatcattaaatcatctcagactttaacaggtgaagaatgagtagctgccctggttaaagatcgcatttgcctcaacctaagttggggctcagaaggggaggggaaggtgtctgttccagtctctgatttgtttctaagtgatttttattgccatcacttctaggtgtctaagtgatttttattgccatcaacttctagttctcaggatgcatgacatggtccctcattccagaatccagcctctgagctttactcgccatttaaagaatggtgttgggcctgagtgtttctgtccatggtgctaaacacagaactctgggactcaaaagcagatggtactacatggtcactctcatctccatagcctgcgagatgagactgctgtgaaaagaaggctggtttgggagttaggaggtctagtacagtttcaatcacttgctgtgttgcctcaggcaaaccacctaacctgtctgttgcagtgttcccattggtaaaatcgagttgctgcattctgtcattcatatttcagagtgctgctgatttctgtgtgagtaaatgagataacagatgctaaagtgggatatgaatgcatagtatgattatgctgcaattgcctctcattcttttaatcatacattttgactgtatcgttttaatttacggaggcaccctaaggcctaataacatataatgcagcatgcaggaaatcaaacaaacagataaatgcactggaggaagaaagaaataacttttttaatatgttgtttgcaagtggctgtatggctgtagaacctggggtgtgtttctaagaggaaagataatgaccagtgaggggccagcccttgtctggaaggagagaaaaactcataaaatctcatcaccactccaagccccaaaggggagacccactttactgtcacagtcctgaaatctcaacattagcttgatttccttttttagcttggtattccttgtccttcacagaatagttgcaatctccctttttgagttaatcatgcttgctatggcctgagatttgaaaatggagtctgtgggtttaagttcttcttttcctagttatagaaacttcataaagcaagtgaggctcttatagcctacctttcttcatctgtgaaatgggctcagtagtcataatatctccatatgggatgattgaaaagatacagttgtaaaaatgggccttataaaaatgtaccagtagttgtcattgttattccctgacatgctctgttcaaagtattgcatgagcaggttttgccttttccccatcctgtgcctttgtgtgttctattctttttactgggtgtatcttcttcatctcttcttttaaaaatctcactcctttaaagcacaggtcaaatactaccttctttgacctccccaaccataataattttttcctttctagaactcctagatagtctatcatctttactgttcaacttatgatctccttgcacggtggcatctagtttagtcattttttttactttcctaaatagattataagaccctgaaagacggctacttatctagcacagtgtgtagcacagagcaattgcccaatacctgttttaattggaatgcaggatgaatattacacagcactcatggccttaggcttttgtaaaaatacaagcgttgctggaggaggtgactcaataggtcatgggtacttgcatatgcattaagaacattgggtttgggtagccaaatgaaggtggaaaatctggaaagaacaagttgaataaagaagcaggagctgctaaaacacgtttttttcactgtagcagtttttcctaggctagtcctggtcttggaggtgctgtgaaaccagtgtattgacttggaaagatcccttagatctctgaactgggacaagggttgcaattcacggacaccggatgttgtgcaatattcaggtctgccagaaggtggcgcattatcactaatttcatggtctggcagctttgctcctggggatccccaaagttggtgtgggcattctgatgggtagctctcctccgcattttgtgtggttcagagcttctcccctcttatcccctcccctgcctgcattccactcagcttctttatgatgtataaagatgaaactgaccccagtcttcagcctgaagagtgccttccattgggcttccacatttgggaaggttcccgctgagatgggacagaagtgtctcagcagtctctcagttcctgcgtaagttcagaaccaactcaaatcatgctctctgcagtggaatctccccaccctgggcgcggagagagtgagcactcggtgcctttttggataaaccaggtaaagaagaaaacaaattactttttagtacactcctttattcctcattccctccgcagcctcctatgacttctgatttcttgtctgaacttcaggaacagcacctctctctgtgtcttcctcatctcactcctatatggtgtttcattctctttatggtgttatcacatttatttatttatttttgagatggtgtctcactctgtcacctaggtaggaatatcgtggcgcgatcttggctcaccgtaacctccgcctttcaggctcaagtaattctcatgtctcagcctcctgagtacctgggaccacagtcacaagccaccaggcctagctaattttttgtatttttagtagagatggggtttcaccatgttggccaggctggtcttgaactcctggccccaagtgatccacctgccttggcctcccaaagtgctgggattacaggcatgagccaccgcacccagcctgttatcacatttattatcttacattttcacacaatatctctaaaatgtgccacagatatttttctctattttttattagagcgttcacgtttatatcacgcaccatttaatttgaccctcacagcagctatgagaagttttggggcatgagcattaatatctccattgtacagatgaagacacacacaggaagagtaagtgattttctcagaaagtataagatgttcaagaacctgttcatcttgttgctaatgtactttactcttcttctcactatggatgatgcaaataaggctcaaaaggaagatatgacttatccaacgtcctaaagtcaatgatggtataaatggggctggaattaatatctctcgattctcaattcagtgttctttgtatcccactaaggaatccttctccattctctaacagaccattggctatctgtctacccaactcatttcctatgtcttcaaactcttaagcacacgtcaatcagcatttgacagagggtcccaaaggtgaatgcctgaggcatatggaaagctcatcaggaattattattttaaatttaaaatggataaaacaagcactggcaagaaatccatcaatctgctagcaatgactgtgcaaatgactgggtataggtattagaggtgtaccgcaatatctctaatactgttacccagtcatttgtactgttattgttagcagattgagaaaagtgttttcatttttctgtttctatgttttcaaaattttcttcagtgagatttttaacttttataatggaaaataaacattacaaagtggaaaaaaatgttttgtgccacaggtttgggatgtgtttgtgcagctgtgtgcatgggagtggctgttgccacattgtgttaaatgggatggaggctgggtagggcaggaactgtgctccagtcttctccaaggacaggtcattgtgtcattcactggttcccattcctcccctaaagccctggctgatgattttcgcacgctttacttaataacttcctccctacctggagcccggtggaatccacaaagccataagcacacaccagcctggtaggttggggcaggtgggaaggagctctgggaggctggggcatcagaacttcaccctctctggtcagagctgtgggctcctgagcttctccctctgcctgctgtggacttatgtaacacattcacaggacttcattttccagtagattgaaagcaaagccgctgttgattttctccaaaatgatctatttggaagtgcaattgcctggaattacatggtggcgcgagaggttagaccttgctgtaaataactttcctctcagccacacaggggctcagctggaagcagtgtctgggctttagatgacggtgtttggggtgtgtgtgtgtgtgtgtgagtgtgaatacatgtgtgcatggtcttggggcctttgctcaccttgctaccacttcttctacctttggagctttgcatcagaataaggaatgagggcagagatggggaaggatggggttgtgcttgtggtttcttttatcagctggtttatagggcctgtctctggccacctcttccccttattgctgcagggtccttgagtcatgtgaggttgagtaactcaagcacagagtgtggagtggcacaaagaacaagcttaagaattggacgtttctgagttatagcaccacatgtgcccaattacaacatacgggaccttagacaattgcttacatctatgacctcctgtgtctttatacattaaagcaaacaaacctaaaccaaacaactggtataaggtgtgggagttgagagtacctacatttcagtattgttgcaagagttaaaggaagtaatgctggagaaatcacactgcacagtgtctgacacttggtatgtgttctgtaaatttagttccattctgtgccctgccttgcctttcatgacagattgaaattaaaagcaaaagcaatgggcttggaaccaggatggcctaatccaaagttgtgaaacatgcaaagtctggggtgtttcacttctttctatactcccttcccgtatagatagccatagcatacatacatgattcccccaaagaaagactgtaataaacgaactctcactgcagcagatgggacttaatgctgtctgctcctggtgggcatttgtattttaagagtcctgcgtaggcacgtagaggacaatgtttaacccaaagatggcagcattttatgcaggatggcatttagatggcagagctatttttagattagaaagtcttacatttactctggccattcttcagaccagccttatttgcaggcgttagaatgggattatgtgctagatcaagtggacatttttctcaaaactcacctagtgttgtccttttcacatttccccatgaaatttagaaaataatagaatcttatcaaatatggactacatcctcaggagaagacttccagacagttctggagaaggcatctagccgcccacctacctaacattttttggaatcctacactgtaatataataaatatagctgacatttatgaaatattttgctaaatttttatgtgcataatctgagttaattcttactacttccggtggtactgatattatgatgccattattatagcatattggccaagagcaaagatgctggagccaggttacttggctcaagtctcagctcaccagtcactagtagtgtgccctaaggcaagctgattctctgtggcttgatcttcttatatttaaaggaggaatataatagtactacttcataaggctgtttggggcattaagtgattcaatgtacataaagtgcttagaagaatgtctggctattattatcaccattaaacatctgagaaaattgtggatgaggggaagggaagtgattttcccagtgacacccagatggtgacagatccaggtcaagatttcatgccttaggactcccagcctagtgcttttttcttggtatgaggaatatgtggaggatctttaatttttcccacattattatctctcaaggcagctgtcagtcataagtaacagcatttcagaatggctgaaaatctagatgagaacaattgaaaaggtgagagcttgtttaattaaactagttcctgaaagcatgtaaaaagaagttttttcataaagtggtgccaatttgggtgcccaccccagcttggcagttgcagcttaagcactagttagtgggcttattaatcaatggcatcagagccaacatccaggctacagctagccttctagagaggtggtgctgccaggtgcaatcccaagatgagagtcaacttgtatgataagcataggtcaagctctgagttttcattagaaaaaaaataagtggctacttcataaaatatgttaattaaccattgatggagttgggatagaatgcgaaagttacattttctttagaaagtataaaaaccctttagagtttttatttcctaaagtgacccagaacaagccttcaatagaccaagtccaataatgcctcatgtgtttcagagggagagggtgggccagatgaggagggtggtcaccaggagttctcctttgtcctcctcccatttctcttgacctctcttgtcataatggctacagttccactgttagggatgtattattttgggcattgatagtgtttaaagagaaatttaatttccaacatctccaagagacaacaaaattatatagcatcttatatggaactctcttcctccctgttcagatgcagcagccaactaggaccatgcggccaactaagaactggaaaataaggcaaggtgccttgggaggagaaagggtggatgatatatgccgattgaccattttgctaaagcccaggtctactttatgccattttgctctgcaaagtgctgctggaagaagttctgtttggaattaagttagaacagggagctctgatccaacataagagagcatcccactcaaccaagataattaagagtttgtcctttcttcattcctttttccagcataagaaagagcatcctacttgttttggattgaattttatcctctcaaaagatgttgaaattctaactcccagaacttgtaaatgtgaccttatttgggtctttgtagatgatcgagttaacgtgaggtcattagggtgggccctaatccaatgagtatgttctcataaaaaggggacatttggacacagaaacagacacatatacacagggagaatgccatgtgaacatgaaggcagagatccaagtgatacatctacaagccaaagattgccagcaaatgaccagaaactaaaaaagaggcatgaaacagactctcccttagagtcctcggaaataaccagctctgaaaacacttgatcacagtcttttagtctccagaactgcgagacaatgaatttctgttgtttatatcacctgctttgtcgtactttgttgccctaaaaaactaatacaccactgaaccaagataattaagagcttatgtcctctcctttccttctttcagtaaatattagatgagagtctactgtgtgccaggcacaataccagatcctgagaacaatatcttagataagatctttgcttttaaggagttcatagactatcagggatacggataagtaagcaggccattactggctgtatgataggtatttcatgtcttttttcccctctagaccactagctctcaaccttcaccatactctagcttctcctgataacttaaaaaaaaaaacctatgtccaagccccattcccaggcattttgatttaggtaccctgtggtgggaacaaggctttggtattttatgaatcttcctaagaaatcccaaaaggctgttattgatgaaaaccactgttttcaaatatacccatcatcagggccccagtccacactaataaagttggaatggtaatgatattttttagaaagcttcccaggtgattctaatgtgtagccaggtttgagaactgctgtctctcctgagaggtagggatttggtctgtctcatttaatgctgtggcctctctacagtgtctgtcacagaatagacagtcaataaataattgttgagtcaggatctatgatgagaaaaacataaggtgctatggtgcatagaagatgagtgctcagggcagtcattagagaactgagacctgaaagatgagttgacttatccaggcaaggagggaagagaagagtgtgtctggcagagggaacaggatatgtatagagccaaggagctggctgtaacttggcatagctggagcaaaatctatgggtggtgaggggtaagactggaaagcggagcaaggactgggtcatgaagagccttgcaagccacgaggagtttggattctgccataggcttgtttgtgttgtccaggggcatagccatgaactctcaaggctgatttttgtttccttggccttgatgctcacccaggtcgagagtagtatcttgcactttttctctttgaagacaaaagcccaaggagggtgtggcattttgatgcccagggctgtaggcccatctcataagaggagcattgccgtctttctggagagaccatcaagtgtcgcaactgcactgcaccccctacatgggaccttccatcaccaggacttgggagttagattccccagccctccttctatacttccacatcttgggtggaccctgggggagcttccacatccctctttacacatccttcccattcctttcagtccagttttacctggacacacatgctaaggatggagagggaggagaagactcagtgtgatattccccagatggtccccttagggagagctcctgggcagggcaggttgatctgtgcaggaggaacctaaccctccatcccaggggcttgcgcatatatccgctgggtgcttgcttgtctgagccgtgctgttggcagcagtgcccgatttagtactctgcagacttcattaacagcctgcctgttccactccgagttcttaatgaagatgttaaataaaatgtgatgttagtattgccatttgtacagcacttcatatttaccaagcacctttagaacgtttttattcttttccaagtgatagccccaagaagtcgattagtactgctgccccattctacagagaggcaggcccttgggagttcattgatctgttgaaagccaggtagccagccaccaccccaccttctatcaccagtgggcattactcaccctcttttgcccagaactcaatttgttgagctgctgtagctcctcagggcccaaggacatctcacattcctccctccaaattccagactttgctctctaaatattattcctcttcatcattcttacaatgttgtgttttcagtttgggaaagccttagtcttctcttggtcaatttgaatgaatttgcaagtgaaatatcctgatggacatcaaatgtctccctgaccatctaaacacacagcacgcctcagggcccctgttgtccatcctgcctctttccaaagcctgtcaatggcactgtgtttgtgtctggcacgatctgtcttctgtaaacagtcgcaggacaaacagcactgttgtcttcctaaatatgacagtcgacacccccctacgacagtttttacttgtgaaaccataaatcagaggctccaagtggcagcatctctaaagaactgaaagaggaagtaaaccttgtaaagaaaagtacaaaaagcggctcaggtttgcttctctgagccttgttggagcagttgaataaggcttattaataggtttacttagctctctgtgccttagttttctcatatgttaaatggagctattaatggaaacacaggtatgtaaagggttttctgctttaatgacataagcattttgggagggacttcttgcaacactatttttgacttcacacttttaaaaacctatcactaactttctttttctagcgtactatgctgtcttcatgttgccttctttgcgtgtacttcatttctttttctttcttcatccggctttctcttaccttcttatcatctgtcattgcattcatttattccttcttccactgtcctaaatctcatcaccttcttattctgttccttatcctagcccatgggagggtcccctctgctattactgactggcttatcccacaggattctgccttttctccccctacaggctctgcaggatttctttccctttctctctctctttctctctttctttctttctttctttctttctttctttctttctttctttctttctttctttttctctttctttctttctttctttccttctttcgttcgttcattcctccttccttccttccttcctctctccctcccttcctcccttcccttcccttccttgcttccttccttcttccttctcctccttctcctcttcttctttctcttcctcctcctcatctcccttccctcccccatcccctctcccccgccacctcctctttctcctcccactctgtggtccaggctggagtgcggtggttcaatctcacctcactgcaacctctgtctcctgggttcaagtgatcctcccacattggcctcccaagtagctggaattacaagtgcacaccaccacactcagctaattgttgtatttttagtagagactgggttttgccatgttggccaggctggtctcgaactcctggtgatttgcccaccttggccacccaaagtgctgggattataggcatgagccaccacgcccagccaggattacttcttgatggaggatttgtgatgtggtgtgggagtacagagcgaggatgatggtggaaagatgcaaggccccctcacttcgttattaggtgatagaggagagggtgacagtgagatagtaaatagctgaggggattctgagttctttgactcagggagctaccttctggtccaggatcaggtagtactgagggttacaaaacaggtcaaaatggcctggcaacacattgtagttcttcaatggaaagaacattgcactgagaattaggattgttaagtcagaaactgtgaagggtctgagactgcagcctacttgcaagctaacaagttaatctgccacaggtagatattatatatatgtatatggtgtatacagatatatatgtgtgtatagatatatctgtatatgtgcatacacacgtacccacactgctgtcagggtacataatgagagaagatacaaactctagatcaaacacaaagatcattgattacttatggcaaatacagcaatcaaggtgatctcttgcattagttctctgaatcctgatgcccatgggtgatgtggtaagggccagatggtagttgcacatatagtggagcctgttaagcaggagacaccccccgctccagtttagaaaattctctgaccttatctagggctgctggtgacctgctcatactcttccctgcagagagagaagaccttaactttactctagaatatgagcaaatcttcagagaaaggagggagacctaactatcctggaatgtctctggggaaggagacagtctctatctttgttatactggtcaggaaacaaatctgccttctgacctagagagagacactctatttcatttccaagaatttttactatgcaaccaacccagaaaaaattgtcagtagagccctttgctcagaggactcaaactgtgcagaaatgtgagatattcacagagaattgtcttccaacagggactcttaggtgtgaagtgaggggcttagacaacattagagacttgaaaaatgtggaatgtgtgtaccaccactctccaaatctatgcccaaggcagccatcactaattaattggggttttttggtgcaaaaccctaggcagtctgtactatactgattattacctgagtcccctctagctgtgtgaaatcatattcttcacgtttcctcctgtgttccatcttttctacttttgtgaatctgtgtatctatttatatctttatctgtctctaagttggggaaaaggagaacatctcttctgaggcaattttgtggtttaagattttcgtacaaagcaagttcttaatcctaccaaataacattctcaatttagtctttaatccatgagaactgtagctattaacttagagaggcttcccttgcaaacagggattaatagaagaataggtgcctgttgttatatctccttctcaccattggctatgaaagtattctccaaattcctctagagtgatacattggagccatctaactaaggagaagactttaaaagaaatatggcgcaggtgaacatttgcttggagaggggaatcctacatcagaatagatacagtctgagactccttccaactctgagattcgaccaatgatgccacctgggcacttggaagatgtccctttacctttgagtcaatttggactctactcccagcccaagtaatcttttccttcttgtgttctatacttcaaattctgcgtttattcagtgggtagatgtggacttacatagctaacatactggggtttctactgaagacctggttatattttattgccagccactgaaatgaaaggaatcaagagaataatgggaaaagtatatgaactgtgagtagggcatcaaaagatagaggatgctgattagctaagtgaccttggatgcattacctagcctcctcgtgcctcaggtacctttcttgaaaatgaagaagttaaggcctgcctggctgtctatctcatggagatattggcagagcaaatgaggtcatgttcagtgtatgaggtgcccagaaaagagatgttggttgaatgcaaagctggcttttgctgctctgaatctcatcagcctctcgtcctgctccaacccatggaaggtcttccctctgctgtttctgactgggtcatcccacaggattctgccctttctccccagcccctgtaggactatgtcttataagggcctgatgggggacttgtggtgcagtgtgggacatacaaagtgatggtggaaaaacccagtgtcccctcaattttttattgggtgatggagtgggatgatggtgagattgtgaatagctgagaagatcttgtttttttgactcaggaagtgtaagcatacaaaaaaacaaactcactttctcgtactatatattcacaacacagtacttctgtgacccctggccgtcaaaatgtgtgaggatttcttcccaccaagcaattctccaatagacaccagctgggtggcctctaattaaatcagattctgacactgtctacctggagatagtgtccagtcctacaggttaagggctcagtcccacaagacggtcctccacttcagatgtcagttacaagtagtaggttgccaactgtgcttctgaccaactggctataaatcggggattcccacaatcccctccccagatttgattgatttgctagagaaactcacagaacttaggggaacgctttatttacatctacccatttattataaaggatattacaaagaatacttatcaacagccagatgaaagagatgcagagtgggaggtaggtggggaggggtttggcgcttccatgccctctccagcacaccaccctccaggaacctcgacatgtccagctgtctggaagatctctgaaccctgtcttttggggtttttgtggaggcttcattacataggcataattgattacatcattgccattggggatcaactcaatctttagcccctctctgtttcctgcaggttgggggctggatagagctgaaagttccaaacctctaatcatgccttagtttttctggcccccatctaggagctatggtggagtccccagccactagtcatttcattggcatataaaagacactatggcgattccaaggattttaggagctgtatgccagaaatggcattttgggagggggtataggaaaatgttggggtggagagtgaggagttggcaaagaccaacaaagaccaaatatgtttttcacactgtcacagggggctactttctcgtcaggagcaggtggcactaagagatacagaacagataaaaatgaggctggctatgtacacagatgaagtataatgaaaaaggttcatggattaggtctgagattctatccctgttgggtcaataattagttggtatgtgactaatgtattgggaagatgcccggtggtctatgatattgggattttttttttctttttgattctttgggcctctgaagataattcagcagtttaccagaggagtacccattctgcctgctccttccctctctaacttcctttctccctccctccacaaatatttatttgtaccttgtttgtaactgaagataagcacctctgaaatcaggcctgttggcatatgtctaaatactctttaactgagagacatatattcaaagaaacgtttttatatgtccataaactgacacatagattgtcaaatccctaataacaaggttcaaattagaatcctgacactaatgttttcaaatgttctaatacaggtcaccgtttttcctggtacaactcttgtgagtcttatgtgtgtgcatgtgttcgcatgcaactgtgtgagatgctttgttaattaacattgtgaagctaagtgctcagtgaaaaaagtactagagaattgcatattgtccttacagaattgtttgtaaatacaatcaagtaaaagctgtattgaaagaggtaggccttgttcagagccatgttactaatctcaagtctaggggtttgctctgagtgtcttggtgtcttggtggccacatggatgttcctttactctgcttattttcaacacaagaaaggttcttgcaaagatgccttggatgaaaaattctgctgccatggctggtatgcaactcattttgcatggatgttctctcggttctaacctagtttgtgttcaggtaattctggtaatgggacatttgcctctcccctgggggaccatttttagtgtctgtccatccaaccagttagtcagagaaaagagccctgatgtaagtagagaaagaggtatttgtagaactgtgggaaaaagaaaaacataacacactgacctgttttaagagtgcagggtgggttcaaggcttttttaaatttggtttcccaagatgttggggtcactataagcttcgagaatggctgaggtccaaatcctaaaaattactttcatctcagaaaatttgattagcaatcagaataattgaagtgtacctttccagacactatttcctaaataaaatgtatgcataagtgaagtcagacctgatttaagatgaatctttcttccattgagcaggcagtgctttggggataaagggaactggttcccaactccagctttgcattgaactgctgtgtgatctttaaatttcctcctaacaaaatgaggagagtaatactttccccatgggcttgaatgagagataaatgaggtgaagccccaagcacaatgcctgttgcagtgtgttcagcacatggtcatttgctttccttttctaggaaggaagcccggcttcctggtcttctgctgagcttaccctgggttcccagaggctcctttggatgccttgatccatggatatcttctaagatggtcatgataatgtcagtcttcaaagtagctgctttccctcctctgtactgcagagaccaggcacatacagaggccgaagggtggctctgtctcctagggtggctgtcaccaggtgccacatcattctgtgtttatgggtttgctctgataagcagatgaggggggtgctcatccattttttaaattcaagacattcaagttcaacgtatgagacaccaggagtaattgtactatgaactgacataaactgcaatgaggaaagaccttctctcttcccctgtcttagattgcacgccaggatgtgataattaaagcatctgtctctctccagctccccttatcagacatcttaatttatttacttgttaaaaactaagaggagaattcatgctttgttggttttcctctttattctactttcattgttacatattaagtgatctcttggcaaaacgaatacataacatagctataattaaatataattctatttggtatggtgtttccctttcaaccattggcagttcttctaatgacaatgaccttgtaatttaaaacatatcctaggggcatctgtttttattctggactactctgacacattggttgaggaatgacaataacaatggcaggaattgggtacaagtgcagttttgttacatgtgtatattacatagtagtgaggtctgggcttttagtgtatccatcacctgaacagtgtacactgtgcccagtaggtaatttttatccctcatcccctcccattctcccaccttttggagtctctaatgtctttattctactcggtacacccacgtgtactcattgttaagctcccacttgtaagtgagacatgctgtatttgactttctgtttctgaaatagttcacttaggataaatggtctccagtgccatctatattgctgtaaaagacatgatttcatttttttatgtctgagtaatatttcatagtgtgtgtatacatatatgtatacatggtgtgtgtgtgtatatatgtatgtatatctcaaattttcctgatccagtcaccagttgatggacacttaggttgattctatgactttaactttgctattgtgaatagtggctgcaataaacatatgagtgccagtgtctttttaatataatgatttcttctcctttgggtagatacccagtagtgggactgttgaatcgaatggtaattctatctttagttctttgagaaatctccatactattttccgtagaggttgtattaatttacattcctacagtgtataagcattccctttcctccataccttgttgttttttttgactttttaataataaaatatgtttttctttctttcttccatgatggtgcacacataatagattatcaatttactcttacatattaattatattaaagatacagatgcatactagatgcaacacagaagaaagatgccttgtttctggccatagatatgacagagagatcaataaaggccacagaattctcttcctgtttattcctgtggttgttgttgggattttttttagatatagcaagtactcagcaaatttttgctgaatacatttacttagaacaaagggacactggcctcctccagccagccacatattattttatatatattattatgcaaaacacagttgttcagtattgcccctttgcaagatgctccttgacctttatctaagggaattaactgctattattattactcattcttttttatgctgcctatttatatattttttaaacttgaaaaggcgagttttatttttatttatttaattaattaattttttttttttttgaggcagagtctggctctgttccccaggctggagtgcaatggtatgatctcagctcgctgcagcctctgcctcctgggttcaagcgattctccagcttcagcctcccgagtagctgggcctacaggcacccgccaccatgtccagctaattttttttgtatttttagtagagactgggtttcaccgtgttggccagactggtctcaaactcttgacctcaggtgatccgcctgtctcggccttccaaagtgctgggattataggcgttagccactgcgcctagctgaaaaggagagtttttgatgaagcacaaatgtgactagacagtaagggaggaggctgttgggatgactgagaaaagaaataaagagtgtcttagaatcatataggtgagagaattcagaagtcattactgtatacccattgaagggattagattctctgaaggcttaaactagacagtctgacttaatctctctcttaaaggaaaagagttgtatttttgttcttcatgcttttaaaattatacaagaaaaaataaaagcaaaatttataaaagcaatttgtatacattgtaaaaatattcaaatatttacaaaacagcatgaagagtaaaattatctcctctgagttccattctctaaggataaaactgtaaaatgcttcaattcttggctcttctgtttactaccaggattctaacatactttcttgttttataaaatttagacagtagattctgactttttgctatgagagtttagggccatatacgtaaatgctatcttccactcatcattcctcctccgaattctcagtcgtattcttacttatccattatcaaggtatattaacattcacattctgttccctaaatgtaattagattttcacatgctttatagttgattctaaagagtttgtttggatagaatgcctactattcattttttcattcatttgtttatttcattcaacccacactgagagactattttgtgccaggtatgagcctatgtgcaaagtatgtgcaagtgttcacagaattgtgtgtaagacaattgaatgagttttgggcaggagaagatactagatgcatatctcaattctatttctaaagatgtattaaaagaaaatttagatgaaaagggttacggagaaggacactatcatacttttagagaaaaagcaccctggaaattgtttagatacctaaatattgtcaagtattaaataaattatggaaaccagatggattggaatcagagccattaaaaattaaaattttgagaactattaaatgatgtgataaaatgtcataatctagcaatttaataaaataagaaactggatatgaaactagatctataatattatcccagttctgtaaaattttaaaaagatgatatgggaaagaaatatcacaagtgatgacagagatttaaggttttttgtttgtttgtttgtttgttttttgtttttgttttgagacagaatcttgctctgtcgccaggctggagtgcagtggcgcgatctcggctcgctgcaacctctgcctcccaggttcaaacagttctcctgcctcactctcccgagtagctgggacaggcatgcaccaccatgcccggctaatttttgtatttttagtagagatggggtttcaccgtgttggccaagatggtctcaatctcttgacctcgtgatctgcccgcctcggcttcccaaagtgctgggattacaggcgtgagccaccgcgcccggcctaaggtatttttttaaatttttatttatttattttttgagatggagtcttgctctgtgacccagactggagtgcagtgacgcgatctcggctcactgcaaactccacctcttgggttcatgccgttctcctgcctcagcctcccgagtagctgggactacagatgtccaccaccacgcccggctaattttttttgtatttttagtagagacggggtttctccgtgttagccaggttggtctagatctcctgacctcgtgatctgcccacctcagcctcccaaagtgctgggaaggtttcttcctttatactcactttcaatgaggaagtgttatcctaactacaaaacaaacagacaaacaacaacaacaacaaacctattgtcttcaaaaaaataaaaagtaacaatagaatcattgccttcaaggacaagattctcaatctggtgaaagagacattttaagaagttctcataatgtaaaatggaataaaatcagtgtctgagtgtctgtacaaagggataaggatggagttttgataggggtctgggcatcagaaaggacataacaggttgcatcatgaagactgagtagtatttctatggacagaggagaacattcctaggcgtgaagggatggaaatgaatgttgagaagtgagctatctgaaattgctggactagagtgtgggctaaaagatgtagaaaagaaagtggtttaatggcttgtggagaaccttggatgctttgctgaagaattagaatttaattgaaaggccatagggagctatggagaaatttttaaagagaggggtggacttgacctgtattttcagatgcaaagtaaagagagcaacctttggcaccagacagacctggagtcaaaatcccagctctgccagttccttaggataggttcttagacaaatgagttaactcttctctatttccttatccattaattgggggcagtgatttcaactttacggtgtgaacatgaggatagaacaacttaatacagagtttcaatatcatgaatgatgaataggtcttttttaaaggtaagaaataatacctggtgatgaaataatctgtacaacaatcccccatgacacaagtttacctgtgtaacaaacctgcacatgtacccctgcacttaaaagttaaaaaaaagaaaatatttggatccacctatgacctataagctctctctttgagttgttctgcctttccagactgaagtaatgtatgtctcacatgtattgattgatgtcttctgtctccctaaaatgtataaaaccatgttgtaccctgaacacctgggtcacatgttctcaggacctctcacgactgtgcctcatgccatggtcactcacatttggctcagaataaatatctttaattaaaaaagaaatatttgcaggatctcaccccctagtctgtgttaaattgtttctattataatgttaaatatttacaactatatttgttataaatttctcaagtttcgtgctctgctacaggtataaaaccaaaacgagtttaaacattataaacaacacaagcacaataaaattaaatgaagcagtattaatttaatagacccatttgtaatcaatatgaaaataaatctttgtggacgatgtgaatatagtactaactgctacagcccaggttattaaagtttggcctttcccatactctgtgtgttatgttgactcagtctttccccacttttctctactccaacttattgtttatgcagtgaacagtggtattatttaaactttgcttagcatgaacacatcttctatgtatcaggtccacctctcttcctcactggcccatcactattaacatctcaccactgtagacatgcatgcaagtgcaagcattgaaactgcatagcaggactcaattatgtagtggttatctagatgattttaaaaatgttatcagtatgaaaatttagatcacacagacatacccacacagacacacatacacacacaccacacaccacagccctcttatggttctacacctcctatttgtaaatacatatatcctagaagtcttattattattgttttgttgttgttgttgttgttttgagatggaggctcgttctgtcgcacaggctggagcgcagtggcacgatcttggctcactgcaacctccgcctcccaggttcaagcaattctcctgcctcagcctcctgagtagctgcgattacaggggcccgccaccatgcctggctaatttttgtatttttagtagaggtgggatttcaccaagttgggtcttattattattgttaatggcagctttattattgttagtgatcttggttaggtagatgtatcagttggctattgctgtgtcataaagcaccccaaaattccgtagtttaaatcaaccagccatttattatttctcatgagtattaggttggctgtacacacctgctgatatggtttgggggcataatggggctgtctctcatctttggtcagttgcacgtgggcttgttggctttgctgatgtggctgagcttcctcacatctttgaagccttgtctgagatggtttggctttgctccatgtgttttcttcacctccagcaagttagcagaggcttgtttttagggtagtctggacacattcttatgctgatcacagagaagcagggaaagaaatggataagtgcaaggtctctttaggcctcatgttagagctggcagactaccacttctgtggcattctattgattgaaacaagtcacaaggccaatccagattcatcagctggagacatagactctatagtctatttctagatgagagaagctacaaactcaaaattcaaagaatatggttatacgtatgtgtgaagaattggaggcacttttgcaatcaatccagtagagcagttaagaacattgaaatctattaggaagtgacatagatcttcttggtgagagggatcctgccttaggaaagaatgaatgtgtgaggtgctctgccagtctttggtgtgggagtgagggagagggaagagtcaaagatggctttgaggaacctgggcttgggtgactgagaagatggtaaagctactgagatgagatggtcagcaggaaaagtaggtttatattagggggcctggggcatgggagaggtcaaagatggagggagaaaataagtttagagtttagcaaagtgggactcttcccacaaggagaaaccttctccacctagttacacaataaaatcgcctaaagagcttttaaaattgataattgagtctcatccaaggccaattaagcttaaatttctgggtagaaggcctggtattttttttaatattcacaggaaatctaatgtatggcaaaataggaatcattatctaaatcagtgttcttcttgtgcccatacgttagaatcacctggaagccttatgaaaaatactgatgcctgggcctcactaccaaagaatctatttagtgagtctgggatagggccttggcatctgtattaaaataaagtctgtctggatatatgtgatgtaatgtaatgcagccagagttgagaaccactgacctagatagttaattttcactgtgaataatcaatgttttcagggttgcaagccatggcaaaggggcactatgacaaagtctctttaagttcttggcaggtccagaattagcatgaaattgctgggtgccaactggggcatggggacaggagcagtcagaaggtgaattctatacacttcgaagacccaacctggatcaacacctggtgtttgaagcacaagggcttgttagtgctaatcctgcatcaagtagagatggtgggaaatcgccctgaaaagctctatagtgtataaaatgtcatgatgctattgaaacccctgttgtcccattcaaaccgagctttctttacagtagcacctgaaaaatacaacttccaccatttcctttgagaaggtaaattcagtctgagatctcagtatttgttttccttgattggaaagctaaaactgcctcttccttgattttgtcccgttagtctgagctttgaccttgttacatgttagataattccttgatatgcttgttgttaatgccttataaatatttgcagaccaattatctgtctataggcagccactgagtcaacaacagaatatctgggtttttttccatgttcataaatcattcttggcagaccttaatcatttgggtttttggctggcctctctgactttcttctagtttatttttatcctccataagcctcatctattttggagaaatatttaattgcataagagagaagttgactcctgttaggtatgacactgacaatcttccctgggttcagggtttcttcagagtggcatgagaatccctttggggatgggagaaggcttgtgaaaaggacatatttatgagtcccaccccagttctctgaggatgggactcaggcatctggaattttcacttctttaaagggtaggtgattcttatataaacagttttagagctattaccaaagttattgcttcaaatattatacttagaggagaagttggggcaatttcttttctcggtgggagaggctttgctccataatcctcgtcagtaatcaagagatacacctttccttaaagagtttccaaaaatgttctgcatgaggaatcaccatttcatgtcagtcttgtatatcagtggggctggttggttaatacatatggattgtattgtgttcatctgacattaagatataagctgaggcaaagtgaagagaggaggaagaatgaatacaatagataaatagtaagatagaaaagagaagagaaatggagatggggaggaaataaagaagagatatttgtgtaaatatggtttcatctatgacaatgtttagtatcacgcttttttacattttgaagcactttacagtataaaaaatccttttatatgcgatcctcacaactgtcctggggtactggaccaggtaagtgttaacatacccatttcacagatggaaaaattgagacttctgacagcaaccttccgaaggtcagatagctagtgtcaaaaccaaccctggaactcaggacttagttctaaagcaggaattttctgccaatcctaatctatactcagcctgggtaacctagacttgttcttgcttgtgtaatgacaaggccttcattctgaatgagtgctctgatgtgatttgatgtagagtggttctttggggagggacatggcactggcacactgaacagagtggacttggtatcctgaggaggtccttggaaattctcataaaaatcaacaagcttattgaaagagctcatgttacatcttataaacaaaataaaactggtacatgattcgtgagtgtcttcattcttctctttcttccctttcttctcttcaacacactcaacacacacacacacacacacacacacacacacacacacacacccccaagaaattcacctctggctctggaatctggagaaagttcaaagtcatgcagcaatgaccgtcagcatgattaggcctactggaatcaacaagataaattcagggcctgatcaccatcagacattttcttggtctaacctattgtggccaaaggaagggaagtctcactcaggtctgctccctctccttcatttacttactgagcaggctttttttgctttagggcatggttggtactgaccctcctgggactataataaaaactaacctgggtaccagggttgaatgttgatgagtttttttaccctcgttatttctcttgatcattacaacagcctggtgatataggtaatggtaatatccaggcataattacgataccattggtctaggcatacttgtataattctgtagatcagctacccccctagaaagtactaaggtaaatttatgcacagagagggtgaaacaatgcaaagggacactctattgctagttggggcttaggcccctcaaatactgaacaggattttggtgaactgggctgcaccacaaagagaagctgggtggacttgaaccaacctaaaagaaaagtcaaacctacctttctgattttggttaggaagggaaaccaaactctgcatccctgctgagaatccccgaaaaagaaagtggctgtaaaagatggaacctaagcctttccaagccagaattctgtgctttgtaggaaaagacaggcatcagaagagaaagcctcaaagagctttgaagagcaagatagcaagatctaggacacagcttactgtttgaggcctaagttcccctcagtgttggaaactcccactattatggccagatgaagtagttttgcctctttcttggtcactgtctttgggatgtggaggtggtgtgggggctggagggaaaatgtgatatcctggggatatgttttactgtgaggaacttaaggatcggggaagttaagtcacttactcaaccaaggtcatttgtttagtgtgtggggaagctcagatttgaactcttgaatcttggcaacaacatttagtaattttcccattttgctacctatcctctctaccaaacaccattttgttcttatgtggaaaattggttctaccctcctgggcttcctctggcaggagcagtgtcattaaaacattgaagagaacccaaagaatatatttttctccacttaatgcttgctcagggaagacatccacatccatgggagttgtctggctcacagtttaggaagtgtcatgcacatggaggtagtctgctagatgaggcttagatcacatgtctatttcatctcactgttcctccttaaaagttcagatgatacaaatggccacactgtcctctaaaagaagcgttggagtttattttgggaaaggggcctattttaagataaaggacaggggctccctattctgccactgtgctggcttgtctccactccacactcagcaaaaatggaatattctctaaacaataggtgactcagcctttgcaaagtctcaggtgaaatggatttagccagcaaagagagaaaatgtctttttttttttttttcatttttccctggtcctgtttgatgataattctcagtgctcagtgctcctttcatccaaagatctgtaattaattaagcctcacaactcccctggcaagtagagagaggtacaaggatgttcatttaaaaccaatcctgtttgatacagtaggactgttaccaaggctctttaaaagaaaaacctttctggccgggcgtggtggctcaagcctgtaatcccagcactttgggaggccgaggtgggtggatcatgaggtcaggagatcaagaccatcctggctaacatggtgaaacctcgtctctactaaaaatacaaaaaattagctgggcgtggtggcgggctcctgtagtcccagctactcgggaggctgaggcaggagaatggcgtgaacctgggaggtggagcttgcagtgagccaagatcacaccactgcactccagcctgggcaacagagcgagactctgtctcaaaaaaaaaaaaaaaaatgaaaaacctttcttttgtgaaacttctttttaatggactaaattaaaaaagaaagggaagaagtaactttatctgggatacctgctgagttatggccacagacagagtcctaagttaggagctctgatgtcattcttggattaaactaggtgtataagctactgctatgtagcaaatcaccatgaaacttagtggctttagacaataataaacatttattgttaatacagttactgtgaatcaggaattcaggagtggcttatctgggtggttctgccttgagatcatagtaaagatgatagcaagggctgcagtcatctgaaggcttgactggggccggaggatccacttctaagatggctcactcaaatggatggtgagttggtgctggctgttggtagaagactaattctgcatgtggacttctgcaaagggctgcttgaatgtcctaattatgaggcagatgctcccctattacaagggacccaaaagagcaaacgtgtaagtgtcagtgtcttttgttacctaccctgggatgtcacactgtcatttcctcaatgtcctgttgactacacaggttagctctcaacattatgggaggggcctacaacaagggcatgaatatcaggaagaagactcactggaggcctgcttggagcctggctactgtatgaagacatattaaacgtatgtccatctgtaatattagtggtcctctgaaaaaccagcttagaggactaattatcattcatctgataagaagagagagtaagagatagggaatggtgtaattaactttctggttatttgtagttttagaaaaaagagccaccattcttcatggttaagtgattaagcctatattggagtgtacataacaaggggtgatgctcccatttttaggagctggatagctgtcccagaccttatagcagatcactggctcctcattgttggtccatggaccaatgttatattaactgctaaaaggcatccctgaggcatttattaaaaatgtggataccagctttctactcttagggattctaagtctgtgcatttggaacccactgtgctggctcaacttatcaagttatgtggggtgagaattatgacttatggcagttatagtcatttgcttagcatctctccatgatctttttcttggtctcagaacaccaactaaaaataagttcctggttgctaagggcatgaatatcaggaaggaattgatagttgccaatgttgtttgcataccatattagttcaagaaagtgcagagagtagaaagttccctaccataagggctactagaaaggcagagaggggatagggttgctgaccaatagcaacagtttggaagattatcattatactgcatcaatatatgcaaggaactggtctaataccaggtacagaagtacttttgcatcctgcatacattttagtccagtggttctcaaatattagtatccagaagaatcacctggagagtgtttaaaagtacagatctttaggtctgcctctgggattctgattcagtgggtctagtgtaccccaggtggttttgatgtaagtgatctgggaccacactttgatatacactgttgtaggtacagcctaacttaattgcaaggtattgacttcatatctatttaatctccagtagcaagagtttaaccgatagagtgggtgacatataaggggtacatgaatgacagttgctaggtgaactgatgacatgcatgaggggtacagggagactggacaggtgtgaaaaagcattttattagcattatctttgtggatattcccctttcagatgataagctcttagaggtaggacctatatgctatttaattttgcaactcccgcagaggttagcatggtaagctgcttgcatcaggcttacaatagatgtgttaacacataggggcaagttcatctgaagtggccaggaattctgcctggttgggaattgattcatggtacccagagcatgttgcatgttgtgctgactgctttatgactttcgaagttgagtgactctaggttattgccaagctctcctctcacctcttccctctttctttcaagtatctcaggtggtattgatagtaaaacagtcttggcattaatgagtgtctgactggagagtgaaatgtaaataagagttgaatagagcacagccaaagcctacaaattaccgctgacaaataacagggcagacaaagagtatttcagccttaccaaacacctctgctacaatcagctaagaacacctgggaatgtcagggtggcagacacagagccaacaacatgatcaagaagaggacatttgatggcaaagagcaaagcagcaagttgcttgtgcattgcttagagaagaagaggaagaagaatgatagaactactggcttcactcaagaataatttattgaacttctactatgtgccagtacttattataggtactagagataataaggtataccaagtagacataaagcttatattttagcaaaagatatagataatggataagcaaatacttagtacatagtacaatgtcacatggtgattagtgtcagtaagaagaataaagcaagggaggggaatacacagtaaaaataaagtaaatataattcccaatgacattgctatatataataatttgacaaatccattaaactaatacttactgagtgcttactatgtgtcacacagtattgggcaatggagatacagtgataagacaagttttgtaatttcacagtgcctaatttttttaggccaggaaaaagactataaacaaagaaagacacataagaaacatatgagatagtgatttgtgctatctagagaattaaggagaactggtagagtgactgggaaggctgctttagtttggttgagggaattcctctccaaggaggtgatattaaattgaaatctgaatgacaaagaggagccagctatgcagaaagcatcacaggccaagtggggagggcacacgggtgaaggccctggacccagcagatctaggaatagaaaggccagtaaagctttataaaccatgaggggctggggtctggttagaataattaagaagagaaataattttttgtttttcatatatatgacctggggaacaaatataaatcctacaaaactatctttctttccatttaaatattgtctagttctttcatcagagacaggtgtaatatttaagtcaattgatttataatatgaatttcttcctgtaattagttctcttttccccagcacccctgagataattcaaaatgcagggcaagtgttattataataaaattttatgttagtataattaacaaaaataccatatagcaatatgccagtcattaagcgtgttgattcatgtagtaactgggaattcttagttaatatttgtctgcagatccatttatcttccataacaccttagatgaaatgtttctttttgggctcgtattcaagatcttggggtgatctttttctgtgtctagtttccatgcaatctgagctctgcagcagccagtggaaatgcccttagttgtcttcagtttctctttatgggtgctgcaatctctttaacccctgtccatacaggaactttgtacactctgctgtattctccatctagggttcacatatcacccaaattctcttctatgtctctgggaagggaagcaattctttttgcaggtcttcactattgtctttttcttttttccattgctttttctgtgctgtctggagaatcactttccataccattgggtcttcttttccccagttaatataccagagcctttctgctcattcattctctacatttcatgcctctctgaagtattaatacctttctctttacactggttacagatgtatatgcaaagatcaagtggatagattgtgtttgctgagaaactttagtgttgaaaatgcaatgcaaatctttaatgtaagtttactgtatatttgagtgtattgtatatttattctccaatataaatttagcaactttcacattatgaatcactaagccttatgtttctccaaagaagggagcatgacttctcaaaatacaatattgttttagaatgaaaatttgtttcatgaccaatgcaaatcagttctgaaattccaaactccctcagccttgaataactttaaaatgcaaatgctacccataaggaacaaatgtcttttcaattattaaaattgaatttcaagatttggtttcttatgataaaaatgtttgaatatatctgaaaaatctttcttaaatcctactattaattaaaaaggataaaagcagaaagttgcaggcaataacaagaacaaagattgagttacaaaaactagaatgtgtttaattttcatagaagttctaaggcattacattagcaccattagggtagggaaacaggcttatgtctctctctgtctcacacacacacacgcacacacatacacaggctaacgggaaaggacagactcatgtacacacacatacacgcacacatagttgagccaatatgctttatgatctgtgaaaattaggctcaacatagtgaccgaattgagagacaggatgttgatcatagttttgctttctaacttgaagaatatagctgagaagccagggtttaatggttttgatattctggaaaataggtatcatgatagtcaaacgtttctgctctgttgggatacaacagaagtatgatgtctgtccttaggaagtttactagtgatttggggggaaaatggctttatattatacaactcaaacagtatgagccagtatacgcttaagcactagatactgcagtgcacagagacaagtagttatgagaatcaagagaaaggaacattattaatactgtgtggggccaacatggaatgcttcatggaggagaagaagtttaacttaatttggaggaaaatacagaatttagcatcattttctctttaatgatagcaagtcatttttattaataatattgattatctctctgttgactcacagattagaggatggaaaagcatgacaaacccacagggtaactatgttttaaaggtttttaaaaaagaagtcagaaaaaaaagagaaagcctttctaagagcctagtcttggggaaaatgtaggagatgcagaagagaattaatggctaatgcttatcattttgtacaaaataaccttgacacaaatggggcaatttaaagaagggtaagtgactcccagcccactcaccaaggttgatggtggaaataatcatggggttgagggcagactggaaaaagaagaccgagggtaggtagctttctcttctacattatgtgtgtttctgatctagaggtaggaagctcatagctgaaggagcattttagaaactcagcctcttccactttccaatcactttaggtacttaacttgatctagctgcaagttagatgtgtctcttttttttccatcctccttcaagctctatgcagagatgtgttagttgtcatatcaccaacgtccaagaagttatagtgaacaaaacacagttagagaactaggataattgtaaatattttttatagcaaaccaatgtgctacaatatgtaagttagggtgtgactatccctgtgcttcataagtgagaaaattattattgctctaagtcagttttccatcttggctacacattagaatcacctggcgaactttaaaaattaccaatgcccaggaccttcccccacctgctctcccaagaggcatagtgagtctgagaagtggcctgggcattggggtttctaaagctccccaggttattctaatgttctgcaaagttgagaaccactcctctaactgctgatataaacaaagtgcagctggagagtttgttaaaccacagactgttgaattccatcggcagagtttctgattcattagatctgggatgggaaccaagaatttgtatttctaacacatccttgggtgatgctgatactgctggttctggggaccacagtttaagaaacgttgatttaaactattgaggtcaagacaattcaggttgtacaaagtcagcatttcgtaaggtttgtccccagaacatacttattaaaatgcagattctgggcacctccctaaactcactgaattagaatgtccaggaatttgcaattttaaatgagctcttccagtttttcttttggacgctagtgaactatggtggaggttaatagttttatttcttatcttgctccaaatattattttatataagttgaatgtgtgaccctatgaaggtttttgtaattattttatgctatattttgtgtgtgtgtggaagaaaacctctatagattggattgcattaggtaccctgaggaatatcagtagtcaaatttggggaaataaggctgggcatggtggttcacgcctgtaatcccagcactttgggagagcagggagggcaaattacctgaggtcaggagtttaagaccagcctggccaacatggtgaatctctactaaaaaatacaaaaattagccaggcatgatggcagatgcctataatcccagctgctcaggaggctgaggcaggaagaattgcttgaacctgggaggcggaggttgcagtgagcagagatcacgccatggcactccagcctggatgatagagtgagaccctcaaagaaacaaacaaacaaaaaacccaaaaaagaaatttggagaaataagcttcgtcatggggcttatattataacaacagactcacctgtttatatagtggctgcaattctcattgcatctgagatgttcaagaggtaactttcaaaaccacacttggcacattcaacataattaggtaattgcacacagcacaggttgtataaaggttagaggagcatctttcaaattttagaggatattaaaattaccaggggtatttgttaaaagttagattcccaagtcagagctccagagagtcccagctctgggtggcatccaggaatctttatttaacaaaagtagattcttatacaatgggtccaggaatctcattttaagaaatagtggattggagaatatgaagtataaaaattgttttcacagttgacctgagttgctaataaacaatttgctatatatttactatttttttcacattttgtaagtcagtgtcctaatagctaggtataagtgtaggctaaaatggcaatgttcaggatacatcctttaagggtgtaatattattacatacatctgtctcctttctcatttacatattgtgcagctttttttgtccctttctatactattcccccttttattaaaaaatggagcagacacatgattaaaatgaggaccaggtcaagtttgcatttagctaagtattcttcccctttatttccctgtcttggccagcttactgtcattcctctttttccctttgttcttttgtctgtcttttcccctaccagtccatgttccatctttcctctacgttgtctctcctttgtgacctctttctgtggccatttcagtgggcatgaagggaaggggtggtcactgtaaaccttgccaatccatatttctctctccacagccaggtggtggtgtagaaagttagtaaagaataaaaacctacacaagtcttctattatattctggtgtgcaagtgtggggttaatagaactgaataaaatgatttttaactaaaactcagagtccacaggtaagagggagagaggtctggacaaaaattgtacaaaattttgttggtgaatgatagtctctgtaggggaacgctgtgcaaaatgagtcttaactgatttagaatatagctggacattcttatcaagttaactgtccactgttttgaatcacaggggctaggataggattatttctttttctttcatgtttcggatttccttctacctgcgaaaatattagctttcactcaagaatcctctcccaggcagaaagaaggaaagaaagtcttgctagaggagaaatcttattaaggctcatggtgattcaggagtgacagccggggctttttcaatggacttatctgctgtcacagagacccactatcctggaagagcccaggcaaagtctgagggttttgaccatcaaaatgaatgactgcaatatgttttgaattgcacagacaggaggagaagtgataggtattctttatggaaaatcacaaagagaaagagctagcaatcttcaagcctttttatcttcataccaaaaacaatatgaatactttctatggagaaaaattgtggcagcaacctgagctgaacataactacaaacagaaaggatatcccctcctacagccctcagagtcatctggcattttgcttatcctgcccctgaactcaagactcttttatattatagagttcttttaggaaatatttatttcttgaacttccccttattttttagggtatctccccatctttttgccccaagagcctgaatcacttgagcaagatataatatccatgtagataagatgataaagggattccttatatcaaggagtcaactaaaagttaatccctgtgaaacacagaaacccaccacaaatggtaaaatcccaagaaaaagttttgagttttgaccaaagagctaatttcatttcccacaagtgcaaaactttggatgtatttatatcagctgactactatatcttttctcaaactccaaagcccacatagctgatatactcttgtcaactgatattgtttccatgttacagatcaggaaacggaggctattcaaagttactgtatatgcgttgtctaagtgctatttgtatacttgtttatcactcctttgatctgccccattgaggtagacaatgattcttgctacttcttggctctcctatatacccagggctatcctgtctcataatagaagcttgataaatattgtcaaactagatcatatgctttgtttgagtcctcaaggggagacaatgaaatagctggggctagaccctcctctctctctcagacatcttgaaatgcagtcaggacgtagcggtgctgagcccattataagacctcaataaatacctgtcaatggcttgactgaaggactgattcaagactatcatattctttagtacttgtctcatgtacttcaacaaggactttagactaaactgatttgattggttatatttttagacttgttacttctgttttgacagaaagaatagacaatacgactacaagcatagtgaccttctggatttgttcctgtggataatcttaagataatttgaaggaagtttcttaactttttaaaggcacaggtgtcagaagtgacaggcttgataattagtcagcattaccccctcactccttttaatgttgtttctcacgctttgcattggttactagtcaatctgggttgcagttctgatttagatgtcaccgtactctgctttaaaggttattttggatctttgcctgtctttgatgtgttctagtacccatcttcctgtctccatccccagcatctgagaacacttctcatttccccactagattgtttttttaaatttttgagcatgctctgttttattttctgattatgaagggcatttctagtagtcctgggaagagtgagctcacaaaaagacagctagagaactagtgatcatgactattatcacatcaagactttggcttaagcaaaacagaacaacaaaaccccaaaaaaccccacaaaactgggaagtgcttagagccccttctacgtgactctgtctgcatctgcagtaggaaagtttacatttactgttaatctgctgttcaactttttgggaatgaattagcaactcttaaatttctctccatttcctatttctagtaattagctcagtgtcacagctaaggttttcttactgacttcagcatggagacttagcagttacggaaaggagaggctagagctttccaccaactgcatgtcactggtgactccaagagagaatccaacaaatcaactactaataatccttactatttaaaccgtgttcactattatccaataacttggctctcagttatatcttcttaagaattctaataaggcatttagtttatacaaaggaggagtctgatctatgcagtggacatgagagacaaccaaagttttgttcctctttccaatggcatagagaaaaaaataaaatttaggcagaattagaattcagaatgcctgggagttcctccagccttgggaaattccaggtgagaggggaggactctggagctttttaaaaagaccctagagttcattttacccaacaattttatttcataaatgagaaaactgaggcctagagaagtatggcttaccaaggttacaaactaaattatggcagttttagctcatggcttatgttagctagactgctggttcgatttttcagtggaagcctccttttgaagaagggcaagccattcatttttcagcataaaccaagggatgctcttacacacacacacacacacacacacacacacacacacacacacacacagagagagagagagagagagagcaaaaaaagaatagccatcataaagatacatttctgttctggattcaagaggcagaattattaatacaggtagactgccaggaatgcagaatgttaatgcagctgcggaataatacactagtgccacagagtttaataatagataatgacaaataatacagttggggaattgtgtaattcaataacagagtaaatgacaaggaaacacacacaccaatgaatggttctagtggggacgcttaggtgttttcaatttaacttacctctccagccctttggcctactacccttttgagaggcaggcaggacatgcagagatgtgcccagctggggtttttagtttgtgcagtgaagttgcaggtttcaggggctgagtcaggaagtatgaattgtgctcctgggcagttatcagctgatccctttaatgcatgtattactttcctccatgtcatgactggatagtttctttttttctgggggagagggggcctagaattgtcccaggttggccattctctcctattacccactctgtaaatcactgcatatgagggagtggtactggaacatggagcttgaagatgggaagagactgggagttggggtttgggtttagggtcataatgggaggtaaaaggtttagccacagctatggtttagtaagcataccagtgatctggtgtgtacttccctgtcctcagctgcattagagaaaggcagccgctgatcactgttagacctgtattctttctctaagagaatgggatatttccctctcattcttttaaaataagataaaaagcaaggggtggggaaattaattaatgtcagtaaatgaagcatgagacacttgtccggatatgataatgactgtgaattagtgcagaataaataaaatggtataaaaaatgaaccttgccagcacactcctttgggatgggctcagtcacccttataatgcattaactcttcccttgcctcatccttggtcctgtctatgttactgtgtcaaagctcccccactgcagagtctcaaggctacagtattatagcctgaggtgcccaaagggagccctggctccaggagagattgagccagctggtgactgcatactttataatgtaaatagaataacttcacatctatttattaataaaaccacactaaaaagaagcaattgtgtgtcccccggttgggagattcaagaaggcagacagaaagccactggaggaagaaaaagggataagttcctcaaaataagttgctccctttcccccagagccaaagtttacctttgtgctgctggtaagttatctacctcccctctctacttttctgtaagggccccaggctgtatgtcttttatatcgtcttcagatgactacaataaacacacactaattgggcacttcctgtgtccaagcactgtagaataaacagagagaaataaagcaatctccattttcaagttttctcctttaagggtgtggagtagtgcttgacatgtagtaaatgctcaacaaattgttgctattacatcagcattgtttcactgaatttaatccctatgaaattttcactgaagacaagtttgagagattcagagagcccttggccactttattttctttacttttgtttctttgctttccttttctccttcattttcttatctcttctatgtttcaaagttcttagattattggcaaagcaaatgcaaagaacatggttataataacctttgaatgttaacacttaagaaattatttgctattaacagaaactcaatgcagtgtagtcaccaaatatgaatcactgaattcagaaatgttattaattcacactacagtatgggcaggtagacaagtgtcggaatactagtttagagttgtttgatgacagcttatatctttttgtattctcatcagtggtgactatatttgcagagtgatttggaaataataacaaaagattgaatttgtaatgtttggtattttcttaaaatactctggaaccacaacaaagagagggctggatgaaaccatgtggacaattattgttgaagctgagcaataggcttatggtggtacttactatttttgtgagtgtttaaatactgctataataaggaaggctaaagtgttgagggatcctttgggaatgtaagcctggatgaatgacctcctggggcctacctttttcctgcccctccaagtccaagttgggaggtagatggtgaatgttttacattcctggtgtgactcaacataaccttttaaggacagtgttaacatgagatgcctcctgttcctttgggaggtctgtaatttttctcagaaggctaacttatagtccaggtatgtgtgcactctgcccattcagtctttgcctttggtttttctttgatctggaggatcataggaggcaagtgtggaaatacttcttcctggagacaatggcagaggagagtccgtgtatagaaattgatttgttaacccttgcgatggcctccctctcccaccctgggatggtggaagagatgccactgagagcctgggcttgtctggtgaaagagtgggcttaaggaaaaagcaacaacaggatcacaaatgagaccctaaatctggttttttccttgtcctcagtagcttattagagataactacatcacataagctctgtccatgactgtgaacttttatggttttgtctattagagggtgatgtcagaggctgttatcactggcattaatgatttatttgggcacaggtagacttataaaagtaggtgggggtattgattatagtcatgggccaatgagattctgtttcatttcctaaccaccaaacagatgtaaaggacttctgtgtgcagacctcaagattacacagcaaaggggcttccaaaggaatttacaatttgaatgagacctataagaatcaagaggtgcccaagagcagacgtaggcctgtatgtccccatatggttgagttttgataatccttcatttccagtcactgctatggtctggctgaccttctgaatgtacccagtattggctggctttagatctatgatatgagctatttttttactcattaaagtgtttaaatttctgtgcttagtttctcagatgacttttttttctgtgtggaatctggttgatatttttggagaataatttaaatcagttctaattccaccctgaagagctccttttgacacacaagtggctttgtgtcattgcaactctggaggaggccagggcaggcttcctgggtgctcagaacactggctgcccttggaattatggctttatctctgggggatagtacttcaagaaaaaatgccaaggaaatgtttgtcttagtgtatttttgtccattttgcctcaaaaaagatttgtcctgcccaggagcagtggctcacacctgtaatcccaacactttgggaagccaaggcaagtggatcacttgaggtcaggagttcaagaccagcctggccaacatggtgaaaccccgtctctactaaaaatacaaaattagccaggtgtggtggcatgcatctctagtcccagctactcaggaggctaaggcataagaatcgcttgaacccaggaggcagaggttgcagtgagctgagatcatgccaccacactccagcctgggccacaagagtgaaactccatctcataaataaataaataaataaataaataaataaataaataaataaataaagatagatttgtcctgaaacttaaagaataaagactcggtagacatggaatatattttttttcaaatttcaaaatgcaaaagagaatacaggtaaatacttgtatttacttcataaatgccctatttttcacagggtgtatcagtgtgctttgggctgccatagtaaaatagcacaggctggaggacttgaacaacagaaattcattttctcacagttctggaggctgtaagtctaagaccaaggtgccagcaggtttggtttctccaaaggccattctctttggcttacagatggccatctttttcctgtgtcctcacgtgacttttcccccatgtgtacatccctggtatttcttcattccaaatttcctcttgttataaggataccagtcacactggattagggctcactctaatgacctcattataacttaatcacctctttaaaaatcacctatctccaaatacagtcacattctgaggtcctgaaggttagggcttcaacctatgaatttgggtaggaggcagggacacaaatcaactcataacacaagatgaggaatattgttaaatgataaaaacaaaacacttgatccctatgatctaaagccctgctctgcaattctagagattgctttagaagtttgcatttaggtatagtcgtaacatcctagaaattaatttagaaagctgcttttacattaaaaatcaaaaaggtgagcaaaaagaatcatggctctgtaaattttcttttattttgatatttcagaggacattattactattactaaaatattgtgggtggggggaaggaaagttgggagtaggatgagaaagaatcaagtgttgagggaaatttttcatgtttgttggaggaaaagaaaagacatgaaaggaagaaagatgaaagaaagagggagatggagaaataaggcaaaagaagagaagaaggagaaagaaaggaggaggaggatgaagaagaagaaaggggagggggaggagaagggaggaggagataaaggaggagaggagaagaaatgaagagggaatgggaggggaaaggtggagtggggagtgaagaggagaagggggtggaggaaagagatgaggaaagggagaggtaaagaagagagagaaattagtgtaggtagcacttaccatggattgaaaaagagagttcacgcttttccctctcttaggaaactcccagctgcttctaagaaaataagagtgactacatcagagagatgcaaacaggaagagaaagtaaatggaggccctggagagggagagcttgggtattgaggtttggtgtggatagctgagaaccatccaacattaatgagcacaaatgtgtgcacaggctgaaaatgtctctccagggacgctgatgacttgagctttgtgtgtgccattggaaatcatgaatgagaaaataactgactcgctctctcagacaatctggtttatggacctgaagctcttatttgctgtcaggttgttcatctccacgcctctgtgagatattattgaaacagaacccagcactgtcctccttgccaaagtggttgacgttggccttaactttccccagttctgagacagggacagactggctaatgtaagtgtgccctgtggatgtgcaatttagagggaggaatgggaaagtatgttgtatgcagctagggacgcacacacagaggatattttcactgattcctctctgtgggcataactactgtcttgaaggcctttgcttttctggttttatgatttccaagcctctttcctgaatcttagaagtcaaaactcaagctaagctgcaacagaaacttcatcttttctcagaataaaatctattttcttccccttcccatggtaaacaaattatgttgacagacaaatgagggattaggtgaggaaatttgtgattttggaagctcagggaagcagatgtcaggattcagctgagagggaagaatttgggcggggtgggaggctacatggagaaatcagaggcaatcaggaggtgctgtccaagatgaggcatggtggtgagatggataaagaagcagtttctaagatgccactcaagagctctctggagatttacagagagctggacttttttttttttttttgagacagagtctcacgctatcacccaggctggagtgcagtggcacgatcttggctcactgcaacctctgcctcctgggttcaagcgattctcctgcctcagcctcctgagtagctgggactgcaggcacatgccaccatgcctggctaatttttgtatttttagtagagatgtggtttcaccaagttggccagaatggtcttgatctcctgatcttgtgatccacccacctcggcctccgaaagtgctgggattacaggtgtgatccaccacacccggcctcccaaagtgctgggattacaggtgtgatccaccacacccggcctgagttttctaaacttctgggtaaggctgtttgactttggacatgacgctaggcttaactgagcctctattttaccttatgcacagtgggcatactccttaccttacttacttcacaggttggctttgaaaacaaaatcatataggaaaaatattctgaatatgctgaagagccagaaaacatagtattatcactttcttggttttgctgtacccatgtatgaatcttttctgcagcatccctgctgcatgcttgtttctatgtccccatgtcctgcctcagttgaatgcatctggtggtggggagcttactaccctttaaggaaagtcattgtttaaaaacatgtatatataatttttaatttttacagaaaaatgtttgcattgagcccaagtctgcctaataataatagcagtaagctaactctcatgtaaggtatactctgcagcagacccactttgggaactttacatatattaacatttattacatttattattcttagccaccctataaggtgggtactgttattattccgattttacatgcaagaaaaccaaggcacagacagagtaggtaacttgtcctaggtcacggggtaataatttttacctgctggctcttgtttttctgtccatagctgacccaaaatatttgatgaccggtattttgtcctctttgagtgctccctttgccggtctaccatctcctttcccttgctttcttctgcatgtgcctccttctgaagttttcccacagcaggccccactctccaagggtgtttcgacctattcagaaaagagttgcattgctgggtccccttggacctgctgctgccggtcggctgggaagagttataaagaagaaaggacattttcaagctaagctctcctggaaactggtaggatggcgtgagctggtccacaggccccagctgccagatgatgggaattgggatcagctgtgacctaattatgagtctcgtaaacctgcattgtgcccttcattttccagctcattgaccactcagagggggagggaaaagggatgagattctggtcaagtccttcctgccactaccatgtggccaaggtcacaggccaatgatgtccagagggagttggggcaggggatgcgctctttgtcttctctgaatgaagcgagcgaggagtgaggcagagaggaaggaagatttgcagacaagcaagcctcccaggagcttgttggattggaatgtattctcaggtctattgtagagacagaaattccagatttagcattctgtcattgtcagaataacaaattaatatgtcttatgcccacacaactacatatacgcaaatatacaggcatgaaacggaatatctggcagatatcatgtattttataactctttggggacaaagactgtgctgagaattcatttttatactgatagagaaccccagctccccacctccaaaccaaacacataatctccacatcacatagatgtgggcgattcaaattgctttctcctgtcaaaaggtagcatctatgaatcactaagtagagtctatgaaattctcagttgagaatgtgtctataaaatttcctcctttcttacctttttaaataaaattactaatttctctctcaaatctgactgtggaagccttaggactagtgggatattgcagaaagaatgtgacgtttgggaccaggaaggtgctgagattcggattccgcctctgctgcttaccatgtgggcaacgctgactctgggcaagttacttagctctcttagcctctgtttcctcatgagtcaaaactgggaataaataataataaccttttagggttgttttatctctatgattaaacaaaataatagatatgacatacattatgggtctatcacatgataaacgcttaagaacagagactccttttactttccagttatccaaggtatagagtatgagaggggcaggtggctgtgcagtggtacatcttagtgcataatctctagatttttggatttttttatattgagaagtggactgccaaaatttttgttaaatgaaaatattttaaaaataattaccgtcaattaacattatttcataaaaaagacattctaacattctaaagaaagccttcaaaggagtgtgtgaaaattaaataagatcgtgcatataaagtacttaatagtttatattagttcctagctttgataagcattttaaaaagcactaggtatagtttttagatatattagttttagtattggtatagtataaatgttaccataccaagaatcaagtccaaaatctctaacatgacatataaatgggtgttcacacacacataagccatttgtaccccacaaccccagtataaagctatttacagatacactctactccagccaggggtcccagatataaacacttgtaggggctgggtggataatatcattaagtaacatagatagcaggtaagaaaaactctgacgtggtgttagtctgtcttttatccttcattgttgttttaaacatggattcaagctctgaataataataagagccaacatttataatggcaaagaagaatatcatcttgctatgtgttcaagctaagcatatgtttatgtgtaagcatagctttgccaagtataaaaactagtttggaaatcctgtatggactcaatcagcttaatttttacatttttaaccctctgattttgtctttatgtttatcttcaccagttctggttctgcatagaaagtctttagaggaatgtaccctttccgataatgcttccagatccaaaggatgcctcgaaagtgaccaggaattgctacagatggttgacttttacccagttgccaacgttcttctggggatgctgtgcgttttgtgtcctcatcccaactcctagccacttcaggtttttatagatgatcttcagacaaaaatagattaagaattagccaggaggggtcaggcattgtggctcatgcctgtaatcccagcactttgggaggatcaggtgggtggatcacctgaaatcaggagttcaagaccagcctggctaacatggtgaaaccctgtctctattaaaaaaaaaaaaaattagccaggcatggtggcacgtgcctataatcccagctacttgggaggctgaggcaggagaatcacttgaacctgggaggcagaagttgtactaagccaagatcgcgcctttgcactccagcctaggcaacaatcgtgaaactccatctcaaataaataaataaataaataaataaataaataaataaataaaaagaattagccaggaggaatgacaaatagatttcatctttggactaccctctttaggggaaagttgtggttcttcatcctgctggtatttaatggattcagcttcatataggggatactagcttggaaggggagatacttagagaaaaaatgactttcagtgctatagcaaaaaggaatttaaaacatttcaaaagcccccaacctcagtacattccaaagcaggataaaataaatacaaacaaaaaatcaacacctacaccaaaccaggctaatataaaacaaaacctacttaaggtccagatttttttgtcccagcatttaaaaacagtgccagcatggactgaagtaaacacgctgcaatgatttctcagcttgggaaactgtcctttcttatatgtgagatgcctacagaggaagcagaaagatagtaatttctttcccttgcttttctgggagatggatctcagtgtttttgtcccttggtcctagccattttaaagagactgctgccagaagaaccacttagcacaattgtgaaaacctagtccccatccatagcagagatgctttcctttaagctgtactttttgagatattattgacatcaatatttgttaaaaccaaccttcgtggagctgttgctatgtaaaatatattacacttaggtcaccaagtcattagtccaatataggtatttggaagttggtttttagtcattctctttaattcaaatggaattagggtcagaagaaatgttcaagtcctaatcacttagaaacccatatttggcgtgttttgttgcttgggtaaagggagtaagacctcatggcttgaaagaatcctaccagaggtgttttgtttttttttttgtctgatttcctttttcaaacttgataagggagtaggcaaaaaatgtctgagtcaccagaactggggtttcacaaatgaatggtctcgctgtaacctaaagtaagggttgaagtgggggaagatgaaacaataggtggctgtagcactggaagaatatttgcagccccacaaactaatgtctgaattacttaggatacatccctctgtctagagccagcccaaaaaaatatgtgattcctgccctgattcagatagagatatctccaggctacttactatatgtatttattatgaagtacatgaataaatcgccacccaaatacagtaaatgcattggtattaaaaattaacacagactttttgttgtctgtcatcccatcattttctctttaatgaaataacggtctggaataccacctaatggcctgagatgcctcagagtgaggtgtgtttttaccaattctttaacttaatcagactggcctcttgatatggggccaggttcttctgagtaactcactctgaagaaaagcaggatggattgattcatggaatatggaagtgtttgcctagtgggcttcttttcaaaagctcaagaactttttctaaggtccctggtgtaccctggggaaaaaatattcttgactttttttttttttttgtcaaactgtttgtatatgtggggtgtgtgtgtgcgtgcgtgtgtgtgtgtgtgtgtgtgtgtgaagttgcatgttggtacatacttgagatgtcactatagcttttcttgccatttttcattccatttctactgggatgagcaaaattgacagcttctagacatctggaaagaggcttttgatcttaggaagtgaagtacataatcatggccaattttacctatgaggaagataactaagtggtttctcaaatgccagaataaaaaaatgacttcttgtttttcaaaacaaggcatagagatcccaatagcaacacagaatgtttctgtgtatcagagcagaaaaaggggaattgaggtagcattggttgaacacacactatgtgccaggctttacactaatttgcttgaataatttaagtgagtaacagaacaatgtttccactaagttgcagcaaaaactacacatcttagactttccttagtgacatctcgaatcttcagggaaggtggggggtgaataattgaaataactcttgatttcttatattagggaccaggaatatgcccttgataggaaatctgtcatttggaggtcattttggccctttctggaagaaaaggagacattgagtgctttgaggttccaacatcaccacataccagttagtgaaggtgacagtcttctggatctctgaccagcaccagggctgttggcccttgttgctgcccccatcagtctgaacagactcttttcccaaagaaatttgctaaaatgacaaatcagttatcactgtctattaggacatccactgcatccatctatcctaatatcttcctcacgtatgcctcagcggcatgttttacttctatttactggtaccacagtcttagcaaaagtagcacattgattataggagttgtgaagccttgagccctgacaaatggggaccacattgaagaaaatggagggacaagatactaatacaatttccattaatgacctggatagagtccccaggcattgcttatgtatttaatttttattctgattatttttaacattgtaggcagaatgccagaacgccaaccatcttagcttcttcaacattatacagtgaaagccagaggggaaacctaactcatcagatcatagttgacattgggggaaaaaaataaaggtcagcctacaaaatttcttcagactttgattaatacagttgtagatttgaaaaaaatgttttatttgagttttcttcctacatattttgagtttggatgtaaaatattttcttttgaatttggaagaccacttctctaagaatggagagttaattagatgattttcttttctttctcattggaaatgtaaaccgtgttcatttattcaacaaatattaattgagtgtctgctatgtgccagacactgttttaggaacctggaatgctttcaggaacaaaaagagaggaaaaaatatccttccttttgtaaagtttacattttagtaaaaggagaaagaggcaatgcaataaacattacaagtaaattccttttatagtatgttagaagattatgagattataggagaataccaagctgagcagggtaagaggatagaggtgctgagtaggaggataggtgaatccaaagatgaaggggttggttatgtcgttatttggggaatataaggccagtacgtctggaatgcagggaagagggagaagttaactactgggagccagagcatagtaggtctttttggcccctgaaggactccaacttgtactttgagttaaaatgggagccactgcagagtcttgagcagtcttaactcatgtgactagcatgagttaacttgagtcttaagatgcttgtgttggcctctgtaatgtaccaagaacagtttcttgccctatgattccagttttcgataagttatgccatcacttgctgcaaaacagacctcacccaccatgacactgggccagtggctatttattcctgatgaggcattgtaggatctagatcaaactactgtttcttccaagcttcctgattgcacattttcatggaaaaatgcaagggtatgtggtgcctaggaaaaggacagtagaaacggtaatacattttactcttgagcataagttttgattaactttgtcattatttcaagccaatatagccacaaacataattggtggttatgaaattatgcaatcacactgtctgaggcctcattaccctttaacttataaatctgccttgccatctttccatgatcctcttaaagaatgtacctacccaccacctacataataaaaaaagccacaagccccagccttgggggaattgtattgatttataaagagagaggctatcacttgctgttctcattaacctggaaatagacaccacattttatctgctgctctgtttcctgctgtagatctgtgtagtaaatccattaatctgtctgtccattcatccatccatccatccatccatccatccatccatccatccatctatccatctgtccacccatctgtctttccatccaaatttccatttttaaagggactattttgtgtcaagtgtcatactgggaggcaatatatttcatggttagatatataggctgtatgtagcctcagactgtctggaattaaattctgcccattactttagctatatgaccttaagtaagttttgttatttgagcctcagcatcttcctctgtaggatgagaatggtaatcaaatgtatcgaagagttgttataaggatcacaaagttaattaattcaagtccttttcattttgtcccggaggaatagttttagtagtttgagtttgcattcaatcatctcccctttcgctttttcatcagtttattcctttgcagttcatccagcagcctatcaaggacctagtatgtgttaagtattatggagacggggatatttttctgagaaatggaggctgtaggtgtgtctctagcacctaacacagtgcttggcacatggacaatgccctgtatatatttcatggaatgggtgcaactccctgcccttgaaaagtgttcagtgtgtctgtagaagtccagtgccagatgggagtgtcactggtgcagtgagccagggacagggagcagagaaagaacaattgagaatatcagagggagatgatcctccggctgcttctgctggcctggacatttgaagggatttcttactgggactggctcttttgttctgtggtttgtatttctgcctttgtgcgaatgacttgtctgacatttctgggactccatcctgatatgcaggccagacaggtgggatcccagtagggaactaggtatgcctttctgtgtattccaggaagagtttaaccttgggcagacagggctagtctttttgactttatggtatgtttaatatcaacacctggttgggggtagggataataaatgtttggcttacaggacttgcagctttgcaagatacagtggtggtgcatacacttatatttgttatgactcatcttagtgcaaaggcaatggagtacctctagaaaaattgcacatttaaggggataatttcagtggtgactttagtgggttttagaagcacgtgagaagtaaatatgggggactctggagctagaatgcctgggttcatagctcttatcttttctttttctttttttttgagatgggggtctcactatatcacccaggctcaccttgaactcctgggttcaagtgattcttttgcctcagcctcccaagtagttgggactgcaggcatgaaccactgtggctggtcagctcatagctccatcttttattggtcatgttaccttgggcaatgttgttagcttctctgtaccttagttttattgctgtaaaatggttctaataattacaggctacctcattggaagttgagaggattaaatgagatgatatatttaaagtgcttaaattcttggctcataataagcattcagtaaatgtgagctattatttctctttctcctcctcatttttaattttttaaatactacctctattactattgtgaataatgtcattataaaggtgcaactagatcatgtttatgaaggtaggtaattgcctagcacaggcctggcacagataagcactgagcaaatgttagttttctttcacatgggtcattaaagtccgtctgtaaagtctcagggactttctcatcattttccctaaacctaatgcaagatattcacatttctttttgtgcaaagaacaatcttaattcagctgataatcggggcctcccttaccttcccactgctcactataacagagaacaagtactagctcataactttttatgactttgtattgaattaaaattataatgctttattagttatcttttgctgtttaacacatttccacaagcttggcagcttaaagcatcacacatttattatctcatagtttttaagagtcaggaatctgggcacagcttagctggatcctctggtttatggtttcttacaggttgcaatcaaggttttagccagggctgagttctcatctgaaagcttgactggagaagaacctgcctccaagttcacctggttgtaagcacaacttcattcctggagtgttgtgggattgaaggtgtcagttcctagctggctgttcactagaggctgccctcagtttcttgccgtgtgggctttcccatcatggcagcttcaccaaagtcatgagagagagagggagagagagagacagagcctgctaactagatggaagttgcaatcttatataaagtaatcacagaattgataccccatcaactttgctgtattctgtttgttacacacaagtcacaagttcaacgcaaactctaaaggaagggattatgtaaggatgtgataccaggaggtggggaccattgaggctatcgtagtctgccatagcatgcctgacctgtgggttgtcttttagatgctttattttgcctaattttattttattttttaacctcagttcagagaattcaatttattagaacaggtctgaatggtacagaggtgctttaattattcagcagaattctggaaattttaagttttctagaaatgtatagttttgctttactttttctccccttataaatagaaacctgtccttccatgaatgaatgctacagtttcagagatgctttgtttttcccctgattgattgtcagtgggcagtagcctctaataaagggaacagttttaagtttccttttcttctcagcttctctgttaaatggttaatgatctggaagcaagtacttggaggtccttagggagctcctatttaaaggaacactgtgaagagaagttgccttctacagtaaaaaagtggggatgattagtcctccatttacatgtttagtaaatctgaatatttagacttccacggataccccctgccaacccccgccaaatagatgagctgaaagtacaggatagtactctacatgcatctgactgagaaagacttttactatctcaccttagggtcctaagagaagacagctggatggttgcatggcggtagaggtgtcaggaaaagctcccttataattattttcattcctatgtttctactcaatactatttaaactgaaatggggcttcatctgctcctttgtttattcagcaaatacttttgagcattttttatgatccagctactgtgctaggtgatggggttacaataagatacagtcccagccttcaaaaacttatgtgctcaaacgttattctccaaatctttattctgtttctcatctatcattaatgggaatagacagctcattttttattgttcttggaggctagagagtacaggcaaatgcagatgatcaagcctttcttattgccccactcctagttgattccctctccctttcttttacttatgacatgcaacttccacaaaggcagtttatgttagttatctatggctgcataacaaattactgttgaacttagcagctaaagacaaaaacatttattatttcacagtttccatggaggaggaactcaggcatacccttgctgcgtcctgtaactcagaatctctcagaaggttatcattgaggtgtcccctaaggctgcagtcatcctaagggtcgactggcaaaaggtctgcttccaagctttctcccggttgttggcaggatttagttcctcactggctattggccagatccctccctcattgcctcaccgtgtggacctttccatagagcggcccatggcatggcagcttgctttactagagagagcaagtgggaagagccagagagttataaacaagacagaagctatagtctttggtaagctaaacttggaagttatgtcccatcacttttgttgtattctattcaaaaaaagctacttactaggtctagcccacactcaggtggagaaggttatacttgggcacaaatactaggaggtagggattgttgtgagccattatagaagttgtctaccatgggcagaaggacatttcaattctggaaggtatctgatatggagactcttaaggcacaatgagttacccgtgagctacctcttgtacattcatagctgtccaccctttttatattttctgtggtatcagcacagagattgggggcagggggtggaagcatggaataaggaattagatgccaaaactaagaattttattttttacaaagcgttatcacatattaaatctggaaaggacattagagggccttatgcaaatgaataaactggcctagagatcttctatgcagcccccccagggtctgttctactgcagaccctggatctcctataacagaactataacagaacactggatctccacagaaagccacaaaggcccagagatgtgttcgcacagatgtcatcatccctcttctagtccctgcaggagcctcatgggagatcacgtgaccagtatttcacagctctttcccccagcacagaaatatctgccgtgttgagaggcctgtccatctcctagtccctgctagagcctcatggacaatcacgtgaacagtatttcccagctccttctcccagcacaggaacaccctgccatgttgagaggctcactcaagagcctcatgatctgcctgctacctagcaatagctttgttacataggttgattctgccttgtgcctagaaaataaatcatgtttaggattaataatagtttatataattaatatatgtgccatgcttgagccaacacattccatcacttatcttcaggctggctgcctcctgggagccactaggtctcgagctgcaggctgagcatgctgggtaacaatgctataagtctgcttactggacccagtcctacagcctatgaatattcttttctgtatttgaatagcaatagctggagatgcacaagtcttgataaaataattttacatttgttatattcactttttttcttgcctgtcaaaaatgtcagcttttactctctggcttgcaatctaaatggacccaattttaccttagctactttgatatgatattagctgcttagggcaattgcaagaaataccatacaagggttaatctccctcacccttccattcctttgatatgctgttggaaatttcaaagtgctcaaacacggagatgaggaggcagagggtaaatggatacagaatggctgggaaagggagtagcagtggttggctgctcttaagatctctctcccatggcctggtgccatgagtctgtgtccagtgtgatttttggcaatttctacattctatgtgtatttgtgaagtactgtttttgcatcagatgatatctaaggataaattttgtgttagaggagtgtagttacttgggaggaaagcagtgccatattattttatattaaacatcactggcagaaatatgaggatgggtaaatgtctactgataatttaatagattttacctgcctaaatgacattatttgcaatctgtttatttagttagtagcaaatcctggcacattagcataatacctaagggcaaaatattggattgactgtttgtttgcccttaggttatttttaaaaagctacttgtataaattaaaaaataaagcgaggcttggttgctaagaggatggtgggatttgtagactgcacaggagactaatgcaaatcaaagagaccaggaaggaaaggccaggagaacaacagacaacaggtgaatatccagaaaccagcagattctaacaggcaagaggtagaggctcaaggggagacagatgattgattggcttcagagaggtctggtaggaatctaggttgtcagctgggatcgtgatcttcagaacagaccagtgtggggcaagcccaaagcaataacttggggtcaggcatgaggtcagggcaaggcagtgggagaattgtaagctttgaggtatgtgtaggttaggggcttggtcaggaccaccatcagcaggatcaggattagggctcatgggtcttgaacttctttcattcttcctgaccagaggcagggctagtcccagggcctaggacaaggctaagcctgaaggtggacattatgtgacaaccaacaaaaggaggaacatcatactagagtcaccgtatgtcctagtttctctaggacaggcccactttacatgtgttgttccagcatgataatcagtggttctcccctttcacttgaaagtgactgacttgcgtgataagttacatagttaccctgattattttccagaatgtgtttcataaaaatctttttagaagaatgtcatccagagaccacaaaagtagagttctctagtcacataagtatggcaaatccagaatgaaaggaagtttaatggaggagtctttactgcaggatttctcactgcctttatatgctaaattataataggaattgctaagaggggaatagagttcttagtttcccatccttggttgatctatttgtacactttggtactcctgagactacgttatgtggaacacactttgggaaaccctggttagttgaatatggggtcagaaagggaaactggtcattgctcctgctgtaataagggtgcttgcaaagacagcagtcaccagttaaataaataattctggaaacaacaactgcagactctgacaaaatcttcaatttgctgattattgactgacattagcagaggtatatgtgactagccctagctgagtaactttctgaaggatgacttgttctctagctcattggcaaaaccacttactacttagggcatgggaagaaagagaattttctttgttaagtctttaactccatgatgttcttaaaggagagatgaatgaggagataatggtgtgtatgctgtgtctctgtgtatggggaaggggcctcaggaactatgtatttttcaccagcattccaggtaattctgataaaggtagccctcaaaccatttatggagaaacatttcctgggagttctgatgagaaactcatggtgataaaaacccattcatagtggtcatttctttaatcatatgagtcctttgatatgatggccagtgatctgatatttgcgaagttcccactatgtgccacaccctatctatgtgctttcagtgcttaacgtatactgtgtgaaatagtcctcatagaaatttagcaatggccccattttacagaagatgtctaaagatagaccttcaagtgggcccgacttactaggccattccatccgggcccgacaagagggtcacagctcttagacccacccctcagcaactccctaggacaaggacacaatgaggcaaatctctgagcctttgccctaaggttacacaaagctcatttagagccttaacaagcattaagaccattccattacaaacaggaccatatgctgacacattttatctctctgcctggtggaatgggtcaatatcaaacaagctaatccagggagaatgatgcattgatttcctaggccttaccaagtgtgcaggctgaagtcaacctacctaggaaggttttttttttaagatgaggtggaagagagaatacagcaagaaacaaggagaaagatttgctttgcttttgttatggagttacaaatccagacaagtgacataagcagcttcttgtttttagctgggccaaagaatgtttttcttttttaatcttattgaagagccaggatctttgtaattccatcaaggatttcaaactcaaatgcttacaggggcttggagcatgaggagatttagaactgcctgctgggtgggatctatggtgacctaaagaagacctgcctcttctaaaggggactcctgataataatgtattgtatgtttcaaaataaccaagagcaaatttcaaatgtcttactctaaaaatgctagatgagcaagatgataaagatgataattagcctgatttaatcatttcgcattgtatacgtgtcaaaagatcacataatattccataaatgtatacaatcatttatctatcaaaaataataacaaaaaataaaaaagcagactgtgctttttagcattcagagaatagattgcctatggaaaatatggctgttttctcagaaatttcaactttttaaacaaaagttgaaaatctatattttttgaaagtttttctgatttttaaaaacagacttcttgagatataattgatatacaaagagctgtacatatctaatttgatgaatttggacatatgcaaacatcgatgatgccttcaccataatcaaggtaatagacatattcaacacctcccaaagtgtcctgtgctcctttcttttttgtgggtaagacgcttaacctgtgatctaccctcaagaaactttgaagtgctcaataccatattattaactatgggcacaatgttgtatagcagatctctaaaatttattcattgagcctatatccattgaacaattccccatttctccctcccctccagtccctggaactaacattacactctctgcttctatgagtttgactattacagatatgtcatataaatggaaccctgtagtatttgtcctgtgactggcttatttcccttagcgtaatgtcctccagtttcattcgtgttgcaaatgataggatttccttcttttaaaaaactaaataatagtcatgcttggatgaaactttgggttgtttccatatgttattgcgaacagtgctgcaataaacatgggggtgcagatatctctttgagttcctggtatcaattgtttagatatatgtccagaagtgggattgctggatcatatggtagttttatttttaatcttttgagtagccttcatactgtttttcatagctcatactacattcctaccaacagtatacagggggtccaatttctctacatccttactaatagttgttatcagtttttttggataataaccaccctgacaggtgtgaggtaatatctcatatctcattgtagttttttttttttttttttttttttttttttaggagatgggggtctcactatgttgtacaggctggagggcaatggctattcacaggcacaatcatagcatgctacagccctaaattcctgggctcaagtgattctcttgcctcagtctcccaagtggctaggagtacaggtgcataccatcacacctggttctcactgtaattttaatgtttatttccctgataattaacaatgttgatcatcttgtatataattgtaggccatttttgtgtgtttttggagaaatatctgttcacctcctttgcccatttcttaatcaggcttttttcttgttattgagttgtaggcattccttatatattttgggaattatccctaatgttgcaattaatttgagtgtttaaaacattccataggccaaataagacatacagacttctggtcagtgacctctttcacagctacatgtgggtgacgctatgtcactcaaataacgggacactcgtttactgggtgtccatggtgttgcagacatttcataagctacctcatgaagtcctcaaaacgaatccatgggttgaaataatcatgcccatcttacagataaaagtgaggcccagagaaactaaatggtttttccaagttcacacagcctacatgtggttagtgcaggtctgaattctgattggtttgaccagaaagagctgcagatttggggaagttttgttttctctcctctggggaaaaagagtcccactcagggttattccattactacagatggtcactgccccggggccagggccatgccacttttctccaaaggttagtcccaccggtatgtgatgcagttggtggactggctctcctttgattagcatgagcgacgagttagtaattgatcatccacctttctaaggttgccaagcttagatttactatattttgtaaaatcacccttccacgtccttaaagtccacgtgcatagtctatctagattctgatatttcatgtgtgaaattaatcctctcggactgtaatgaaaatgtggctgttagcctctaattaagatgtgtgtatattgattgcagtggtcaagtctgtccactgatatattaaaataaataagcatccattttatattggaaattttgtgacacttcttgagacaccttgagtttctctgagttgttacaaaaccagagcaaagagtcaaagctgtaatttctgcctatcactggcttttgaatagattatgaactcttagaggattgggtttgtatctatatagttctctttatacagagatgaaggctttcacagcagtatctataattgggtgtttaataaatgctttttgatgagggtaatggtatggaaataaagctcttgagatccagagtttgcttggatttcttgcctcattagggaggaaaaggtgaatggggatgcatgggtaaatacgaatgtcaatctcaggtaggaaaccatatgctcttctagcatgaaatgctgaaaagagagaaaccagaagggtgtgactaagacagaaattctgctgattgacactaataccggtatttaccaatcttctgtaacgaggtagactccatttagaatctggtgatgtatcgcatacaagttagattgcttgacaagtcacaccaaggtttactcaaagtcactgccattatggtatataatcacaggctcaccagtgtcccacaagggtgaaggcagaggttaatggttttctttttatttgcattattacttgatctctggctttcctggtgagatgggtttttataagctcttcccatctcactttttgaagtgtttttaagctattttaaggctgttttataggtgccttttcttatgtttgttttgtatgctagaaagtaagtaaagaggatccaggatatgagctattgatactaccaggcacactgaagtaagtattaagtcttttattgagctttctaaatggcaaagtatatttcttttttatttaaaatgttaaaaaaaaaagtggtcaattctaactaactgccctaaatgtatcaaaaggcccttagaagttttcttctttgccaccatggtgaatccttcaagcaaattgattttaagcttgtacaacaatgtgaatgcaatgacactaaagtgtacacttaaaatggtacattttatgtatgtatattttaccacaataaaaaaatagattttaagcaactaatcaactacgaggttgtcagactgattcatagagcatgagcaatattttgtattcagtactataatgtagagaatattactctgttatagtcaagtgtaaaaaatatcatattttattttccttatgttaaatttgggccaggcatggtggctcatgcttgtaattccagcactttgggaggccgaggagggcagatcacttgaggtcagaagtttgagaccaacctggccaacacggtgaaaccttgtctctactaaaaatacaaaaattatttggcatagtgacacatgcttgtaatcctagctacttggaaggctgaggcaggaggattgcttgaacccgggaggcagaggttacagtgagccaagatcgtgctactgcactccagcctgggcaacagagcgagaccccatctcaaaaacaaacaaacaaaaaattaaatttggctctgagttctcatctactggaaaggtgtgtgagaatcaattgtgttatatttaaggaaacccatttcttaggggtctttgaaaatctaaatgagacttacatgagatcaggaaaatgggagaggagagctgcattcttcccatggggaactttgtaatcatttttctctttgccacacaatggaactctgcgatttggcccttcaccgcctgttaggtttatatgcttggaagtcagggagaggctcctgtaattgacctctctattgaccacagacttggccagaggagcaccttctgctcttctccaggctgcagtgttgttttcacctccagagggacctgcagcaatccttttcacctttggcattgcttcaaaggggacatgggtctctattagtcacagaaactcagcaagatcttatctcacttcagaaagctcatatcctctgagtggactcttctacctgcttgaaccccagcatgcagccagcccagattctcagacaaacctttggatgaagaaagtgaaactctgagtgacaaataactttggcttgtctgccctaagaaacacaaattgttagtgctcttgaaagtaaaggttctgagactcagaacaggatggcctaagatcttttctatataggggaggaaaaaaatgtttttctgttttctgaatgtccaaggcagccagaacatgacaaaattttatatatatatatatatattttggcaatgcctagatgagtattagtaacatactagttgcaagggtagctttagagacagagaacttgggtttgaatcaggttgaagcaggttaagttccccatgcctcaattttccccatctgtaaaatagaaataacagtaatttttttatcatgaatttactataaaaataaattaaataaaaattaatatgtgtaaagtactttagtctggcatgtagaaagtacttaatgaggaagctataataataataataataacaattagttaacattaccaaactggttattcagagtttaatcctctggaactctatgcttagctctaatctcaaggagtccagggaagcagactaatcctcactattaaattttgtattgattctcggatgttttcaaagaatcctacatccacatatctcaaaggagtgctattgatttgatcattttatgaaattcttacccttttgctttcagaattctagctagatgacaaaaaggaaataactcacacatgtaaattaatcaaactattttggaactcaaacattgcttgtggaagacttgcagattgagccaagccctgttctttattaactctggataatttgctttctttgtttgatccctggcctttaagtgaatgtcaatctcttgcttttttcctgaagacctataaggcttgctgactaaatttcatggaaattctttgagattcttagctagaagaggctgtaaaggccaagtgctataggtactaacgtctcattgctaacactgatattttaccttgatagtaacttccaacttgacataaaagcttgtaagcaccagatctttgcctctccccatggttgtatgtgtttgaattctttggagaaaattttatgacttgcatggcttagggtttcataaattataaaaatgttttatctctggtttgaatagagtagtaaagcatatccctgatttctcacttcttccataacccagtgccttcttatttctaatgcctcctagtctgatgtcactgagaagatgtttatggccttgcttgccagagaactaaaaaagaaaacaacaacaacagcagcagcaacaacaacaacaacaaaaaacatctaacaacggagccaatgcttactcatgccagtcccaggattccatatatggggacattgggcgtgttttaagccatatgctcataacctttgtgtcatgattcagttggtgtgtcttgatcagtttcctcatctgtcatctcttggaaagcatgtaaagattaatcacagatatctgcttgtattacctagattaatgctagatgattagcagatgaaccttaacatctcagtggcttaacaaaaaaaggtgttaatctcccacttctatatgaagcccaggtgggagtaaggctgtactccacaaagtcattcagagaaccaggctgttgaaggctctgccatttctagtaaatgacctccaaggtggttctcagcacaaacatctattcacagatggagaaagagattttgcatatatatttttctaattttcatttttgcaaaatgtcataataagcaggtaagatggagcctcagttggagttgtggttagtcatggtgaaacaagagttaaaaggtaaaatcgacagatttcctatcagctatttatccatcattactaagaattacggagtgttaggcttagaaaaggtctaggaattgactcattttcctacttccaggagatctggttctagaacccaggacttccagctcccaggcaaattgaagcgcttcttcttccacatgggacccacttctatgagagcatcagtctgttagggttaagtccaagctctaccacttaagagctgaacaagttatattaactgcaaagggataattttagcaacttcctcattaggaggttgtattaaatgcacaatgcgtgacacacagagacttattgtcattattaatatcccaaattttttaaatggtcacaataattccccttgcaacttctgtcatatgaataagcccaggatcgcttgatggatgatgatgaaggattcatggccaagtcatccacaccacctcagccgactttgagtcagtcaccagacatgtaagtcatgtaagtaagaccatcctagagcatacagccccaggcaagccagcctagatcagaagaaccagccagcctactcacagaactgtgagaatgaccaatgtttgttactttaagccactaagtttggtggtggtttattatccaacaaaggctgatacagaaaggatcacaattgaggagtttatgtgagctcaatctgaaagtttatatgagctagatttgcccattatttcactaaattcatcacatggccccacctaactccaaaagagactggaaaatgtaaaaaacccagacagaaagggaagtaggctccaggacagctggccaatatctgccacactgatttaccttgattttgtaaaaacaaaacaaaatcaaaacccttaggtggcaatcagagtgtaacaactttccaggcaagttctttgggacaggccactagacagtcacttttagtttatttgtttctcacaggaagatagagaaaaggaaatgcgacagatgtgatgccttcctgagaggctgtctggtaaatcaattcctgccaaagttctcctacaaccctaagagataaaaaaggaacctgcaggcgaaaaccacaaggtaggaagagtttgaagctgtgatctcttagaataagagcttttcatttattctttctgagaaggaagtctagggcatctgtcattgagagtgctattgatataattttgctttctgccccgtaggatctgaagcagtcctgccccaggcttagagaagtaagggcaagctagcccaattctgtttgctccagcacatctcatcccagagcatttgttgtaaggccctcttctttttgatcccatgtctacatttggatctctggtctgggaggagaaatctcagaggctatgaatctgatgaggaaggcaacttggcagtgcagaaagcaccctgctttgcagtcagactttccagcttccaattctacctctgccagattaattagctctgtgtgatcttgcacaacttctctaagccttaattgtgagaattaatattgtatttattaggagtatggcacacgataggtacttattagatgttagctatcatcatcatcttcatcataatttgattttgcttttcttattccctttgatcttgcctcctagtctaacaggagaaacattagaagttggtggagacggcctagaaaaggaagggtagattagagagcaggagatagtgaaaaattacagttatttcacaattgaaatcctatcccatgtttgcattgttaattatagttttcgaaagactgtcatctaggcaatctcatttcgcatgaccattctatgagacacaggaacatgcagtctattttggcagataaaaaataaatacatgaggagttaagtaaaaactgtgttactgagactgcagtaacttttataaatcaatgtgcaaaaaaaattcaagtattttggaatgagatttgttggattgaaatattttatggtggtctgtaacatcagctcgtgagctcatagaccaaaccccatcccaaatacctggtgttcaggattatcaatataaaaattgatttaagatccccataattcatttactcctatttcctgacatgcagaaagcttactgccactgggttatttcatcagtttttccccatctctccataactagtctacctctgtatgcttggcttctataacattgcttactggtctttcttaaggcatgttgtgttctgggtcagttctctttaatctgtggccaaactcttgctcagatctaggaatgtgtcatctatgtgcatctttgttctaagctgaacatttcttagcactatacctgagtttctgctgccacctttcatattcttttatgatttgcaaagctagcaggaacccaaagtgactttcataaccaagtgtccagggtctccaggagttcaggttctctctagtaaacagttccaagaccgcaatgaaagagatgtcacagagttgtatatagtataacattaactaatatttgaatgataaattattgccataggaaactagagaaagaaaaagacactttgggatggagaggttagggaagattctgtggaagatgtgagatctgagctgtgttctatggggtagctaggtcgaggtaaaaaatgccatagccaagcgatcagaggcataaatatgcaaggagtcttgggtggaatcacaaagtttagcagatgagtacatgaaggtagaccctttgtgccaggaagtaattttgacagaatgttggagataattttgcctgtaatggtttctgactgacagtttattcattcattcaatcattgagttcaacaaattcaatttattaagaacatactatatttcagtaactcttctacatcccagagatacagcaatggacaggaaaggttctttccctcatgctgattacatcttaagtatggagacaaacaattaaaaacaagcagatacacacagtaatatcgtatagtcatagaactatgaaatgttaaagcaaggaaacacaatagtgactataagggtcaaacaccattgtagagaggaaaatcagggaggaccacttgggttgggtgatatttaagctgagatttgaatgaagaatggaagccattcttgtgaaagatctgggtgattggcattcctggcagagggaacagctaatgcaaagctctaaggtggtaacgagcttggtagagtcaaggagcagctgtcattgctctgtagtgcacttggaaaatatgctcaggtctggtcctactattggcacattaagccagaatctctgagatgaggtctaagccacagtgcttattaacacctctccaggtgattctaacagttagccaaggttgaaaaccgctgtattaaaggaaagccaaaagatgaagggcttttttaagcagacagagaacactcaccaggggaatcaatggaggagggaagtgaagaatgtaactgtgcaggaagagtatgctagggatagagggatgctcatcttcgacctggtaatcaatggaatccagactgacctattacaagagtggggtccctatgctctttacatagtctcccttgtcagtttcctgaaatttattgtgccaactatggtgggagttaaagcgttaaggtttggcttatttgttttgggcagatcacagagatccaggactcagagctagggaatagacagctgaccccaagctggaaaaactttcccagatactccctcctgcctaggaagtggcctatgaaaaagcagtttaaataatggcagcctaaaatatagttctatatgcaacatttttttttctatgaaaactaccttttgccttatacaacctgttaaaaagtgggagatttcactaataggagggcaggagttgagcacagatccaatagaggaaaaatactgtcttcaggcagataggggatgtgccactggggccgagatgacgagtttcgtgaaaaacagagttcaaaagaggaggctcttgagtgtaaagataatttgaggggaaaagaaaaagatagaatgtgactggaaggaacggaataggaaaagcagcatgatatagatggaaatctcctcatttctttgacgtccttaacaagaacatcaagtgaggcagaatagtcaagaacttggactctagaatccaaattggatgagcgccttaagcactttaatccacagtttcctcatctttcaaatggaaacaacagtgcctaggattcgttgctgtgaggactaatgacaaattgcatgtaaaaagcttggcacagtacctggcacttagtccaggccccactccatggtattcatcaccagtgtcaaaattgccataataattaacattgcctcaatcacaaaattcatgtcatgttcaccaacagccaatggcttccagataaaagtgagaaggccaatatagagctggggttaaacatgtcaagaattcaaagctatagtgcccctgggtattcaaaaagcgtaaagatttgactaaattcacagccaaatggcatttaccccaggtctaccccataccagtcactggcttctctctaatagttgttatcccttttaattctatagaatagaaaagaaggaattggggctaggctgagcagcagaggagagattggctgtggagagtatagatgacacatgaggccaggtgatctctgagaaaagtttctcccatctgttgcttagattgcccatcttggaactcaggaaatctgagatggctttaaagaaaatgatggcattgagaagtagtgagattgcagggggctttcaattttctgcttgggtgttggtggagagcaccgaggtcaacatccatgcttgcagtataaaattctaggtctgtgtccctgaaaagaatgttggtgtgagctaatgtgaaagatttggggagaatttgtgtaaaaagtaacaacaaacaccaaatgcctagttgagttctctgatgggtaaggtagaatatttgagagatttttttgagaatatttcccactgaaacttgggaaataactatagttaatgaattttgaagaaaagagttagcaaaagagaaagtaaatctgatcattaacattatatacaataaactgaactgggaaccaggagacctgtgtgctagactggattacattgagtaagcaatttgaattatctaggtctcagtttcttcagtctgaaaaagaagggcatgagattatattatgttgaatccatcttttgtttaaatttttgttaaattctatggagtacagagaagttgatggcttcaggcacaagtgagaaagtattttaatcttcttacatttttaggccatgtccaaatcatttgttttttcactttattttatttgaatataatttaggttttctttctcatggggtgaatgaaaataaacactttagaaatgtataaatcagtgtgcatttattggagtatggccaataactttagataatgaaaaggatgattgagctatttaatatgttgatttaagtaatgctgggtgatgagtggtagtgacaaggctcttctcttactaggatatcacatgaacaggttctgtcctaattctgcccttgcctagtacatatgggtgactagaatttggtgagagggggctgtctgctgagctaccccaactgtggttacagcacagttacagagatggatttttaagtacacttgttttccctgtcatttgtcatgaaacagactccctatgctcattatcaaaaagcccatatgctatcttcagttcacattttgctcacctctttctcttcattgcattagtcaagttcagaaactagactgtcagctgccagacaggctgctgtttctctcagagataggtgaaaaccatttaggaattcattatcaaagtgtacagcccaagaaggtgtttttgccttcaattcaattattccaaagaagcacacgataaagaaaagtactcaggacaattagatggactatctagacgtcaaaaatcaaatttttacctttgcaaatgcaggttcatattctgttcttaagtcatcagagggaaacatatgatgttcactgtcagtttagattgtcagaaaaagcttgttcaaaatctgtaaagttgtcactcctcatgtattttcactcaagaaaccagggatccaacttcctgtgcctaaactctctgcctagacaaatggatcttttgggaggttaagtatgtcttagaagaatatctgagctggagttgcaaatagaggaatcatcttttgttaagttgttagaacctagataacatagaagattactctatggggtttgaaaaaactaagacatgatgccctctcatgagacctttacagtctatttggggagttaaggcatatatgcccagaactttattttcagtggttcttggcaattttaaagttccggtagtatagtacaagtacccaaatgtgatgcccacaatgagggctgtggtaagtcagaaaagaggctgggttttggtttcttaggaaatggtaatttacatggagtctcacccacctggaaggattgcagtctttatgtttagcatcactttttgtcatttaaatttctctctaggtggggatctaatccagtccggagttacaggagctagaggtgatcagaaagtgtgcctaatttgacttttgctccatatgtgacataaaatagaaaaaaagtgaggtccccaaagaaaaggtagcttgagaaccaatgagagtgtctctccatgaactgtcaaaacctctgggatccagcagaaacagggtttgatttaagctgttcctgggtacaaaatgcgagctcttacttggcatttatccttgacacatatgggagcaggctttaccagaggcaagaattcaatcaaaagtcaggctttttgaatttaggtctttctcttttcttctgctataaaatggtgagatcatagcccatgccctaattggttcacagatggatacatcctgaggcaggtgggggtaatcctcaagttttcctacaccaaagcataccccagaacaaagaactactcgttctggaggtgaagataaggcctgtgatgggttgtcccatttgatcactgtggatttcctctctgtgatatcttctgctcccctggaatctagtattgaggaaaaataaccttaatcaggaactgtcactcttcttcaaagagtaggacagtcaactggcctctagcctataaagaaatattcctttcagatagactctagtatataatatcattctgctattcatcaggaagtggctgaataatttattatacaacttgtctatagatcagagtagatgaataataaaatctttagtatgtaaaaaccttacaagaaagttgagacttatggtagcaaaggatccagaaggattgggtcattttgtagttattagtaaacatatgtctgtgataaagaccactttggcaaaccgaggtatctctctacccatcatcctgcttcaggagaacttgggctctgataagtatgtacgtaatgatcaaatcccccacatttaccaacctgctccagtcatcattgtggtagatgtgtgcacgagaaaaatgctcattttattccattccatggatacttacattctctgcgtgtttatttaggaagcattttattgaaatgattcctcattatgtgtaacttaataccatttattcattaatttatttactcagtacacattaattgagtacatacaatgtgcctggtgctgggaaagcaaaagaaaaaaccaccatacttatcctcaaagtcatctcagtctatttgtagaggtgaataataaatgactgtaatacatggtgaggaagaccaccattaagtcagaaattgctaaaggagttagcaactaactgtctaagatgattgggagcattcacagagaaggttatatttgttgaggaccttgaaggagtaggagttgcctaggtaaatcaaggaaataaagggaataaatatcaaaggacccacatgtatgaagacacagaagacatagctttagagaagtttagagatgtttgtagagcatgctggaacacaagaaatgcttttggaaagactctgtaaaatatttataccctaatactaggtatgcaacagtgaacatttaaagtttattgaattaagtcaaccaaagaagacccaagttgtgggattcaagaatagcaaggctctttcaaatgcctctgaaacagttgggggtggacctctccatggtgctgaaacatcccctgttcaagccttcctatctatctggattattggctcctttccatgttcctaaccctcattctgcatgcagtaattacttgattgaccatttcactcactggccctgccaggaccttgccttggatactacctgtccaatggtgagcttattattctttcctttaacctgcacagaccctggatgggcatttgatcaactgaaataattaatgggtagaaacagatattgtcagtgaagtcctttaacttctttctgcttgcttttctcccagatattttagcatttaattaatctggatgcaatttattagttgcttgggttggaatttctttagccttttagcccagatcacatatacttattacgtatttattggaattttcaggaaactgtagttcaaggtgaaactttgaagatagactcaaacaatgggcatgtctcacaatgatacagaggactcagataaagttggtggaatagagtggaaagaatactggatttgaaattaaaagttcaaatcagggtttcaccacttagaagctgggtaaagtcatttagtttattttgaagcctcagtatccttatttgtaaaatgtagacaggttattccctgtatactcacaaacttgtgctaagactcaaatattctcatgtttgtgaaattagtttgaaagtgatgcagttgggaacgattactggataggttggaaggttgtccaactggtgcccctcatgatgggaagagacagaacactgcgaattagcacagtgaaagttaggagctgtgaagaccctagggggcagaggaggtacaggcattaatattatggtgctgagaagttaatatctttctttttaaaaaatagctcggcatagaagctgtcagtagggctttctccccggtcagatttatgacttctgaatgacattgttttactttgccatttggaggataaacaaagctggagagaacaaaagttttattttcctatcagtgacaaatacatagcaatcaatgtaattgaagttcaagtggaataatttatgggggatccattgcatgctcctttgtgtactctgtctgtctgtctctctctcttcctctatccccactctaattcctttcaccgtcatttatttctgcctctttctggtattcagtcctgtatatattaaaagcataagccaattagaaaataattgctgttactctgcttggcccatctttcttgatgtttaggttagtttggcattttattctctccaaagaatgtatttattcaaaaaagacatctaccacatttaatgcgggccatttagatattaatcatcaaaggtaaacgatgaagaaaaattttagtctttaattcttttcttaaaagtcacatatacagagagctaattgacccatgctatgcagaagtgctctgcctgaagcccagggttaatttttacaatggccacttagccaattgaggatggttaagtgagcaatattttatagactcttgtattaattattttgggggatggatataagtttgtggatggggaaaacactctcagattattctaggggagatgaatgatatatctttacaaaaacatataaaaaccttaatttcagtgaatggtttataatgtaaaataccacaatgatatataactggataagagggcttctctgtgagtagagcttatctgtatatcctgatgaaatttaaaaaaaaccccatggaatatatgtttttgggggttaacaaaaggaaacttgggaaccaagaaaaaggaaggatgtaaattaacttattgttgtcctttattgtttgaaaaattcttatcataaaggatggtagcccactgatttttaatttcactgataagtgagcaggaaggaataggtaagagatgaagatgaatgatttaggtcatacttcaataaaatatttttactgtttatttcctgtatcacaggtttttcaaagtagagcatttcttatctggctggtatgatttaggcattattttatcactagaaaagccataacgatgaagggatggtatgttcaaagcagaggattaatatttactacatatctactatgagtaagttactatgcttttttacatatacttttttacatatcatttaatcaacagtcttgtgaattaggctattctgacagatgagaaaactgaaaatcaaagacactaagtagcttggtaagtgttacataaccatgatatgtcagagccattaaatcgaggtgtgcctaactctaaattccatactctttatattacactatgatgtctaataaataatttggttgaaagagtcatttttattcaagataggagagtagactcattgatttctgttagtcttttctatgaatctgttatcggaaatagttgactacaattaaaataattcctggcactataacactactagacatcttcatgtcatgtagccaacatctttttttcctttgcaccatataatctgttttctctatgggtaaaaatcacattttaatgatggggtggaacttcctttattccaaaactcatttgtagtcggggttgggcacatatctaggtctgataaatcagaatagcctattcttctgtccacagctatttatttttaatgttttcaagctgattttacctttctgctagagtcatcagggaagatactctctttccactggggttgttaaacaagtagaatgcaaggctagactactagcaggcatccttctcattaattagcgagagaagagcttgtctgaactatggagggaaaaatagagaatcaatatctaacggtattctttaagaccctgaatccagccacacttgaaccatttttctaaaggaatgtgaattcatagtgtttttcttttatcttgggtctatgttatttgattttaaaatatattaaaatctagcaatgttattttatatgtggctgatacattatatatccatagtcaaggagatagcactaatcacataccatgacaatagacacaagtctgatctaaactctgtatagatattggcactgcccttgttttccagattatctctggagtgctctgagggatcagttggttggccaacaaataccatttgtgcctcaggctctttgtaaaacctaggggaatgtctgaatttcccttgattgagacatctcccttccctgtcaagtcctgaaggagctgtaaactcaaggaataatgccaaaggagaaattagtgtctgccttattatcaattgtacttttgttcataactcgcaataatttggttgctgcatagggcttagcctcaaatctaagcagactttctctgcctcataaatcaaatcttaactctaggcagtggtaaaaccacagtgcccagtaatggttagtaaagaatacaagagagtgtaggccgggtgcggtggctcacgcctgtaatcccagcactttgggaggccaaggcgggcggatcacggggtcaggagattgagaccatcctggctaacacggtgaaaccccgtctctactacaaatacaaaaaaaaaaaaaaaaaaaaaaaattagctgggcgttgtggcaggtgcctatagtcccagctacttgggaggctgaggcaggagaatggtatgaacccaggaggcggagcttgcagtgagctgagatcgcgtcactgcactccagcctgggtgacagagcaagactctgtctcaaaaaaaaaaaaaaaaaaaaaaaaaaaaagaatacaagagagtgtgacccatagttcagactactcaagtctatgtgggtctgcttcctgaacagctggtaaacagtggagaaagccatactcaaatgaatttcctttcaatttcagtgcgtcctttcactacaaaacagcccaatcaatgtcctgggttctgttcactcagactgagaaaaagaagtaaatcatccatagattttggcattttgttattatcacaaagtatgctagacatacacctcataagtgattttgacaaaaagatgtgctgcaagcacagtgcttgaggggtggtcacgattatggatatcactgtactaatctcagaaatcttagtgtatgtttttttttgtctttactggatagtttcgtatttctacctgcatgtggagttctgtcagggccacattcttccgggatatataaacgtggagaaaagtccttacactgtggtacagtgatccgctggaggaaagtgctatatctgtgcattttgcaagaagtcattctatagcatgtgtatgtctattaacacaatcactgaaccagagccaaggttccaaagggactatctgagatcatctttctaacccagtgattctcgagctcaggtgcatggcagaatgcctggagggtttattaaaaacactgattcctaagctccacctaagaccgattgaatcaggttcttttagtgtagggtgcaggaatttttttttataacaacttccccaggcgatttttctgccagtctatagaatggcctttggggatctctttatcttttaccttcaagttaaaacacatcactctgaaacttcatgagccagatacgaatctaacctatattcaaagaggtttagaaaaagataccttcaacctctctcagcacaatttttttttctattaagctcccttttcaaaatacttgaactccacctggacctaggcaaaatgttttaaaatggcatcagagtgaatcaaatcacattaacctgagatggtgggcaaggatcatgaaaaaggacagagggaagcctgaatgtgagtttgcctgaagaggaaatgatgattccaataagtgccttttctttccgtttgcattctgtgcgtagctaatccgctcggcataatcctcttaacggcatgtgttccatcagtattttatctgatctacttctctgacaatcctatgtttgctagtttccttgtatttttgagaagctctagatgttacatggaaaattcaaccttgtttctctgttttcatacaaagtggggttcttggaattcttagaaaatggggaggaccctttgcacaggctgaagttgtgtgagaagtctggacagagtttccagctttcaaaatttagtaggggaaaactaaatagaggctttctcccttgtctcaaaactggattttaatttgcacactgctggtatgggtcaggggactgttgtgctgaatcagaggatgtaggatacagggaatcatgaaaataagcattggcccccatgcctaggtgatgagaacatttgtcagtagatgttaaggttcctttataagcttgactattgcttttatttgcataaccaaggaaattagaataagattggggcatccttcatttaccatagataaagacagggattctcttactgtagacccagccctatctgtgcactgcctcctatggggaataatctgagggctaaaatgcatgaccacttgccatggtactaaagtccctcagctggacttcatgccataatcacttcatcccattgggaattcagatccctctaaattaaaatacccctgagatgggtgtaaccttaatccctttatcagcttactctgtaattatcaattaatactttaggagagattaactggcaaaaaatggaaatcaagatggcatttctcctggttttgctcctcctcgttttgttctcctggttttgctcctcattagcagtgtgaccttaattttttaatttctctaggtcctgggttcttcatgtatgcagtgaaggaactaggtgatagaatctttgacctctcttctggttctgttttagtgacagaattcactaaattcacatttctggattcctgactgaaaggggattcataagagccttgcttacttcatggctttcctcattgtgtccatggaactcaggccacatgattgtgggtctagtgaaacaaagagagtgtggccagagaatgaaagccataggaaacctagatagccgcataattacttagttgaaagccttgaacagctgaattccagagatgagtttgcaaaagaggagtatcatatgggatgtcacacttcaacagcagaaaaataggctgatacgatcagaaaggatgccaggccattgtggacatctgccgtgcagaatgacatcaagtggctgtctgaacatagtctgaaatctctctctcttgactttgaagagacccctgggcctcaaacttcaaatctgcaaagatagcactatagccagcaggcctggctttctcatgtcaacatgatgcaaacgtttctgtggatacgggatttggagtcaggaaaactatattccagtgtgacatctagccaaaaacaaagaaaactaacaatgttattgttaactttgagctttcctctactttaagcactgggctaaatgtttcatgtactttctttcattcaaatggtgaccttaggttcttctgtgagtcttcatttctttttcagtaaaaatggagcatatctgctttatctgataatagtaactaacaattaactgaatgcttacttgtgcaccgtgcactagggtaagcactttcgtgcattattatctttgtacaataatcctaagaggtaggtagggatgatgactatttatagacaggaaagctgagttggactaagtgaaataaacagcgatgaataaagtctgtggaagaaaggggattcatattttctatgcttcctgatatccaagtcacccagaaatacaccaaagaagctttcagttttcacacctggctgtatgaatttattccatctcagtgagggccaaatggaagactatttgtacagggctgtgtggattaagggagtgaagtggcaatgagaaacagaattcaagtaatctagagctggatagaaactacttatttaagagagcacttggattccagagtttgagtaaaggctttattgactaacttcctaaagtcaccaagaatatcaataaactaaatttacccctttatttatccttacacctttgtattagtccattctcacactgctacaaataaatacctgagactgagtaatttataaagaaaggaggtttaattggctcatggtactgcaggctgtacaggaagcacagcagcatcttctctgcttctggggaggccttaagaaacttgtaatcatggcagaacgaaagggggaagcaggcacatcttacatggctggagcaggaggaagagatgaagtgggaaggtgatacacacttttaaacaaccagatcttgtaagagctcacttgctacacagtaccaaggaggatggtgttaaaccattcatgagaactccactcccatgatccaaccacctcccaccaggacccacctccagcactggggattacaattgagcttgagatttgggtggggacacagatccaaaccatgtcagccttcttttctgtgttatttttatgtccagccttactgaactttctaagctccaattttttatgatctgaaaaatggggctagtaatagctttaactggctagtggtggtgagtgggaggcaaataggagaattaaataatatagcagacattaaaatattttgtcaatgataaactaatatggatagctattaggcctaatagtgactgtgttgattgctgatttattatttgtcactgatgacaggacaatatctctcttattgagaagaaatgccttccttattttcttcttaaaaagattatcatttgcttattttcttcctcctctgtgaagtaaaactttatcaagaagaattaaacatttaaaaaagatgtgcagtaattggtagggaaggataacgagaagaaaagcagacaactgtctgctgcttagcatatccatgagtgtgttaatttaattagaactgccctgtataaatattaaactcaattcacttttgttatgatcctttgcttttcaaagtattcccagttacagattatctttttcaaattcttctgtgagtttgagggagttaatggaagtaaaacaacccaaattggaatgaactgagagaggttttcatcttatcacactttgcttctttctgttattttcctttgcctagttcctggcccagcggcaaaggaggtgattgattttcagtggttttgcctttcaagatgttggcaatgcaacaacttcccttcagtggaattcccattttgtgtagtattttggggtggaggattgaattgctttacatctccacactcctgattaaatgtgaacccccacctgacgtttccaggtcagtagccaggatgtgggatgtagtgcgggatggttgttttatttgattttccccacaactgtgtgagggcaggatatcattgtccccattttacagttaagagtagagtcagtaaatcacagagccaagcatgtataatttctaacagaaattatgggtttagtacctagattgagattttgatagattcaggataaaggtagtgaaaaaattgcccatggaattggtttgaactgaattcatgagaattatagacttccataggcagaagggatcacttttagagtcttttttcagaatgaggtgagtgaggcagagtcgtgcaagtacagatttggggtcctatctttatttaaatttttgatactttgtttagcatggatatttccattcatttttgtgttttaaatgttgcattaaaaattctgtatctagattaccaattcttttggtacccccttaaattttctgcctgatgcaagtgaggcacttccctcaccctattcccagccctgtatagcaggcacaatgctaggttgtttaccagtcatagccccttatttttcacatgaagaaactggggcctaagatcacaaagccagcaccaataacacatggctcttgactcacagtatcgttctcttcttgctagtggagctaaaataataggagagacaaacgtcaggagattgtaacctcataatagagcctgactaaatgtgccagggaaaaaagtgtagcgtccttaaactgtacaagtcagtttagcaccaaatctttcactcacccagcaagtagaaatagctgcaagttgcagcaggtggaatttagattcggttcaaagaagaattacttgacaatgtgggaagtgaggtgctacattgtttcctagataatggcataaaataagagtgggaaattcaaatcccctgagttgggtgtaaatggtggcaactgtgacaaactggagagagagatcatagtagaaactaagttctatacttaacttgattactagagaagcaatgtcttttctttctttctgggtctcggacacccttttgatttcaggtcaaaatcattttcttgaagtaacgtgaaccccaatatggcatcatcctcttctacctatccatagaacctccttgattctacttctttgttttgtctttgcagctttagtcaacagaggctgttcccacagttcctcatccttccctcagttatctatttctgtagctctgggtcctgaattacagcattttctaaccctttgatttggctctcttctgctctgaaaagcattggctctttcacagttactgtacagtatccccactgtggcattttctgactcccatgctgggccatctcatcccccatcaacaaatcaccttgctaccacatggccttttggtaactgacttttatgtagaataacatacatgtagaatgtgtgagagaacaatgcaggcaggagcctggctttgctctgcactgaatatttagcactagcatagttctctgctgtacaaataggaagtcaataatacttgttgaattaataaatatttatacagtgcaatttaattaattccaagtttggcatcttctaaaattcacataggaattttcaatgtggccaaaagccccacatttcatagcaaaatcatgacttggctaatcagagagataaaagaaagaaagaaagaaaaagctctgccctttgcatgtggcctgataaacaattatgccctccagacaccagggctgtgaattccgcctttttaaacaggcccagagtcagcttatttggagattttcagcaccgtggacagaggcaccaggttactttttatctgtcactccctgaacagcaggatgaagaactactcagtttgggacagggctctcagccactgtggtgaaaatcaccccctttagcagaaggaaatttacttagaccctttttatttcccctttcccttggaaaaattgcattttcagttgtcaaggcacttaggcttctacaagttatttttcaggtgcctggaggatggaaaagggttgccctggaaattgatatcttcttctgagtttggcttaacaggggaaccaccagtgcccttgcggatggctgaggtgtcttttatgctaggtatggctctcttccagataaccaagtgtagacaggagtaggcccagttgttcatggagcattggttttaggacttgacctaaaagctgggtcatactattgccagggcaagaattacaaaagcaggtaaactctgccaagatttttctagtggaacatacacattcatggggatgaatccttcccaaactttcaggttttactgtatttggctgtaaaattcaaaagccagattgactaattctcagtgcctgttaaattcttttaggagcaaagtgatacattgtccccacccctgcctttcctaagaactcattttttcccctactcattagctgtattcaaatgcagagctttgctgatgaacagcaaagtggcttcttgactattgggtctctcactttgtcttctcctggactctgtaagtagccctactttcatttattttctaatctttgatgcctttccttcattttcttgaagcacctttacttttcatagtctgtctctttctttttgccccttttatggccattacacacaaatctgagctggccctcttctcatggcaatagacatcctgggctactttcatgaggaagcttaggacaggagctgatggagattagccaaaatgtcagagttagcctaccctttgacctgggcctggaggtgaggttttcttcttacacttactttggaatgagaaatgagagagtgaagttttcttcctacacttacttcatgtcaatcttctcagtgtctaattgctatgatcagaaattcagagttatcccaggctgggtatttgcataccacaatgagaattgctacaactaatgttgcttgatggaagggcaggagctgaaattttacctgagccaccaattttctcaaaaccttggcctgagagagaattcaagttttacccagaagtatctacattttgttttttacaaaagggctcatgatagagctcagttaccttctgctatccatctgtgccaatctgaactgaatcagagtatcatttccttttttttgcatgtgctggtgtctcctgtgttggccttttagagtctgacacggtatttgggaccctccatgagattggaaggagttccattaagtgatagataaagatgtagccagtagaggccaaaggtactcaaatactttttatttaaccttcttactttttgtccttagggaaactgtagacactttgagactgtttattttatgcttcttttctaggaggtaaagcttttgggggaaggttttatgctttcagaattttcagttaacatttctgctttgtgatggtctcccaatcccatctccttcaatgacagctccaaaatatcaccagttttttatttttcttattcaaccctaagttttattggagaaccttattcctgcttcatggagaaaactggctaggcgtggtggctcatgcctgtaatcccagcactttgagaggccgaggtaggtggatcacctgaggttggaagttcaagactagcctgaccaacatggagaaaccccatctttactaaaaatacaaaaaaaaaaaaaaaatagccaagtgcgcgcgtggtggcacatgcctgtaatcccagctactcgggaggctgaggcaggagaatcacttgaacccaggaggcggaagttctggtgagccaagatcgcgccattgcactccagcctgggcaataagagcgaaactccatctcaaaagaaaaaaaaaaagaaaagaaaagaaaagaaaaagaaaattgatgatattttgtgtgtgtgtgtgtgtgtgtgtgtgtgtgtgtgtgtgtgtgttttagttctccagcccccttagaaagattctttcttccacaccaattctcatttccttttcttcaggtttagagatgacttctctcattcaagaccagttccttctctcctatctttcaggagatttctctataattcattctctctctccacactcaccccaccccactacatgatcttcaacctctccctctctcttctctacttgtcttcattctgtcagcttagaatcatctttcctgtgttcccacctagcaaatatcctttctttgacgccacatctctttagctcccatctttgtttatcttcgctttcttcttcttttttttttccttcgtatccaaatcatcattcattacacaactcattgaaatctgaattatctttcttttcatccaatgaatcatgcctaggtcaatgatttatttttccaccaaacttgctattcttcgagtatttaccatttctgcatgtgacaccactatctatctcagctagctgtctcagaaacgtcacatcttccacacccatcaagctctaattactttcttcctcaacagctctcaatttcctgtcctctctatttctgctaccactgcctatattctgagctttgttgtttcttactatgccactacatcagtctcccaactgatatctctctctctctccctccagccttttttttttttttttttgagatggagtcttgctctgtcgcccagggtggagtgcagtggtgcgatcttggctcactgcaacttctgcctccaggtgattctcctgcctcagcctcccaagtagctgggactacagccaccacgcccggctaatttttgtatttttagtagagacagggtttcgccacattggtcaggctggtctcaaactcctgacctcaggtgatccgcccgcctcagcctcccaacctccagctctcttctagttgtttatcctcctgtatcactagtgtacaccctcactcatattcactgtgtaaaatgcaaagctgacctgattaaaatctgtgttaccttcctatttcctgtggggtaatagtccaatcttctgtataaggctgtccacgatccatctcctgccatttttcctgctttttgttccaaccatcatttaccttgctgttcaccctccacaacacccacagttgctagtggttccctgtatttgatacgctgtttctcatgtttgcggtttgtgggagccttcccctttgccaatattggcatttgcctattttcttagttaactcgtggtcatctgttgaaaatcagctcgatatcatctctccaggaagccctccccgcatttctgcactcactttctccatccgttaccaaggttgaagcaccttcctttctgttggtataaagtaccatgcatatggccactatggccattgcactcatggtactgagttacctgtttttgtattttttttcctcaatgtgcctccatactcagtacatcatttttttctatagtactgggcaaggttcttgacacacatgagctgcttaattaagtttaatgtatttatgacaaatttagagcaggtttgaagaaattcaggcttttccccattaagtaatggtgcaccccattaagtaatggtgcactttgggagaaatgggctgaaaaagttttaacgatagcttttgcagcctatttgccccaattgtgtaaatactaatttaaaaccaaatgacttctagaaagtctgtagtcagtcttcaccattgggagataatgaggcaacatggattttgctgcctctctcttaaataacatgaatctactgtggagacttttaagcctatgatgatattttatatcaaaactgagataaataaaaaatgttcactgacaataatgactatagataaatgctgtcagttgtaaggaagtgtcaatcacagacagacgtcagtggatctgtgagggccacactgaatttttgcatgtgtaaactgtataaaataagattttaaagaatgtcataatcatattcagaaagtggaatgagtgtgcatctgaatggctgcccaatctataacgaatattctatctacagggcaataagcagaaaaggtgatgcagagcagccagccagatactatcatcctcatttctttaacatgtatttctagatccttttttgctcagaacattgttatggcattcctcagaacgcttttagtctctctctttctcttttatacttaaaattctaaaccagattctggtgtagagttctgagattatcactgtgccacagtgccattcaacattcctgggattacatttttctttacaaaaggtagcactttggtattcccctaggaccctcagattctccttttttcttttcattgctgcttaccagaaacaggtgctcctcaacctgtatttgtgcagtattttttgcaataggcaattatatgtacttttagtgataatagttgtttgtacattaacaatagtttcacttttaaaattggtgtattttccccttccgcatatgtgtatgtacacaaaggaatacaaacaaggacagacctgattgttcctttgttataagtaaagaccatctaattataataaagcacaattaataattgtgtgtaatgagcaaattagagcaataatacaagaaaatgagaggcaattccttgaaatgtttctgtcttatcttttaattgaaaaaaaaaaaaaagccttccatttccctcaggtagagtgaaactgacaactgagctgccctgcttctgccaaatatgaagatatctaagactctgcttctctgtttactgggcaaagtcctggagggagagtggggaggggaaaggaagaagtctgttgaacttggggcttagtttcactctggattatgtggcaaattgattttgataacaggcacctccccattcatacctatgttattcttaggattatgcagtaaaatagtttaatagtaaaaggatagaactttggtgttagaaagacctaatttctggtcctgactttgccactttactaatttgtggttttaagaagctacttaagtattccaagatgtagttataggtcacatggtttttgtgacacttaattggatagtgcttacttcaaggcctagcatgtagccagggctccatcaatattctctatgagagaaagaggaggaggaaaagactaaaaagtccgaaggatgatatgatgtagttgaaagaggatgcacttagacacttaaatcctgtattcgtttcttactgtctgtattgtgttgggtaaagcaacttgaactttcaaactcaccattttccaaatctattaaaaaatggataatcatgcttaatatagaacagttctgagaattaggtaagaaaatgtctatgtaagtgcctagtgccacatcttgccattagtaagaaccaagaaatgctatttgtggtgggatgccattgatgttgggtagagcttagctatgatttatgatactcccaagagactttttttttaatcgtgtgaagccatgtgttctattctgctcaacgttctcatcagactcatgattcctaattcttaaagcaaaaaatggggtctgagagtgtttcgtggcatgacagttgtggtcagaacccctcccatattcccttattctcaccaagtcaatgcaacttcgatcaggcatgcatttttctgcctgggggcttgctctttgctaatggatctgctttgtatcctgtgctatagaccagaagtgcagagaaattaatgtcctctttcctcagtgttcatcaaacaatggctggtgttgttttctactggctcctagaccttcctcagtgagctaaaattccattttccctagatagtagctggctcttgccccgtctgtaggtcacatccccgcatcacgttcctaataatctacctgcacttcactcttggtctgaaggtttgcttctgaggaaacccaaactaaggcatggggctactctagtaagccagcccagtgatgtttatggtgaattatcataagtagatctcgataccaggatttgtattatattgtacagaactggttataatagaactagctctagctggtctgaggcttaatatgtagattgaaataaacatgcctgagacctacagattatttttcttttttttttttattatactttaagttctagggtacatgtgcacaacgtgcagatttgatacataggtatacatgtgccatgttggtttgctgcacccatcaactcatcatttacattaggtatttctcttaatgctatccctcccccagccccccacccatgacaggccccagtgtgtgatgttccccggcctgtgtccaagtgaactcaatgttccattctcacctatgagtgagaacatgcagtgtttggttttctgtccttgtgacagtttgctgagaatgatggtttccagcttcatccatgttcctgcaaaggacatgaactcatccttttttatggctgcatagtattccatggtgtatatgtgccacattttcttaatccagtctatcattgatggacatttgggttggttccaagtctttgctattgtgagtagtaccaccataaacatacatgtgcatatgtctttatagtagcatgatttataatcctttgggtatatacccagttatgggattgctgggtccaatcataattctagttctagatccttgaggaattgccacactgtcttccacaatggttgaactaatttacactcccaccaacagtgtaaaagcattcctatttctccacatcctctccagcatcttttgtttcctgactttttaatgattgccattctaactggtgtgagatgctatctcattgtggttttgatttgcatttctctgatgactggtgatgatgagcatttttacatgtgtctattaattggctgcatagatgtcttcttttgagaagtgtctgttcatatctttgcccactttttggtggggttgtttgatttttcttgtgaatttgtttgagttctttgtagattctggatattaaccctttgtcagatgggtaggttgcaaaaattttctcccattctgtaggttgcttgttcactctgatagtagtttcttttgccatgcagaaactgtttggtttaattagatcccatttgcctattttggcttttgttgccattgctttttgtgttttagtcatgaagtccttgcccatgcctatgtactgaatggtattgcctagattttcttctagggtttttatggttttggatctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatggttgtagatgtgtagtgttatttctgaggcctctgttctgtttcattggtctgtatatctgttttggtaacagtaccatgctgttttggttactatagccttgtactatagtttgaagtcaggtagcatgatgcttccagctttgttctttttgcttaggattgacttggcaatgcgggctcttttttggttccatatgaactttaaagtagtttttttccaattctgtgaagaaagggtcattggtagcttaatggggatggcattgaatctataaattactttgggcagtatggccattttcacgatattgattcttcctatccatgagcatggaatgtacttccatttgtttgtatcctcttttatttcattgagcagtggtttgtagttctccttgaagaggtacttcacatcccttgtaagttggattcctaggtactttattctctttgtagcaattgtgaatgggagttcactcatgatttggctctcagtttgtctgttaatggtgtataggaatgcttgtgatttttgcacattgattttgtatcctgagactttgctgaagttgcttatcagcttaaggagattttgggctgagacgatggggttttctaaatatgcaatcatgtcatctgcaaatggagacaatttgacttcctcattgtgtaattgaatacagtttatttctttctcctgcctgattgccctggccagaacttccaacactatgttgaatgggagtggtgagagagggcatccctgtcttgtgccagttttcaaagggaatgcttccagtttttgcccattcagtatgatattggctgtgggtttgtcataaatagctcttattattttgagataagttccatcaatacctagtttattgagagtttttagcatgaaaggctgttgaattttgtggaaggccttttctgcatctattgagataatcatgtggtttttattgttggtgctgtttatgtgatggattacgtttattgatttgtgtatcttgaaccagtcttgcatcccagggatgaagctgacttgatcatggtggataagctttttgatgtgctgctggattcagttcgaaagtattttattgaggatttttgcattgatgttcatcagggatattggtctgaaattctgtttttttgttgtgtctctgccaggctttggtatcacgattatgttggcctcataaaatgagttagggagggttccctctttttctattgattggaatagttttagaaggaatgctagcagctcctctttgtacctctggtagaatttggcagtgaatccatctggtcctggactttttttggttggtaggttattaattattgcctcaatttcagagcctgttattggtctattcagagattcaccttcttcctggtttagtcttgggagggtatatgtgtccaggaatttatccatttcttctagattttctagttcatttgcatagaggtgtttatagtattctctgatggtagtttgtatttctgtgggatcaatggtgatatccccttttttttattgcatctatttgattcttctctcttttcttctttattagtcttgctagtgatctatcaattttgttgatcttttcaaaaaaccagcccctggattcattaattttttgaagggttttttgtgtctctttctctttcagttcttccctgatcttacttatctcttgccttctgctaacttttgaatttgtttgctcttgtttctgtcgttcttttaattgtaatgttagggtgtcgattatagatccttcctgctttctcttgtgggcatttagtgtaaatttccctgtacacactgttttaaatgtgtcccagagattctggtatgttgtgtctttgttatcattggtttcaaagaacatctttatttctgccttcattttgttatttacccagtagtcattcaggagcaagttgttcagtttccatgtagttgagtggttttgagtgagtttcttaatcctgagttctaatttgattgcactgtggtctcagagacagtttgttgtgatttctgttcttttacatttgctgaggagtgctttactcccaattatgtggtcaattttggaataagcgcgatgtggtgctgagaagaatgtatattctgttgatgtggggtggagagttctgtagatgtctattagttctgcttgttgcagagctgagttcaagtcctggatatccttgttaatcttctgtcttattgatttgtctaatattggcagtggggttttaaagtctcccattattattgtgtgggagtctaagtctctttgtaggtctcgaaggacttgccttatgaatctgggtgctcctgcattgggtgcatatatatttaggatagttagctcttcttgttgaattgatccctttaccattatataatggccttctttttctcttttgatctttgttggtttaaagtctgttttatcagagactaggattgcaacccctgctttttttttttttttttgctttccatttgcttggtagatcttcctccattcctctattttgagcctatatgcatctttgcacatgagatgggtctcctgaatacagcacactgatggatcttgactctttatccaatttgccagtctgtgtcttttaattgggggcatttagcccatttacatttaagggtaatattgttatgtgtgaatttgattctgtcattatgatattcactggttattttgcccattaattgatgcagtttcttcataccatcaatggtctttacaatttggcatgtttttgcagtggctggtaccagttgtctctttccatgtttagtgcttccttcaggagctcttgtaagacaggtctggtggtgacaaaatctctcagtgtttggttgtctgtaaaggattttatttctccttcacttatgaagcttagtttggctggatatgaaattctgggttgaaaattcttttattttagaatgttgaatattggcctccactctcttctggcttgtaatgtttctgctgagagatctgctgttactctcatgggcttccctttgtgggtaactcggcttttctctctggctacccttaacacttttcccttcatttcaaccttggtgaatctgacaattatgtgtctggggttgctcttcttgaggagtatctttgtgatgttgtctatatttcctgaatttgaatgttggcctgccttgctaggttggggaagttctggataatatcctgaagagtgttttccaacatggttccattctccccatcactttcagggaaaccaatcagacgtagatttggtcttttcacatactcccatatttctttgaggctttgttcatttctttttactcttttttccctaaccttgtcttcttgctttatttcattaatttgatcttcaatcactgataccctttcttccacttgattgaatcagctattgaaacttgtgtatgcatcatgaagttctcgtgccatgattttcagctccatcaggtcatttaaggtcttctctcactgtttgttctagttagccattcatgtaatattttttcaaggttcttagcttccttgcgatgggttctaacatcctcctttagcttggagacgtttgttattaccgaccttctgaagcctacttctgtcaactcgtcaaagtcattctccatccagctttgttccgttgttggtgaggagctgtgatcctttggaggagaagaggcactctgatttttagaattttcagctttcctgctctggtttctccccacctttgtgctttcatcccacctttggtctttgatgttggtgacctacagatggggttttggtgtagatgacctttctgttgatgttgatgctattcttttctgtttgttagttttccttctaacagtctggtccctcagctgcaggtctattggagtttgctggaggtccactcaagaccatgtttgcctgggtatcaccagcagaggctgcagaacagcaaatattgcagaacagcaaatattgcagaacagcaaatactgcaggaaagcaaatattgctgcctgattcttcctctggaagcttcgttccagaggggcagctgcctatatgaggtgtctgtcatcccctactgggaggtgtctcccagttaggctacacgggggtcagggaccaacttgaggaggcagtctgtccattctcagagcccaaacactgtgctgagagaaccactgctctcttcagagctgtcagacagggacgtttaagtctgcacaagttgtctgctgccttttcttcagctgtgccctgcccatagctgatgtggagtgtagaggtggagtctagaggcagtaggccttcttgagctgtggtgggctctgcccagtttgagcttccaggccactttgtttacctactcaagcctcagcaatggcagatgcccctcccccagccaggctgccaccttgcagttcaatctcagactgttgcgctagcagtgagcaaggctctgtgggtgtgtgacccatcgagccaggcacaggagagaatctccttgtctgccagttgctaagaccttgggaaaagtgcagtatttgggcgggagtgtcccgttttttccaggtagtctgtcatggcttcccttggctaggaaagggaaatcccctgaccccttgcacttcctgggtgaggcgatgccccaccctacttcagcttgccctccatgggctacacccactgtctaaccagtcccagtaagatgaaccaggtacctcagttggaaatgcagaaatcacccatcttctgcatcgatcacactgggagctgcagactggagctgttactatttggccatcttggaatacccactccagatttcttttcttaaaataatacctttctaaatacctgttggagtgcttgagttggtaggggctatgggaatgtcatctgactgattttgtcagaggactttgtggatttgagacagggtgggtaggagaggatcatcacattgattccagaactaaacttagggcttgaggtcactttaggtggggtagaagtggggatatctggcatactatgagatttagagggccactgtagcctcataggtactcagactttatagtgttggtttaattagggattttcttaagctggctgccctgattcaaggtgatggttatctgagcaccaggtaaggcctgggaagggtagaggcaatatggctagatgtccatttcctataatctctaaatttgtatgaattgatgcattcatgatctgagatcataaatgaagtccataaagtccataaacctcctgatattttatgtaaaacttaatgcatatgtacacttttctagagaggaagtcttgagcttttggattttaacaggtgtcctcaacatattgaaaactgcttcagcttgatgtccaatttcagtgctaacaattgttgcagaagtgtttttgagcactaatcatatcaattgcaataatggtgctccttggggtctcaggtgagctgagacttggagccttgggatccagaactcacccttaaataagcatagcatctctcttggtgggggtctgtggaggtacagggaggttggagagagttggcattacccaatttagtgaggttaagataaacactgcagagtaatccatggctgacctcagtgatgagttatccattttgcaatctggccttttattacattgctgttgactttgttgttgttgttattgttacatgtttgtttttctttggatatcaatgcttttatgggaattatttctcatttcgttaatcctagcctagtttccttcaaaagggtcttgagtgcaggtagcctcttcagggtagagtaaaacaacaaaaaagtcaaagccggaatcaagggtgtgttttctatcatacagaatattatgatggaccactgaggctcagtgccactagggactctcttgggaggtgcatagaatgaatattaaaactctctgcctgaaagatggaataaggcagaatgtatttactgttcccatttccccttggccaaggattacttcatggggcattaactgtcttacatttccaggtttactcagatgccctgcaggttcccacaggcttcctgcatgctgatagcagaggagccctggggcacaccatgagagatacatgatacagctcaggcaaatgctatcaagttataccaaaggcacctctttgcagcagctggcatgcaaaagtgaacagagaggatatgagggcacaagaggtgtctcatacaccttctccattctagcatctctcctcactgagaccatggtaatcttaacttgtaggcatgcagtgttaataaatgaagccaaagtgctggatttgatccctatgtaggtcacttagctgcccacagtgaaaagtagcaccatggacatcaaagtgaacaaacccctgcctgagtacttatttccatggatcaaaaggatggggaaatgctgatggagagttgaactttataatcgggaaaagtccattcaaatgggctattttattcaattcccaaatagccctagactttatataacttacatggtggaattcatgcttttactaacaagtaagttaaggctcatagaggctgcgtgacttgaccagggtcccatagttaatagactgaaatgtattccttcttacttcaaacttgttcacatcatccagctctctggcaacacattactggaaaagaaaaatagttcagagaaggatgtgctcatgaggactgcatagagttgcaatcttcttgggagggtacacatgcatgacctgccaaatctgaaatattaggaacttttgcttgcaacttgttccatctacagcatgggtagaggtggcaacagagaggtgactggggagaggtttgcccaagagacagcagggagattctgggaataaacaggagttgggttctcaatttggcaactaagcattcttttgttattgcactttctcaggctgcagcagagcctgattagctttaaaattcatttccattggtttcttctttcatgatagttttagatgttgttttattggcattcctatagatgtaatttaaccttggtagtactgatgaactggttgttctcttgtaaattttagaaggaaggtggacagtctgggagaaccagaactgacaggagcaatagggtgcattgctaactggcaccctgtgctctgaggtcaaaaggaaacataggaaggtggtttctgagggcaagacctaggctcctctctcaattctcttttgatttcaaattttgtttcttaatttactttaaacacacacacaaacaactttacataaatgtgtacatatgatttcagtacattttcctaagtgtattcttttctttccatttttgtttgatgtctcccctcttctcctttttgtccatgttggtcccctaactctactccaagatagttcatattaataacctagtataaatcctggcacatttttctctatacacatataatttatacatatagaaatgtatacaagtttttcaggtcattgttttataaaatgggatattatatacttattttgcatcttgattttctttttagaagaacactattgtgcatcatagaataaatacaaaaaagtttaaaacatatttaggtactttaaataataatgaagcaaacatttgtagtatgtctatctacccactgcattaaagaaatagggaattaccagtgccttagaacctgctgtgtgccactttgcaatctctttttcctctttccctcaggaactctactttctggaatcagtcctgtgtttctctttctatattttgcttctgttgctcaacattactttataaaaattttttcatatcaaaaggcagtgctctaattcactctttttaatgggtgcataatattccagtctgatgatatgttatatatgtggtattctccttcctgtaaattataattttatttccatcttacttttttctaccatgcacaatgttgcaataaatatcattgtgtatttgcactggtgcttttatatctggtgcagtccaggaatggggttgataaatagaagaggatatgtattttaaatatgaacaaatactgtcatatggcttttcaaaacattgtaacacttcacatactcaagcaatgtatgagcacacccttttcacacatccctgatagtgatacgaattattgcttttttaaattgtgccagctgagaagtgtaaagtgatatttcattgttattttaatttgcatttctcggactgttagtgaatctgagcatttttgcatttgtttgtaggccatttagctgagcacttctgtaaatgggctattcatgacttcttgtttctacaatggagatatttgtctttttcttgtctttccatagtaatatttgtttaccttgtttagggtatattttgccatcaaatatgttactttttaatgtagttagatgtctgtttttaactttcacatcttctaatttccagtcttcgtagagaatgttttccccgtccccacctttaaaaagtgtgtttagtttttaagattctttttaaatctttgttttcattttttatatttaaatcttaatccatttagaaatttatttttgtgtttatagatgctagaggtccatgtttactttgttcctgatgataatgataataacaatagctaacacttactgctgctatgtggtaagcattgttatataggcactttccacatattgcatcgctgacttggccttgtccctcacaactctgagacataggttttcttaccatatccattttacacttgaggaaaatgaggcacaaaaaaattgagtaattagcccaaaggtcacagaggaggtcaagtggtgaatgtgggatttgaactctgggaatctggcactgaaatccactcttattatagttcctcttatttgttaggccaggactatttatgaaaaaagccactcttttcccactgaattacattacttttcttgtcatttattaaattctcacatataccagagtttatttctcgattgtctgtctgctccctgatcttttcatctattcctagcattttttgttgagttgatgatcatggtcgtataatgtctgatatctatgaagtccagtcttctgtcattgctctttttttttcatttatttttttttgagacggagtctctctctgtcgcccagcctggatgcagtggcgagatctcagctcactgcaagctccccgtcctgggttcatgccattctcctgcctcagcctcccaagcagctgggattacaggcgcccgctaccacattttttttgtatttttagtagagatgggtttttaccattttagccaggatggtctctatctcctgacctcgtgatccaccctcctcggcctcccaatttccaggcattcatacttttatgtataatttatgtttattttattcaattaaagtagccgatgggatcctaattgaagttgtattaaatcaatatgttaattttgggacaattgccatgttcatactaattactccataaatttaaaatatagtatgtttcctcttcattcagaaattaatttatatcttttatatatttatattttctttgtgttgtcttttaaatttttgggggagatgtatttataaatattttaaagcttttgctgatataaatagaaatatttttctcatttctattccttagtgattgttactagagttgagaaaaggtactgattttgtatattttatatataaatcagtaggaagagcactgtcaatctaatatttttaattaattaaacaagaaaaatacattcatgtcattaagggctgaaacagcttttgataaacttcagcaggcattattaatacagttcaggtaaaattgaaataaaagatgattgcttagatatataaagattatttactaaaaacagcaacagatttaacaaacatggagatcattttagttaaaattagaatgcatttagggatgtcccttgttatctatattaaacattgcatttgctatagcctccaaggccataaaacagaaaagtaaaatagttggtgtaaatatcagaagaggtaaaactatctctttttgctgatactataattccttatcaagaaatttaaacaactctagttaaaaacttacagaatgaataagatactttgataagctatctggatataagtatataatatcaatcacttctttattctatcaataattaaccatttttagttctcaaggttcaaatttcagagaaggtggctttgagctataggttggatcatttcccatgacttggacagggagataaaagcttcttaggacggccccactagactctaccaagtggaacaaaggtgattgctcaaatttgagctgaaaggggaaatggatgatagacagaagttttttaaaaaataaactccacatactgtatgtaactgcacttcagaagtcaggtgcctagcttttaagaggataaatctaaattctttgcctgcttcttctagaatccttcccaaacccttttccgttgccccctccctttttacctgttctacactgcatcccaactggttgttacattgtcccctgcacacgttttgcacattcctctgttgtttgcccatccattcccctcactagacgtattctattcctttttctttcatgtaattctgattcgccctgtagggctctctgcacgttcccatcaaatgcttgttccattacccaagaccaggtcccttctcccaaaccacaggggctctaggagcccactctaccaaagacctgaagaacctccagctgtcacagtctcttcactcctaggactgaaggacctgttctcttctccgcatctgttcctgcatccctgtgacatctgccccaacgaaatcagaagaggagaagggaccaggactctcacttcccagactatacattgttcagcttcctctttccccctttctgacatggaaatagcgagcgaagatttgagggccagttttttcatgttgttgttttgggatgttttttggtgtgctgtcatagattttattttttcatttagagaagccaggtccaacctaaacagtttcatactcttaccaagaggatgctttgtccttcactgtttcaagtttgtacaggattcaggaccatgttttgcacctagtaaatgagtcttcgtttatccaaactattttgagttctcacctttatgcctttgctgttgctatgtcatttctcctgaaggcccttctccttctctttgttcacttgattactcttagtttttacatttcagctcaggtgtcaactgctccaagaagcctttctcgagctcatgctccccttcaccaaactgccacaacaacctgtgtgaatcttgatcaccaagcttacagtgctgtttgagataattatctgctcaagtttctggtgttcccattagactgtcagtgcctcatcgatgtgctcagcctctagctgtgaatggtgcacaggtgaccccagtggatattttttgaataaaaaaataaatgtatggatgaactgagcaatgttttgttaccatggatgttggtcatatcatttcatgatttgctatctaattttgccatttctcctctaattccattaccctcccagctcttgtttctctacgtgagcatgttgtgtgaatgctgagtgaacttttagtttactatgcattcatagtgcattcattccagtattcatttcttccttgggtcctggcctactccttccttttctctcatctattcattctaatctcatttgaacatcaagctcctcccactgtcgatactttatcatcattactatcccttttagtaacttagtaaaaaagcacctctaggatctttcaacttactaaagacttttcctagaggaggagacaaatctgattctgcaaactttttttttttttttttttttgagacaggatctcactttgtcacccaggttggagtgcagtagtgcgatcacagcacactgcagcctcaacctccccaggctcaagtgatcctcccacctcagcctcctgagtagctggaacgacagtcatgtgccaccacgcctggctaaattttgtaatttttgtagcgacagggattcagcatatttcccaggctggaattcctggacttaagtgatccacgtgcttctgcctcccacagtgctgggatgatatgctgcaagccactatgcctggctggctctgcaaacttttacttctatgaccctttctttctcttggtttctccttgacacttctccccaatgaacccatggtgcaatatgggagttggtgccctaaaagtgactacctcctaaaatcactcacactcaattattagtaaagttcaaatgacaacttttttatgataattgtgttttaaaagaaaatctgagggatagtaaaaacaaaaaaaaaattcatgccagaatttcaggcaagcaccagttgagaatgtatttttgtgtgagcagggtgttatcagtaaggttcaacatgttctacataagggactggaagctctgcccgggatgtatgagggcaatcttgcctggcctaaaggttggactgtaggtagcacaggacttccgggtttggagatttagaggataagtctaggcttcacccaaataccaacaataagaacttgagtagttcctgggacctccctgagcctaagtataaaatgaggacagcaacacatatctatactgccatgctgttataagaaataaatgagataagaaatataaagccttaggagtcaatacagtgcaatggtggagcatgagtattgcagagtccgattggttgggttcaaactctggacctgacactaattaagggttaatgaccttgtgtaagcttttaatctctgtgtgcctcaatctctctatccatatgataagggatacaagacctttctcatacagtggtttaaagatgagagtaaataatatatgtgagaacacaaatagaagagcatgcatatgaatagcatttaatgctcagttaatgaggctcttatcaaagtgacagagggcctccatgtaatcagagaagggtccacttaaggctctattggcatttgctgaaggatcaagacttgctgtattcctatctatgaatagacctatggaattaaaacccagtacaagcattttttttttctacttatatctatgtatgctctttctctcttgccttcttgataattcagaagcagaactttgtcttattactgacttccagaagaaatttcacaactctcataaagtttgtgatttttgtagactatactgaacatttagtgactcccagggaggatcattttaatcagcatacaatagtttgctcttcctcttcccttccattttcttctttccctttctccccccttctctagttttttaatctcacctcctctccctgcccttttctatcctcctcccctctcatttcccttcctttatttcttctctcatttctactctttccccctttctccttccttctttcctgccctcctcccctccctcctcacctcctcccctttctccttttcccatccctccttccctccttccacttctctctcctctttcatctccctttctatcctccctcttctctcccttccccactctacttccccccattcctccctggagttctccctttttacttttcttcaagtgggcttatcaaagtattttttttaaataaaataaaggcaagtctttctgtaagaaaaaaagtcagaaaaacattttcttctcattataggaccaaaagtgcccttagagatcaagtagcccagtgatccccagactttgcttgttggtcgcgataccctgggcagcatttgaaagccaggccctgcctccagtggtggttctgaatcaaaagatcagtgtagaggcttggagtggcatttgtgtggggtgtgccagaatatatttattttaattcaagaagatttggatttcagtcctaagtctgtcacttgctaatggaaccatcttggctgtgtgctattaaaacttccagagcctcagtaacatttgtaagaatgtggaaaataatatcttcctcaaataacaagcagtgatcagcagattggctggcacatagtaggtgttaaaaattgtttcttttcttccttccttttgagtatggtacagaatcctggttatctctctcaacacacaggatggtgataaaggaaagcctgagtatttctgtgccttgtagcacatcttagaaagggagaagggctattcagcagcattgttcatgctcaggcccaggcccagctgcctctaactgtggtcatgagaagtctcagacactggcatgaagtcagcaaataaaaataaacaacatagccaagtatgatggtgcacgcctgtagccccagctactcaggaggctgaagcaggaggattgctggagcccaggagtttgaggctgcagtgacctgtgatcacaccagtgcactccagtatgggcaacagggaaaaatctctgtctccaataaataaataaataaataagtagtaattagaaataaataaacaacatttttgaggagaagggatgaagttgattaatgggtacaaatacaccgtttgatggaataagacctagtgttagatcagtaaggtgactatagcctataataatctattgtacccttcaaaatagctagaagagaataatttgaatgtttctagcattaagaaaatattaagataaacatttaagtgatggatatcctaagtatactgatttgacctttataaattatatcaatgtattaaattatcacatatatcttgaaactatgtacatctattatacatcaataaaaaataatttaaaaccccatttattgtgaattcactttcccaggactattttaattaatcatcataacaaccttatgaagtaaatgctatgattatctttaaccacattgacttggtaaaatgtctgtaggcagagcttttttatttttttgaattttggctactatttgcatgtctgtatcatttacgccgtcctttgtctgtgtttcttagatcccaaataagtactgaggggtcctatattcatttcaaccatactgtattgagtacctaatataaaaaatccagcctctagtttgaggagctgaaagaatgaaccctatgcagtcctgattgtctgggcttattttcacttgctctgtgaagcacctgagcccttgttggtgaaccctgctacagtccccactgagtttaagacccactcttttcaagggtccccatgttaggtttgcctccacaccttagcttccaaagctttgttcccccctgccaatggggcactctagccccatccacccatcccctctcagagttgtagaaaaggcttctatcagcaagaatccagagaggttattcatacatgggacacttgatagtggttcttattctttgaggaggaggaatacttctgatttaatggtaacgaagttctaattttggtaagtccggggatctgaggctagagctgctttgtcacaagtcttgtttgcatatgctgtgtatttctacccataccctcatccaacttatctaaatcttgctcctttttttccattcttgctgatttaattttatccctcaactcatggttccaaataatcccctgtgttagttgtgcctacagcaacttgtttaactctctctaccaggcaataaggtggaggggcaggggaaggataaatgcagcctacttgtgatttatcacagttggaaagaaaagggaaaagacatgcataacactttttaaaaaagaaccagagaggcagagagagaagagtgtgtggagggagatgaagggtgcactctgatgggaacagatggcccaaaaggtaagtgggtggcagagagtaaaaataaccagggagtgaccaagccttcattttctttgaaacactcacactttagggatatattgaaactgctaattttgttggcactttgacacctcctcctaattaatgagaaatttattaggaggatgactgaggtgagcaagctgcttacaaagagagaagggagagaatacattgaacctattcagcttggcggtcacgaccaagcgaggtgccattggatatgtggttacttgtgggtgagctcaagtagaagcctcgggctgggctcctctcctggggtggaacccttctgctgggctcctttcctcctggctccctgtactcactgctgctctctggtttaccagcatagaggcacaaccccaaaacaggcttcgtggggaccaaattggcttttggatctcaagtgtgtctctgagtcactccagtgaacacgttataggtcactctgtgcaggttagtggcccgaaaatctgcccttcaaaggaaaagaaaagtgaaattctcatgacttttacactttttgtcaaatcttctgcatagagaccttctgagttggctctacctagtctgtgattccaaatctcaagcaccacctgcaattgtccatatttttcacccacaggatgctcatgttaccaggaacttaaaagagtaaacgtggttgctgacattttagcgttcgtgggccagttttctgagatcaacactaggcaaggtactggggagtgtcttctaacacttttcagactttgaacagctaactccattttctgggagagcagggttacttgacaggtatctaaatcctctgtcctagccatccaccaagccacccatttgcccttccaaatcccttatgcagttcattatctgtgcaacatagaacagtcgagagcatgggctctggaggcccattgggagcttattcactcctctgctctgccattcatcagcttgagttgtcttaggcaagtcacataccatcctctgtgtctctatttctccctctgtaaaatgagatcactaatggcattcactaacggatggttgtgagagttaatgaggtaacagttataaagaggttagtactgtgcttggtataaactaagcacaaaataaatagcactatgacatttaacactataacatttaactttcaaaatgatttcatatgcaattttgtggcagtgtcttcatacattgggtagtacagagttttaaagattatcctttaataaatggaaaaattgagtcatgtaatggattagagactttcccaaggtttacaactacagaggaatagaattggctctagagctaagtcttctcattctagtttaattgtttgtttatttgtttctatgcaaacatgttcatactcttccttagcatgtttcatcctatctctactagtgcaacaagatgctgagaagagggaagaatgccacaaaactgcatacaccaaagatgtgtggctcaaaggatacaacttttgacttgaacagtcaccaggccttgtgatcttgaacaaatcattctgcctgtctaaacattaattaattcctcaacttttaaatggaatatgatgactatttccctttatatgtgtatcttagatgtaggcatggagctaaaatagaaactcaaaatgaagtaacagtaagggctggcagtggaatattattgatcccagaggaaaataaaaattttatttccaacgttgtgccaagatggtggcaagggtggggaaaccatgtgtcctagaagaagaaaacagaagaggttaagttacctctttattcttttgtttttcagattcaaaggttgtctttttaacaaaatgaataatgcaggtggtgattatggaaagatgttaaattttgatgatgttgaaatgtgagattggtatcctgtgtgtgaggagctcttgtctcctttttcaaaggcaaggttcctatgtgtgcactttcacagaccagccctgcccctgttgcctggaatctcccttctagcacaggctgctgctgaagaggtggttcagaccattttccaaggcaaatccaaagaaaataatggtttccattggttctccttattcttcagccttcccagcttcccccacccctactccagtcttcatgacatcactaattcatacatctattatgcaactcatgccaagaggctggttaaattggaaattgctctttgttaaataatactggtatagatggcatttccattttaatccaaagctcttgagattccaaaatccttcaaaactcaactaaatttcaaaaggtgtaaatcaagcactgcattttactgactctaaaggaaacgtttatgtgagagtagacctccctggagcttcttaaactagccaatgttaatcttggtgctgagacatattgatggtatgtcatatgtaataggttaccaaataataatgcatatactaaaattatgctaaagatttactaaaaatttaaattaaggcagatcaggcttatggctaaaataacatcatttccatgcacctgcattctgacatgctctctggagattctttgctatgggagtgtgccttgtgtataaatagcatttatgatgttggttgcactagaaaaaggaaagttatcaactttaagctccactgaattaacaaatacctgatctccatttttgtagaccatcaagaaatagcattgtgatcattgggcttctccctagcagttgatggtaaaaaaaaaatacatctaggagacctctcctctcctctcttctcctctcctctcccctcttctcctctcctctcccctccccctcccccttcccctcctcctcccctgcctgtcccctccttctcccctccccctcccctcccctccctcccttcccttctcccttcccttctctcttctcttccctctctcctcccctccccttccctctcctcccctctccgctccctcttctcttttctgagaccgggacttgctctgccacccaggctgcagtgcatgatcatggctgaatgtagccttaacttcccaggctcaagaaatcttcccacctcagcttcctgagtagctaggaccacaggtgaaaatgatcacacctggctatatttttttctatttttttttttttgtagagatgcagtctccccatgttgctcaggctggtctcgaactcctggctcaagcaatcttcctgccttggcctctcaaagtactgggatcacaggttcaagccactgtgcctggctgagatctctatctttaatattcctcttccctcctgcttaattgaatgaggaaggggcagtgtcatacaatggaaggagcatagtaactctaacattaataggttgtgtggccttgaacaattcactcaactgctctgaactttagtgtgtcatccataaaatggagctaacagtgactagtttgttttgagaatgagaaccaagatgcgtaaagttcctgacacaaagccaggtgcctagtggcctttagttcttatgacagctgcaggactacctttgtcactgtgcttttacgtctcctccagtgcctggtaagaagagtttatgtatatttcacctgtgtgagtacaaggcccaacttctaactgttaataagagacaactttgcctccctcacagctggtacttaaagcgtcaaagaatatctacactccagatacttgttaagataattcagtcagaatcgactgcaatctagcacctgccagaggcttgctgaaggcatctgttacttatttattgagcacatgattatataactcttgtttactgtacacccagcactgttctaggagtcttaagaatattaacttatttaattctcacaacaaacctgtgatataggtactatcatccccattttacagttgagagaactgaggcacagagagggtaagtaacttccccaagatgacagagctagtaagtggtagagcagcatttgaacctagatggtttggctccagagtttgggaccttcacaactatactatgtaagaaagactggctaatcgttatgttcaccagccattcttccagattcatccagttctttctctgagcttagtgaaattatcagaaaacaagagacccaaacatgtgacttcagcactcccttcccccttccaacagcttcatgaccatccttcagttcctgagtcacctttctagatggatattctgtgtcttcgacaaactcctggtaggaattgtcttccatgttatccaacagttctaacatgaaaacccatgtattaaagtatctaaacaaagtgtgtttctgcataggacctttccagctttatttgctatgaaatgaaaatgatgaagtctgttagttccctttctatgaatattttcattgctattactctggctaacttctgtgctcaggtgtagtctccagttctgcctagatagttgctgatatttactttctctacttcctttagggggcatcttttctgtttttatccctgatggttctgttttcttattgattaatctcatataatgcctctgaatctgttggatgcagggaaagtataaaccataatccaataagcagcttatgatgattttcttaccatgtaaaatgtttcaaggtgtgtggactaaagtagaaggagatgaaaaaaataatgataaattatatcatctattatggatagctaccatttgctcattgcttactttgtactggcactgtgctaagtgcattacctacattattgtttcttaatcctcatggacatggctaataaatgacagggctctaattcaaaaccaggtctttctgacatcaatgcctgtccttgtaaactacactgtatatgaatttggctcagacacatatctcacattttgccctagtgaaacaaagtgtattttctccttttgaccttgggtgaagagagttgaatacaagtctttccatttgtaacacactgtcatcagtagcacaaggcctccctggttttatttatttttcccttcatccctaattatatcttcaatggcctttccctagagatacccattacaatagcttttatatatatctttaaaaatgcatatacccttgtaagatatgtaacatgcttttcttgttatttatttaaaatttattttactggcagcatgctgtatatcttaatgcatttttttaccttttccattcaacactgtttataagatctttcatgttgctatgttttcatttagttggttttctgtaactgctgcatagcatttctctgtatgcatccaccacatctttgcatctgttcctctagtgctaaaactctgcttcaattccacaattaccaatagtgtggtgtgtggccctgagcaaaaattgcttggggatatattcccaaaagtggtgttcctgagttatagggcaaataatgcttaatcacaccaaatactttcagattgctttccagaagggctgtaccagttcagattaccaccagccatgcacaagaaaaatttctaaactgtctctattcttgacaatacttggcattatcacctttgtactcattgccatttgacacgtataaaattgtatttcataagtaaagttcttctgcaagtttggaaaaagttgatttggacttgaacatgccactaaggctgcttaaaatgtcttagatgggatgctgattgagtgaatgcagaggcagaggaggagcaggctctcatttgagccctccttgcaattggtttatgtgtctcttatgacaactaacattgttttgcaatatgcagtgattatttgtgtacttgtctgcagcgagcaccttttggattgtaaattgcatctttcttccttacctgtgtatgccctcaatgctttgcttgttgcaagactccagtaagtgttttctgaaataaattgtctgatctctcgaaggtcctgcctgacaataaggggccattggctatgaaagggtggtaggatctaggagtggaaagtcacagatgattattttctattctaatagggtgatcggtttatttttttcttttcttgactgttttcctccctactttaaccagaggtgcttgcattaggatagatgaactatatgaaactgctctggtaaaaccaaacttttgaacatactggatttttccccctaaattgacaactaaaaatcatgccatgctattgactcattgtcctcttcagtaatcttctggttgggattgggaagggaaatttccagaactacaaacacttctcttagggactcaggtcccaaccttgctgggcagagtgcatgatgtgtttcataatgcatgagtgtttatttaacaaacagcaacactttttaattaaactgttgttgaagatacagactgtataacctttctccaaggcctggatgctcactggcccttccaagatgctgacccctcgctagctgcaggcctctggggcagtacatgctgtgagagttattacaagccagctggattagagggccacctctcttgaatcattcagaagctgaagtgcaggctctgggatggagagtttctcaatatgccaaagctattggaatgcaggcaggtctggagacacttagctggaacctgggggaaaagagtgttcaagataacttcatagaggaaattccctaccgcttttggctttaaaggataatcattggttcttgctggtcttgtactactatttcctgagctactctgaaatagaattgcttttaggtttcaggtcttcatttatagagctatatccctaaaagattagatacgtctcagggatgtttttcaggatgctttttcgcatcatggtgattgtattagtcaggttagacttgattatgctgcagtaatacattacttcccaaattttagtgacttagaacagcatagctttacttcttattcatattacatgtttaacactgggtaacagtggggctatgcttatcttggacgttcagggacctatacgctcagaagcttggctgctttttgatgtgaccatctcgacatgagtctttagggttttctacagcagagaaagaacaagaaataaattgtctcttaaatgttcttaccattttcattggccaaagcaggtcacatgatcatgcttacctataactttgtagagaactgtaatttttctgtcttctcagagagaaaagaggactggaaatgacagagaatatgaataacatataccacagtttcattgggcatgagaaaatggtgatactttgatagatctcagaaaattacatacactcagcaccatatacatgcccttgaagagaagagaccatagactcttaaaaatgtaagtatctcagaggagattttggccagtgaatccaaattatacagcttggaagtctacaggtttatgccataggggacacagaggggaaaatgaggaactaagatgggaatcttgcccacacatctccttcaaacagggcagtataggaaagcatatacttccaaaatgatatgattttcagtcctactctacctcgaacactcttcctggaacatactccaatttgtcatcggctcctcttaaattcagcactcagtcatgaaaatgttctttcatacctggtctcatcagtgtagaggccagaagacctgttggttttccttgctttggatttgttattttggcaattaacgtttctgacaatcatactatacctttgactcattataagcctcatgtgggtttctctactccaaggaggcataggagtttaaaataggaaaacagtagtacgttgtgatggattgtatttttcaaagaaagtcacaataatatttcccatcccatgcactcttctgcaatgtatccttgacattctgtcatcaagattaagaggtagactctctctctaccctcttgaatgtggataggccctatgatggcttcgatcaataaaatatggtggtttaacgctgaggcaggtggggcacgatgtctcacgcctgtaatcccagcactttgggaggccgaggtgggtggatcatgaggtcaggagattgagaacatcctggccaacatgatgaaacccagtctttactaaaaatacaaaaattagtcaggtgtggtggcacacccctgtagtcccggctactcaggaggctgaggcagaggaatcgcttgaacccagaaggcggaggtttcagtgacccaagatcgcgccactgcactccagcctggtgacagagtgagacttatatctcaaaaaaaaaaaaaaaaaaaaaaaaagtgctgaggcagtgaggcagctctggaaatagcccttaactggcttggcagcttctgttttctgactcttagaagccagttgccatgtaagtaatgtgactaccaaaaaatgaccacactgtgagaagcccaagtgtggtggagaggccttggggaaagagataacccatgaggcaagaaagaggcccaggaggtcccaggcatgggaatgaagaaaccagcttgcacatcctgcccaggctacaatggactgtaaccacatgagaggttccaagattaaaccactcaattgaccccagccaactcatagcaccatgagaaataacattgttttaagccactatattttggaatagttttcttaaaaatataaagtgatagataaccataatagaaatttgtgctagaggaaaatccttaagactcttgaaagccattttgtctaacaaagagtgtaaataagatatggccttaacgatcctaagtaatttttctagttaagaaataactgtaatcagttgagtgtttttccactttatgtgacttcagttgaggctgcaatcatttggtgtctggatgagatgggacatccaaggtacctcattcacataaatagctggcagttgatgagataactcagccagagagaacctatgcatgatctctccatgtgaccaaggcttctcacaggatggcaactgggttccaagaagggctatctgaagaaaaactattcttagaaaaccaggcagaaaaaataaaatttcttatgacctagcttcaggagtcattcattgtcacttttgctatattttgttgatcaaaagcaaggcaaagggctctccaatattcatcgattaggggactacacaaagggaaatattaggagtcatggtttattggggggctatctttggagacaagctaccttgatggatagagaaatgataacggaaataggtttgatgaaaaacgtggttaatctgaattgcagtaggtctgatggttggttggcaagttgtccttattctggtgtatgggtgaagggaataagcagtgagttagctcttacctagatccatcccctagaaagtaactgtgtccagttatcaatgggcagggcttgctgggcgttaagcacaggtaacctctagtcttttactatgtttctgcgacagtggcataaaacagctttttaatgagacctactgagatgcactgacagatctcttcctttccttttgtgtctagcccatccaccttcatgtaaatgatttatcaagaaataagacctaggattttgagatgggtacataagagcaaaagagaactaggatgagatcattctcttttgcctgcccttcagcattctcaatgcaagcaggttggggttctaaaggaagagcagggatgactggaaccctatagcagtgagtctgaggaatgggatcatgggggacccagaaggaggaagcagaactggaagatgtttccattctgtgaaagtggcttttggctttgaggcagcaacagtaatatttcatgtcttccgtggtgtctcctacctttaaatgtcagtctctgcagctgccttatctcctgtagcacatttcaattaggtattccaaattatactcttttcttccaggacaaatatgccagaggtgatatttactgttacagcagcatttaaaatacttagggggaaaaaatcctagtgaatagcaatttctcccttataataataataaagcacaataataatggagagaggaggtgaattctggctttgatgccaataactggctgacttaaagtgaacatcttttgtctccgccctcttttgtccccctcctcctattcccgcctcagtgtgaaggttatagtgtttggctctgtcaagagcaacctcacacatcttcttcactggaggctcacaaatgctcctcagaatgtctatttaactatctctaggtaggactgggctctgactgggctcctacttcacccattacctgtttcttcctttgtcctgagaatgtttgcatgaagccagaatctctgtttgtttagaaatttaccaggcaccactgcttactcctcacctatgggacattgtaggtcctgatggaacaccccggcctcctctctaggaggtatatgggttagaaacttatgtattgtacctttccttcttggaatcaagtccttggcctggtaatgaaggtccttcgatctggtctgcattttccagctccatctcctactaatctttatatccttatctactgtttccctaggctgttgtcttcacggccgccatggtaggttttgcctatcatcccaaaccttgtgcaggcctaccacagtacttgacatatggtgggggtctcagtcagtattctcccctatatttagaacccttccactagatcttgtcttcatatttttgattcctgctcagggatcagattatgttccatgtcctccactgagccttttctgacctcctcagcgcactcagtgccgttccctctctgaatttctaaagtgctcagcagcagcagcactcatttggcacttggtatatactatcttatgctattttgtatgaccatatgttgtctatacaactacattataagcacctgatagggataactgtgccctgtgtgtttttcctatccctttgattctaagatagttccttgaacattgaagatgctcagttaatattcatttattaagtagatagatcaaggagtaaatgaaagcaaggatcctaagaagcctgccttttggtgccaatctattcaatttggaattcacaaacttacctaaaacaaggcctttcaatttcctgtttcccctgtaaacagagctctaccaccaggatttctcagaagctctttctccacactgaaccctaaaactgaaggttcaggtagagagcttttccagtgtgagagaatttttaaagcatctggggtttggcacatccagtgctttgaaaatcaaggtgtcttgatcattgggtgaaggggattagaacagcaggctgtgttttcaagttcaagtccataagcagacaggaatagaatcccacaagagtttgttctgtctctgccatttactagttaatctctctatgcctcaatttccccatttgtaaaatggatttaataatggctgtctaccttataaggttgctatgaggtgccagtgtgataataaacgtaaaagtactttgaatattgcaaaacactgtatgaatgtcaggaattaggcaggcaacaactatttcttgggggtttgttctgcatgtagccctgcactatgtgtagatagaggcctctgtacattacagaagactggcagaggcattggggattcatcatggctggaattctggttctcagatagatgaaagctggaaaaagtattatagcctagcaatcacatctgaaaggttggcagcaacaattgagtcagagaagacgggaggtgaagtattggcaaaaatttgaccctggtcattctttgaacacttcagatttccacagattctatccctttaacatttctgaacgttatgattttgcttcctccccacactggcagctctgcctcaatgaaaccgtgttgcttttttggttgatcaattgtgcccaacttcctgatcatacttgtcctgagagcctgtgttaagctcatgccggctctcccaccccgcccccaacgccggccaaaaaaaagactctctaaaaacaggtgcccccgatgatctcacactgctgctggcattggcagcagcccagaagggccaaatggtgacttcaggtccagggaggctactgtcctcagctctgttttcatgtaaatgtcgctcctgctgaaaggaagtggatgcaaaaaaatatctgctatggaagcagaactaccccagactaaaatgttggtttttttttttttctctcccccttttcttttccttcaagttttccatgtggcatcagcagctgagtaagggaaagctaagaggtttaagtgtgctggggctgggtgggctagattaataacccaaagccttccaagctggcggtgctgggtgagacaggccaaccagaaagcgttaggttatggggagccctggccacagagccagaccctaccagggtggaaggtgaaggagcagcgagctctgcgtgcttgccccgagcccccaccttccttccttcctcctccctctggtttctttcctcccattttatcgagtccctctgagatggctgcgcaccagtggctccagcctctgaccgttgctgccctctgctgggaagaaagctttactcggtgtggaaagtgctaagctctaccagggaccagcttaatgcagaccaagtccacagtctgtggctagtgtgtgatttggcccagaggaaggaaggacaattcagaaaacccttgcaccacagtgtttccctagtggtttcaggtgggggcaggactttggaatctattagggaaggattgcttgaatcctcagagttctctgttcaagaggaacatccctgggagaggagcctcctggctcctctttacctgggtcagacatgatgtatggagactccaccatggatgacccttaaatatgatggatggctttagttacaggacacaattctttctcaagggaaggtgaccaaaagaagttgggtcttgaaggggctgcaggatgggcctggaagtctcttggctctaaaggaaccatcatagaatggggattctgagcaaccaggaagcagcagaaaaatatgcaaagccagatgggagtggggaatattgcccattaatgggcaagagtacatagaaaggtagataataaactggcttcaccacttctcaactttccccagagctggctgtgccagtaaactgtgctcagctggctttggatgagagaaggacaagagggtgcctatctccagcatggctgtggggtcgccctgctccatctctggatcttcagcctagagtgcagcccagccaaacaagagcgatgacctcactgaccacatgtaattctgcttgagggatttattttcttccatgagctcctgccaagactcttggttaaagctaatggggctcccccagccagtgagtgtctcctagttatatgtgtaaacaacgccaggcaggaaataggtttcctgttcttaatgggcttgttaaacctcttatcgagtggggtttaaatggctttattatgaataataataatagtaaataaacattattattattagtagtagaaaaattatgatgtcagccctgactaccccttctcattttaatcttgccaacgtggaggtctttggcctctaagtgcacaggaatatggtgagtgacactgggacttataactggagaagatggcagaattcatcttcgttgcctgcagctttccaatcctgagcccttttccactttcatcgtgtttccatctccatcattcctttcattcagggttttcatgatcttattctatcagagaagatagaactacacatccctctccttctcagttttatttagcattgaaagccatggacagaggttctgaggttaaattgaggtatcgggtagaggggattttggagagagcagtggatgctggtaggggagctcagttggaagtggggctcatgttctgatcttcagtgccgaatgtctgtgtccctccctcagatttacatgttgaaacgtaatcaccaatgtgatggtattaggaggggggccttttgggaggttagtaagtcatgagtgctttgggattagtgctcttataaaataggcccaagggagcttgttcaccccttccaccatggaaagacagaagaagaactagaagccaccatctatgaaccaggaggtagccctcacctgatgccaaatcttccagcaccttaatcttggacttccaagcccccagaattgtcagatacaaatttttgttgtttataagctacccagtttatggcattttgttgtagccacctgaacagattgagatatccagtttatagctggaactggaggtataccaggtatcccagactttggtaatttatgtatcaggttcactattttcaccataactccctacaacagtattgattttctttacaccgattatcttgtttgacttaagtagatttggcatcatcttacaagcaatatgtctttgaaatcctgggttcaatgtgttagccaggttttttactgactgcatattgaaatgaatatctaagagctaaatattttttcctaaagttcatcatgtggcaaatgtgtcacaccctccagggaaaacataccacaacatctggagacactgctatagggtagtggttcttaaactttagtgggcatgagaaacactggcagagcttctaccagaaacactggtagatagctgtgctcttccccagagaatctgattcagcaggtctgtggtgggaaatatgactttgcaggttttttttttttttttttttttttgagacagggtctcattctgtcacccaggctggagtgcagtggcgcggtcttggctcactgccagctctgcctcccaggttcacaccattcttctgcctcagcctcctgagtagctgggactacaggcgccagccaccacgcctggctaattttttgtatttttagtagagatggggtttcaccgtgttagccaggatggtctcgatctcctgatctcaggtgatcttcccgcctcggcctcccaaagtgctgggattgcaggcatgagccactgtgcccggccttttctttattttttgagacagagtctcattctgtcacccaggctggagtgcagcagcgtggtctcggctcactgcaagctccgcctcccgggttcacgccattctcctgcctcagccttctgagtagctgggactacaggtgcccactaccacgcccagctaattttttgtatttttagtagagacggggtttcaccatgttagcaagggtggtctcaatctcctgacctcgtgatccacccatctcggcctcccaaagtgctgggattacaggggtgagccaccgcgtccggccgccttttatttttttttgagatggagtctccctctgtcacccaggctggagtgcagtggcacaatctcagctcactgcaacctccaccttctgggttcaagcaattctgcttcagccttcaagtagctgagactacaggcacccgcccccacacccagctaatttttgtatttttagtagagatggggtttgaccatgctggccaggctggtctcaaactcctgatctcaagtgatctacccgcctcggcctcccaaagtgtccagaactcctagactcaagcgatcctcctgcctcagcctcctgagtagctgcgactacgggcttgcacccggaaactgcagttctaacagttgctcaagagatgttgatatccaggggccacactggcagtggcactggcctggagaataagggcctgttctccatttccacatgtgaaaatttcctcatttgaaaatggggataatgtgtgctgtataaaatgaaataattttttcttggtgccaatctgtctatgcaatggaatgtttgtgtctccccaaaattcacatgtggaagccctaactgccaatgtgatattaggagatagagcctttgggaggtaattagatcataagggtgaggtccttagaatgaaatccatgcccttagaaaaaggaccccagagagttccctcaccctctttctgccatgtcaggatacaatgagaagtaagaagtctgcagtacagaagagggctatcaccagaagctgaccatgctggcaccataatcttagacttccagaatgcagtactgtgagaaataaatttctattgtttataagccacccagtctatggtacttagttatagaagcccagatggagtaagccaacctgtttggagtgtttttgagctgtcatgcttttcaggttcagcttaaagctcagatgggaaatacaggaacttctgcaggttaattctggttctaagttcaagtcctaagaataagcccattatgcaattctgggtggccaagcagttctccagcagcccccaggaagtattctatctcacagaatcctggcaaaaggagacagtcttctcagtctggtcaagggctatgttgagtgtgagggaacagaggtgaatgtcccttgctgtgctcaccatgttctgagagacaggcagacaaagcgtaatttacaatttgattaagtgattgcattggtgactttttaaagccgcccagtagttgagccccctttctgcatttggaagtttacccgtatgagtctaaaagggagacagggccctcattccatgactgaggcccccaaagtctagtctcactttcctcagtctcagtgagccacagaagccaggctcagtgtctgggaggagaaatcctctctgatggtggcaggggtggggacagcagccccgctgggccctgtggggacagtcccagcagcagacagtcccagttgggcttatcctgtgatgttggcctcactgtcttggcagcctctggcatttctgttctctgttcatcttccacatatggttctcaggttcactcatcaaatcccttcccatttcacccaatcaataatgctgaactaataatggtttttagagcagggaagtggcacaatcacaacttattttaaagataactgaccactctctggagcatggattggaggatgagtgactcaaggtggggtgactagtgaggaggtgatgaaggagatgagaggaaagaggaagaaacactcacagagtaaacctggccatatctaatgactggaagcctgagtttctcttcaaactcagaagagaaaaatgaatttatggttttgggcgcagctttagttttgtctttggggatgagtatgtattttgttgggaaggtggatgccctgaagcagggttgggaaacaagattagaggtttttgaataagactgtgtttgaatacagcttggctatggtcttctccatttcaagtctgttcaacttaacaaatattgagcccttactaggtgtcagacattcttgggtatttagaatacagtatattttgattttggtgttgaaaaaggtgtggaggtatgcagggaaaaatctcacatgcttttacctacacacacacacattcacgcaacacaaagtgcacgcacatattggtcttgaaattccccaaggaccaaaatggacccatgtgatgagtctgtgttataacagggaatctaccgtaggttcttggctaccttttgtgaaccttctgtcttctttcctctcacttacaagtaatcccctgagtttttacctcctgaaccctgtgatttcaagggttcacaactaaatgcttcttatgctgagcaaatgtatacactgctaaaaccatatactcactccttgtggtgtgtttgttaggaagctgccacttctgtcttctccattctttggaaaaggctgtgagtaaacacagagcactggctatttacatacctagctcctgcttgctttttcaaagctctttgttcaagtgtcagtgctggtttgtaaaacatgaacagagttggggtaaaaaaagtaattacagttcaaatctggtgtttctactgacatgatactgagctgcctgactgctcttctttcttatcccttctctagttctgtcttttcagttgcaagttcactctgtctctgtctcccctctctctcccttgctctcactctcattctcttgcttgctcttctgtgtgtcagaaagctacacacatgaaaggtagctggcctcatagccactgggtagcccatccttgagagcctggccaccttcagtgtgtcgagatgccagggccctctatggctttttgcacagggaagttctagtgttttcagtttccagagcccacaatgagctgtcctccaaatccagatctaaaaccaaaccttctcttggatcagaccaatccagaagcactctatagtttcaggggtgtccaatcttttgacttccctgggccacagtggaagaagaagaattgtcttaggccacacatataatacactaacactgagatatagagtaagctcagttgttgacatagcaagtttgaaattacagcagaacttccagaaaacatcacaccagagttttctatccttccaactatattttacattttttgctttcagaggctatgcttcttcttctttgttcttctcttaattcagcccatgagcacatggtagattatgaatggatgctttaggaaccatgtagatggaggtttgtgaaaatttccacggaacatggcagttgagaattggtgactgatatggtctagctctgtgtccctacccaaatctcaccttgaattgtaataatccccatgtatcaagggtgagactaggtggagacaattaaaaaatgggattggtttctgccattctgttctcgtgatagtgagtgagttctcacaagatccgatggtataagggggtataagaggctaccccttttgcttggcactcattctctatcctactgccccgtgaagagatgccttctgccatgattgtaagtttcctgaggtctcaccagccatgcagaactgtgagccagttgaaccacttttctttataaattacccagtctcagttacttcctcatagcagcatgagaacagactcatgctggtaccacagagagtagagttctgctataaagatacccaaaaatgtgaaagtgactttggaactaggtaacaggcagaggttggaacatgttggagagctcagaagaaagaagacaggaagatgtgggaaagtttggaacttcctagagtcttgttgaatggctttgaccagaatgctaatagtgatataaacaatgaagtcctcagatggggatgaggaacttggtgggaactggaataaaagtaattcttgctatactttagcaaacagactaaatttgcatttcacccctgccctagacatctatggaactttgaacttgagagagatgatttaaggtatctggtggaagaaatttctaagcagcaaatcattcaagaggtgacttgggtgttcttaaaagcattcagttatatgtattcacaaagatatggtttggaattggaacttatatttaaaaggtaagcagagcataaaagtttgggaaatttgcagcctgacgatgcgatagaaaagaaaaacccattttctgaggaaaagttcaagtcagctgaagaaatttgcataagtaatgaggagccaaatgttaatcaccaagacagtggggaaaacgtatccaagatattcagagatcttcatggcagtccctcccattacaggactagaggccaaggaggaaaaaatggtttcatggattgggcccagggccttgctgctttgtgcagtctcagaacttggtgctctgcatcccagctgtggctaaaaggggccaatgtagagctcaggccattgcttcagagggtacaagccccaagccttggcagcttacatgtggtgttgggcctgtgggtgcacagaagtcaagaatttaggtttggtaacctccacctagattttagcagatgtatgggaatgcctggatatccaggcagaagtttgctgcaggggcgaagcccctatggcgaacctctgctagggcagtgcagaagggaaatgtggggtctgagctcccacacagagtccccactggggcactgcctagtgaagctgtgagtagaggactagcatcctccagacttcagaatggtagattctctaataggttacaccatacacttggaaaagctgcagggactcaatgccagccaatgaaagcagccgaaagaggggctgtatcctgcaaagccacaggggtggagctgcccaaggctatgtgagcccacctcttgcatcagcatgccctggatgttagacacagagtcaaaggagataattttggagctttaagatttaactgccccgctggattttggacttgcatgggacctgtagccccttcgttttggccagtttctcccatgtggaataggtgtattcacccaatgcctgtaaccccattgtatctaagaagtaactaacatgctttttattttacaggctcataggtggaagggatttgccttgtgtcagatgaaactttggacttcaaattttgagttaatgctggaatgagttaagactttggaggactgtgggaagggcatgactgttttttgaaatgtgaggattaagcataaaataatggcaaaccgcacaagaattattacaattcaaggtgagatttgggaggagccagggacagaatgatatggtttgcctctggggccccacccaaatctcaccttgaattataataattcccacatgtcaagggtgggaccaggtggagacaattgaatcatgagggtggtttctgccatgctgttttcatgatagtgagtgagttctcatgatatctgatggttttataaggggcttccctgtttgcttggcactcattctgtcccctgccgccctgtgaggaggtgacttttgccatgattgtaagtttcctgaggccttctcagccatgtggaactgtgagtcaattaaacctcttttctttgtacatttataaattacctagtctcaggtatttcctcatagtagcgcaagcacagactaatacaatggccaagaagtgatcataggatggtaatataataaacacatggaggggaaagtgagtgtagttgcaggttttcaggagaaaatctgaaaggggtgaccaaaaatgagtacctgaatgatgcagctttttgaaaaagtctatttgtaggtcattaacaaattgagattcaggaaatcattgtatggtttaaataggataaaatttttcactagaatgcttgatctctggggattcccagaagcccattcatgaaagtggttcattcatgcaacaaatattttaacaaatgccaagtatgttgtagaattattttaggtgctaggaaaacagcagtggataaaacaaaaattccttagagtttatattctaatggcgagtcataagtaatctacaaaataaataaatatacagtattctagatgatggtaagtgttttaaaggaaaaatgaaacaacaaatagtgatagtacaagcgggggtggtggtgataatttcaagtttaggtagggtaaagaagaagacatggatagacaggaagcccagatatagcatagtattccagggaccaaagcaagatgttcaggaaactagaggcctcaaattctcctactgcaatctgactttgtaccccaattaacagtgacagcatactgctttaaaataggaaataaagtggaaggaaagcaaatgcttgatagttgacctgacattcactgttgcaagattgggaacgtacaataaatgtcactgatggagaaatattcatgaagtaaaaatgtcagttttcaatttggcatgaggatggtttgacatgtattagtcatgcacagaatattatcataattaatgcattaataatacagctgtcctttttctcccaatcataagttaaaagggaggaaatagaggcaagtgaaagagcagctctcatcctgatcagaccttttctcttggcatttgtctcttcctctgcccagccatttctgtggcattggcttctgatcagtatcagtcttgatttatccatctcagttcttccttcacctttcatgaacaacaccagtggttttgtctgctgagggctttttccttaattttcagccatactttaaaaaatattttaaaagagagagatatatatagtaaaaatgagacataagcaaaatcaagaatataaaaatctcccataagctcactacccagagaaaactactattactattttggtgtttgtactgatctcggatagctggcgctgggatgactcaggggatttgattcttctccactgtttctcattctccagcaggctggccctagcctattctcatgtcattggcagaggcacgggcaagcttattctcacacctgctttttaagtctctatttgtgtcacattcactaacatcacaaagcaaatcatgtgattaagcccagtgtcaaggggcggaacattctgtcctacccatagttggaaggtactgcagggttatgtggcaaagggaagggtgaaaacttggggcaaaatttgcgacttcctatactgggtcaaaagacacccttgtttcaaggcttatgatagatgtttccaaattgctttctagaagggctgaaccaaccccactaatggtataagacttcctggctttccagttctctttagtcttgctgattctgggaatgatttatgaccttctgtctgggctgttttgatttgtatctccacctgtcttttaaggctgcacagtttttctttgtggtaattctttacttgcagaatacccccaaagctccctaagactctggtctacttaccttcttcatcctgatttcttctgcctgctttatctaacacttgtgctgaccaactcccagctatctgaatattcagtaatccatgtaggcctactccccaagtgttctaagttggtaggagttactacacatcttttaactttgctgcctacaccagcagtaatgtaattgttggtcctcattattcccagaatattggaatttttagggtcagaaaagagctcagaatccaatctcatttttatacaatattattccaaagatgtatgggtatttgtgtagatgaagataagggtatagatagaaatttgcatagaaaaaaggttgaaaggcattgccattgttaatatgctagtatacatctgtatatgggaattataggtgaattttttttttgcgatggagttttgctcttgttgcccaggttggagtgcaatggcacgatccctgctcactacaaccgccacctcccaggttcaagcgatcctcctgcctcagcctcccaaatagctgggattacaggcttgtagtaccacgcccagctaattttgtatttttagtagagatggggtttctccatgttggtcaggctggtctcgaactcctgacctcaggtgatccacccgcctcggcctcccataggtgaattttaaaaaatctttaatgttgcgtacagaaactgagggtcacagaagttaaataactcacctcatatcctaaagattaataatagtgaaactgactaatgcccagttctgctgattcctggtttaatgctctcttgagataataccacagtatgatctctgaggcctagctgtcttttgtttgattgtttgtatccaagctgtattggcagtttcttttggttttataagagtgctctgctgattgtgggttcacagggaaataaagaatgttttttaaatgattgagtcatctaagtcagctatgtaaatgtatatatatatatacacacatatatgtaatatctgtatgcataaattaccatgacttcaaaatttgacaaatggttcaggtaaatagtggattttatcttttaaatcacattaaggctcccaagtggatgcatcctgagttctggacacataatttatcataggcatcacatggattttatgtaattatattaattatttagtacatacaaaggtaagctctgcagaattagaatagaatcggataagtttttagggagatctaaattggtaagattgatcaaatttcttgctatgagtaattgaaggtgggtcactgtgatggagtgttcttcactggagctaagcttcactagagctattcggagtaattggggactggttaggagaccaatgcatcaacatctgtctataggaagtatggattcatctgctttgaaatgagtctttagtttgtttcctgcttgttctttatttctttttcacctgaatgctctttcaagaatattcaaaaacacaaaaacaaaaacttttcccctggagagtggggattagctcaagaatcaccatgatgatgagaagcagaaaacctggtttggagagtcctggacctggagaacaccaaaaagatgttagcatcttgagtatattgttctgatctaaagtcagatgttaaattttttactcacttagggctgtctgtgagactttgcggatcacagagagaatagacactgagaaatgaacgtgaactagtgggtacaaaggaaagggcacccgaggctgcttcatcaagctagaggagtgggaatctcagcccctgagaatgagcatctacaggctcttttttcctagtgcttctgtggtgtttgtttttcattgtgccacttggtttgcagaaaagaaaaaagaaaaaaaaaaaggctgccctggaagctgaggttttacaagtgctgagagaactgtcaacctattatagaattcagacagagactttcagctagagagggtttaggtattctgtgcctggctggactctagggactcacgcttgatcatactaggattcaagaacaacgcagttgtcactgttagcccatgatcccacacgtacccagacacattctctcacggcaagtacatctgcacctggatgccttctactagtatgacatacttaaaagtatcttggatatgccttaaagatcattgttggctgcttcttgatggcaaagtgctcagttagagccagtttaaacacatgtcaccagaactgaataaatagattttgataaaactgattcagtgaatatctcccttagggcgaagctcagccttctccacttcactggtgctatgaaaatcactagtcctcatttccaagctgtgtctgaattcagatttaactgctaaccattgtttaagaccgcagtgagatccacagggtagtctcaaggtgtgattaagacacttgggagtggtggtggttaaaaaaaaaaaaaaaatagagccaaagtgtaaggaggcaagctggaggcacgtggttatatgaggagaaaaattgcagtgaggccttctcatcaccctcttcagggtcaatgtgatggcttcgtagaatcaagtgcaagtctgtggctccattatctcaactggctagaagagagtgctactaaggcagaggtgggagcatgaaagttcacctaatagcttagttttgttaagtctcattgccacagtctgcaccttatcctgatgttctcactggaaaataactagcctagttcctgagaaggaattgtgaacagggcattgcctgtttgtcaaaaagttatttaaagtcactccagctcctcacttaacctctctatgcctgtttcctcttctcgaaaattacagtaataattattacagtaataatagaatagtacctatctcataggctttttgggaggattaaatgagttaataatctgaagatattgaaaaccacacctgtcatgtggtaagtggtcttcaaatgctaattgtttttatctttattaactgccatacccatgtttgattggcagctacatcttgtatgagtctttaatatttcatctgtaatttctgggttgctcctgccacagagaaggagcaagggagccattggtactactgatgaatattaggaggtggagacaccttgacaactgctgaaatgtactcatgcctgcctgcttgccctaactgcacttagtggcctggatttaggagctgccaatctcattacacaccagttttcatgactatcctcaacttactcctttcttaccactgctcagcacttatcctaagttgacaccaggctcattggtaatcatggactcacttctcccatctgaagtattcttgagttggctcccaagaagcattctctcttcatctccaactcaagggtgagctccttttcgtggaggaactaccctgtgtgtcctttccctccctctctccatcaccatcagcattcaattcagtattctgcacacacaggagtttagtctcaatttaaggtaggtcaggtttcattcacccttgagctccccttagcacccactacagactcattggagaggtgactattagaggtgcttgtggaaatgaatctcaaatagtgtccttctgcctgagtccttcattgaatccctcacttgtatacatgattcatactctggtagctttgatcattgtacaaaagaaaagtagtaactcttctttggggccaggccaggactgtggagcccaaagggcttttgtcatccctcctggaatggagttacctgatctggatattggaatgtttacatccttagtccttgaaaaggggaaaagttatgcttatcctcaattgtttaccatgacccttcctgtcacatcatactgttctacgaacacaagaatcatggctaacatttgtaaaccatctactatatgccaggtactctataatggaaggtattttacataaactttttatttaagtctgtgaattaggtataattcaatgcatttttaaagttaaagaaactgaggcttagagagctacttgaccaaaatcacaaggctactaattagtacaagccatttgatctaatactaacactaacttgttgtaactagcttgtcttgctcttaacttcttatctcagtccatttgtgctgctggaacaaaataccacagactgaataatttataaataatggaaacttatttctcacagtcctggagtctgggaagtccaagatccaggtgctggcacgtttcatgtctgctgagggctgctctctgcttccgggacgacagcttgttgctacttcctcctaaggggaggcatactgtgtcctcacatagctgaccttttatagaggttgctaatgccactcacgagggttctgccctcatggtttaactacttccccaaagccccacctcttaatacttatcacattggtgattaagtttcaacacatggattttaggcgacaatcagaccatagcatttcttctctacaggtttataaaaatacttttttgtcttgtatatattttcattatttttcctgcttgagtatacattttcatctctgaagacagggacacatttatggacattccttcctctgctctctaagactgcagtgattttatgtgcacatacatacattgaaaatgtatagttggctagatcctggaccccatataatagcttactggttactatacagcaggaggaactgaagagaaagaaagaatcaacagcaaaggtgcccatacctgttgcaatttgtattttgctcatgtcctagttcagcccatccaagggccaaccctgatagggcttaaatgttctcagcattagcttctcttcattaatatctgtttgtacctttctttgatgccgtatctatcctccataaggtacttattaattttcgcatcatcctgcttcatgttgttctgtccattatctgtaaggctcaaatatagaaagaaagtgcatccatatcagtgagagacagttcagagtgattgtgggtgagctcatggtttcctgcagctgcaggactagagagagctacttcatgatgttggagatctggagtttaggaagcctaggaggtattcaagcagcagtcagtcagcttgccttgcatttttaaaagcatgtctgcaattttatggtgtgttctcctctcccaccactgctgttttcctccattactgcttaggttgctaccctgagagagaagcagccatgctgattctttatcttttaccaaaagggcagcagcagcatctctttctaaattgttattatgaagagaatagctactgtggtttgaatatccccttcaaaactcatgtaaaatgtaattgccattgtgatggtattaagagatgggacccttaagaggtgattaggccacaagagctccattttcataaataaattaatatcattatttcaagagtgggttgttataaaaacaaacttgcccccgtctgtgtttcagtctcaccctcacttgcccttctgcctctgtcatgagatgacatagcatgaaggcccttgtaaaatgtcagcaccttgatattgaacttcccagcatctggaactatgagaaatcaatttgttttcgttgtaaattatccagcctatggtattccactatacaataacaaaatggactaagacaataacccatccacacgatacaatgcatgatgtagaaagtaaatacattgaaataaatacaatgcaaagaaggtctttgttatccaagacgctctgtcctgttctgcagagttaacaaccatcatatctctcatatgatacttcttactagaaaattcccaggcgtacacaggtgtgtgtgtttcacccctttttgcctttataaatggaattggctggaatgctgctgagatcccagctgctgaccctcctgtcaggtgccctgtggttctcattagggcctctgggatactaacattcacacaggcaatgtactttcccttcctgacgcctctggggcccacccgggaccgtcaaacagaccctgcaaagcttaggagatcaattccaacagaagtccagagccatggtgctcttggaaaaatcacaaaccaaaatatagaagtaagactttttcttcctaaattttaggaagaataagaaaatttagtggacttatttgtccactaaaatattaaatgtgaggagaggggaaggcaaaactatggatgattattttcttttttttatatttctgtaactttaaataaggatctatatttataatgaaaacatttatttataatgaaaaaaacctcaatctatcaaaaaaaaaacaaaccccaaaaagtattgccagttcccattgaagtggaatcttaggctctcaacttattaaatgtactaataaagtttttattggtaagcagatacaaaatcgctttataagaatccccagggaattactaagcattgttttgtaatagtaaaattggatcctaatgagcatagtggtagaagtcactgtctgcagaaattagaaatgaaatagagttgattctgggtatgtctgcattgaattagtagagtgtcttggaaagcttgctggactatgatgtgcacggtgggtaacaggatctcccagggtgttcaaagcagcatgattccatccccagcttgccctgcttgttgaaaatcactctctaggacagtattttctgtgctgtgggttttagcctctgtgggcctggaatattactgctggtgactgtggacccttccaaacataacatactgtctgccacaaataacacagttactatttattgagtgtttcttatgtgccagccaccgttctaagaactttcatgcatttacttatccagttcagtaatccggtaaagctaatagcatgttgattaccttatgattgaggaaactgaaacacaaagggctgaagaagattgtctagagtctctcttctattaggaggtggggtcatggttaaaaagagccacctcctaatcactaaaccatgtcacctctcagattagtggatgacatctcctgtatgtggaccatctgtctgtatgtgtgcctgcgattgttttccagatatttgtagagattgttgagattgaacaagcagaaattcatataagagccatactgagtttacatcagcttttggtcatcagtattttctgtcagtggatctaaaatgcgactcttttcttgtgatgatcctccaagtatttggctgttctaaaaaggctatggtcccaaaggctgaacgtcattgttctagaggaaggattttcctgtgatgatcctccaagtatttggctgttctaaaaaggctatggtcccaaaggctgaacatcattgtcctacaggaaggatttggtcatcaaacacacaccatccctagttctttcccaaacagctctcctccagctctgtcatgtctccaccaggatcaaatggcatggtctctcattctttgtgatgtagacagacactggtgagataaattgataagcactgctttgggagtcatctgttgaaatacaaaaataactttgtaacataacctccttctccttagaaacaattattggaggaatttatgaattttacatcttgtgtgagaggctgacagaacctccaatcagaaaggccgtgttctagcgtcaaatcatccatcatttgtgtaactttcagcaagtcactctacctctgtacctctgcattttcaatttgcaagagtggttgcagagttaaactagatgatggtattatatacttgtttttggtttgtctatttctttattttaaagaatgttcaatatctactccataacaggcatagcattagcttcaggatttccagcagtgagccaaacatacagagccctagttctcatggggttgatttcctatttgaggaaaagagacaaaaaggaaatatacaaatacatacattattaggtggtgataaatgctatggagaaaaataagaagaaataggggagataaggggggggggtgattaatttatgtagacattcaggaaaggcctcaatgttgaagtagtattcaagctcatacctgagaaaattagagcctgagccaaaaggctatcagggcagatggtcacaggcagccagtgcaaaggacctgaggtgggaatgtgcttggtgagttggaggcacaggaaggggcctgtgtggctagtacagagggaggaaggctgagagtagagatgatatctgagcttccaaggggccagagaatggaaggtttgggagtgagacggagccatggacaaattgaagcagagtgaatatgctctgatttatactgttaaaagttgatcactcctgcggagtgtggatagaaatttagggacaagggagggtggagggagactagttaggagactattgtcataatccaggtggcttggccatgaagttagtggcggaagaggtctcattctgggcatatcttgaagctatgcttgatggggttgttggtaattgggtctggggtatgagaggaagggaggggccagggtgacaccaagcatgtgattaaggcctgagcacctggactgatgagctgttgtttgctaagatgggtaaggctgagagagatgcagttttaggggaagggttggatattaggggttcagctttggacttgcatttccgtgtctaggagacactctagtagagatatgaaattggtgatggtatgagtaaggttggagtttagacaaaaatctaggctagaattatggatttgagaatcattagcatacacatgctatttagaggcttgagactggatggaagcgtagataaattgagtgtagctagtgggggccaaagcattgattctcttcccaaatgctagggagccctattacttggagcaggaattgtcagacagtgaccagattttcatgtctttttgtaaataaagtttaattggaaccattcatctgcatttctttatctattgtctgtggctgttgttgagctacaacaggagagctgagtagttgtgacaaagactcatggcctgccaaaggccaacaaaatctaccatctggctgtttagagacagggtttttgtttttgtttttgttttttttgacccttgatttagagatcaaggagataagaggcatccagcaaaggaagctgagaaggaatagccagagaggaaagaagagtgccaagagttctgcattgaaggaaagatggtgccagggtttgaacacacagcattagaatacgtgaggctgggcaagttacttccccataaggacggtagtagcacaggattggcataaaaattaaagtagatgatgcatgcaaaacacttacagctgtgcctggtatccagtaagtattcagtaaatgctcttacagcatctacttctatttgcttagtctgtagtcctcagccaaggctctgtactggagacaaatcaggatgtttgaggattagccccaccgcctgatcaggtaagcctatgatctatgctcagggacctgaggaagaaggaggaaggtgagccatgtcccccgaccctgaccgtgtacaccctgtcccccaagaggaccttgaagaagagcccttcagcatctgctttttacttcctatctttgacaaacagtctttatggaaagcttttgagcaaacggcaaatccatctttatgagattactaatgtcaacacattttgtgtatcaggattttataggctcctgcgggcctgtgcctgtgacaacattggctggcagtgctcgcctgaggaattatgcaacatgcccctgatgctggagaaggatcttgatatcccactgaggcccgggacattttctcccagaaacagtcttgaatgagaagcttgaagaggggagttagatttactggggcttctctaaagattctgtgtccaaagcttgaatagggaaagaaatactttgcatccatgtagcaggttctgcattcagcataccaggtttgctcctagttaaagagtcatggagcccatgggagtgtttgttctttgggaatgtcataaaagagaatttggcctctcccacttacatgttcttgcatttcttattggtccttctcttgcaattattgctactttccctggtcaacctctagagcagtggctttccaagtgccttctgtggacaggtagtatcagcatcatctagaaacttagagacgcaaatcctcggtgcacccccaacccatggaatcaaccgtttttaatgtgtgacctttggcagattagttacccctctgaaatctagtcttaccctatgaaatatgggaacgttaatagcacaggattattgtaaatattaaatgagatgattttaatgagtcttccaggcgattctgattatgctacagttccactcctaaagattcttctaaaagattcccatttttggacaattagaagttcctgctaagagaaattttcagattttatccctctacacattcgcaactatttttaatctgagctaatctgccaatcatctttccaaaatgaattaatactctcccattttcttaaaaattttgtaggatatcaaccattttaaactttttcttaaagactcagggcatcatcatgaatataattattgttatattagatgttgggcctttgtcatatttctatattttgtgttgtttaccagtttttttcagcttctttaaaaatagaatctttagtttgctaccttcttcttcattgtctggatatcagctatttttttaatagctatatccagtattatccccatcactttctaattttttacttttaacttgattttgcacaaggactgaaataaccaagatgattaataatgtactcaaagcaagaataaatcattaaacataatagtaaataaatgagaagaatttattgagaggaaataaatgagagggattttttttgaaagtataagcttctgtacctgagttttgcatcataaagtctggattcttgggtaccttactatttacttctgatcatgtcatagttgtcttgaataactgaatagctgatgttttgaataaatgaaaagtttttgtagcatactcaccactcaatcattctcctgaatgttccaccctcatcatgttatacctttctatcctttgcatatattgttgacatatacattttcctaggtgatacagtttgtaactgatatcatccaatcacaagtaaattactgctctgtggaataaaaggtaataactaaatgggacatgtctcctctttcactccctttttgctgttgttccacttctcctgggctcctgatgaagtctaggggagagtatacagggctgagatgtgaacaaccctaggatctaggcttggctctgccactaagtgactatgtagaactaggcaaatctcttggcctctctgggccatgagatgcaacactataaatcagtacgataatactcgcttctccttccttatagcagtagagcaagaatccaaataaatagtacaagtgagaactcaacacaatctacatctgtgaagcatcattcttaaggtatatccagggcatttggctccacgtagacctagaggttgctttctcagtcccttgtccgccccatatccagctgccttggctcacagagtttgagactgtgctgtattttctgtcatgcttcagagtgtatcaaatcaacacaaatataaaataaagccataaagagaaggctgatattcaccatagaaaatgttggagggaaagacaaaaacactcaacgacaacttcacaaacaacccttattatggctgtggaagacacaatagtatgtgtaatgtggtgtttgggctgtatttgctgcttgggaatctggtgcattctgagatggagggaatgccaagtgtttagacaacatgctgcttggcgcctgcaggttcctggaaaggactggggtctccagatctaggctgccagccaggagtctcaggcagagacatgcattctaccgtttaaggcctttctagacttcagcagtgagcagatacaggagccctcaagaagctctgcaaaagcctaccaccactgagatccaggacataatatgcattcctaagcaggctgctgcctttggctgagtctatctgggggccttctctctgcaggagaggatgctaacagctactgttcctgaaggactcataagaagacttctgtgcacttccagcctcccacatgaagcttctggaagggctaacccggttcatttcatctacttgctgcctatgccaatcctatcccctcttcaaagcccagtttaagtctgaccttccccatgaaatcaccaaagcctttagtcttcatgacccctcctgcctctggcggtctcttgcacttgttgcctgagattctcttaagctcttttcatctgctgccttgttagttaaatttactctgagtgtgttttatcttgtttcctcagctggattgtctgcatcttgggggaagggaaagttcttataaatcctggttctgctcttgggccaggacatgcctggggcagcaggtgtgtcttccccacctagactgaggaattgtgtctcaggggctgggctggattccgcaggagggaggccagggctgccaagagcaggagagccagagaaaagaatcaaatggccttaaatttgatttaagtttcaaattgcttgaacccaggaggcggaggttgtagtgagccaaatcgcaccattgcactccagcctgggcgacaagagtgaaactccgtttgaaacaaacaaacaaaaaaacaaacaaacaaacaaacaaaaacaagcctggcaactgctgccaagtgtctcatccaaagaaggaagggggatcgaaaccaaagaattgtgaagtcacaggatcaacagtcaggcaagtggctaaggactcaggctatgaagggtcctctgccacggttaggaggtttctttgttgttttgtggtgctctttgtggtgtagaaacaggtcatttctctacaaggattcatgcaggttggacagttccatcatggtctgctcccaagcatggggcctgtagaagtaatgacttttcttctggtcccagtccacaaagagatcgtgatcccattccccttacctgtacaatgcaggggtgagactcaatcctttcttgagtcccagtaaatgacttgagagattgtgagcagaccaatatcttctgtaaatgactggatattccagggaatactttcaaaaagcatcttggacataaaaacttttttttttcataagcagtggaggcttggggtcaaaagctagaccattcctaaaggaaagtttgatagtttcttctttgggagtgaaaaccctatgcatttaagaacagaaaggaaagcttgcataggtctgaaaatggaaaataggcctatttcctttaagaatagtaaatttcaggccagatgcactggctcatgcctgtaatcccaggactttcggaggctgaggtgggcagatcacttgagatcaggagttcaagaccatcctggccaacatggcaaaaccttctctctactaaaaaatacaaaaattagctgggtgtggtggcacgtggctgtaattccagctactcgggaagctgaggcacaagaagcagaggttgcagtaagccaagagcaggccactgcactccagccagggagacagaaggagactctgtctcaaaacaaacaaacaaacaaacaaaaaaccaaaaaagaatggtaaattccaattaacaacaggagatggaacaaatggtggacagtgactgtcatcagagaagtaaatgctatgtctgcaaaaaagaggtgagggcacagtgatgcgtagagacccctggctttaattatcccatgccttggtgttactggtcctctggagatctacttaacaggaagtagtgagctatgtccccacaaaagcatcccagaggccatttctgagcaggatggcctgtgggagtcgagtggtcagttgccatggttagcagagatttcctgctgagaagtcgcccctatgtgtgcacatggacagtgttgggtagagcaatgctccttcaactttagtgtgtttaccatcacctggggatcttgttgagctacacgttctgatttcataggcctggagtggaacccaagactgtgtttctaactagcttccaggtgctgtccatattgcggggctgtggaccacattttgagtagcgtggtgtagtggacactggaggaagaagtgtagacctgagctctagccccagctcagccctgtgtgtggccctgggcaagtcactgacactctaagactcacaattatgtcaatcatagtgataaagggaaatgaactagaaagactctccctggttctatgatgcgatgtttctgttacagtcccacagagaatttagacctctaccttgttcttccttagagtagactgttggccctagagatgtgcccagtggtcatgtaacatggagatatgcttgattaattcactgtacatgggttgtttgaccagcttctacccagtgcctataagagtagataccagactctatttttatgtcatttgaaagacaagggtagaagagacagcagttcagtgacagttgcgccatcgccattactctaatggttcagaaatagcttcccctcttcccctgtggaatgtttagattcatacttttaacctgtagcattttcctacccttcctgtgtaggaagcaggtgcattggaccaccctaaaacaatgcgtaggcctcagacttctgaactcatttctctgagatgagatgtccagtttgttcactacaacaatagttgccagacctattacggttatgtaataggtttctttttttaaacaggtcttgaaaatgtatgcattattctttaggtaataaatgaaatttaaaagactgaaaataaatcagctttgcaaagtgggggctgaagcttttctactaactgaaccatcttttcttttttattcttgttactttttaaggagatgatggcaagtgatttctttttaacccattttaagggcccagttcatcttgtacaattcttgtgcaaagtctctactgagactttggcctgatgcaaaagaagaggcccttagagaataatgctgggcatggagtgtgattcaagaagttattatcgtgtgttctctgacacagggtggctcttgctccccaagggtccaacagagaggggcccaggcatgcagaatattacatgcctgccctgtttccccatcagagaaatgttttccaacagccattgtggttgtagtaaggaaaaacatgtctttctgcctggatatatcaactgagggatgaacggtgagagaatataattgtctaaggatgacaacaggatcaatttccctttgacactgtaggccaccacctctttgtctccataaaatttcattagcacttgaatttatcagattggcttagctgttgtgcattctgctctgtgtgcaacgggcccattgttctactctactttaactggttttctgatggatgtgtttatgatacctcctgctgggtattgtgcgtgacaactggggactcgataactaaacaatatctgaacgcagaatccctctgtccagggaggggctgaggaagtcacaacagttaatctgtagtaggacccatgtcctcccatctgcaggggatgctctgttggcttgcaaagtggaaagatctgggaggctgaggtctgatgtcgtcgtcatcggcagagcgaccttgctcctcatttgtgcgcacaggcactgaatggagggagccttgaatcatctgattttgctcctcattagtatttctccactgtgttctctgaccacactttcctcctcggtgcatgcaaagctattagcaatgcacacacgcggcacatctgtggagccattattgctgctggatagctgtgtttgtgtaaaatattgaacaccctgtgaagatttataatggtttcccgccctgtcctctatccaccccctcttctctatttaaagacatattaacatctctagctctacctggaggaaaaactctttgaagtgagactgcacgaagataaaatgccttctctgaaagcgtccctctagaatgagcatggaggccttctgagaggccagggaaccacctgaggcacaggggcaggatgtctctgctggaaggcctcaggcccctctctccctgctttctgtccctactgggagtcagctctcccaagcacaggctaagcacccttgtgaccacagttatctggcccttgtgagagcttgctggtgactttcctgagactggagtcccgaggcttttaacaatgtggatgtgccttggccaaaagacatcctctgggttccttaatacttgtcttcactcttctgttttgtcagtggagatgccagtagctgtaatttagtcttgggtgggagagagccagaggtcgaggagggggtggggaaattgtcatcctaacccagcatagaggacctggtttaaagaggcttaacagaccactggtcttaccagcagatgcacctggggcttcgagagtgacttgggcttagcttcttcaaagggtgctgaaatctctcaccacccctgctcaaccctcttgctgcccccaccccaatggagaggggcccaggcatgcagaatattgtattccaacgatgctagattcatgtgcatgatatggaagggtctggagggaagaggctgctggtgcctatggccctgaggaccagctttctccttcccccatgtccccaggccaccccacccagagcatgccctcggcacgcaacaagcggcatgttccaggttgttccagggccagagagagtgacatgaggcaatgtctgtggcaagcgaaaaatgtgtgctgagccttgggaggcgccgattggctggcagtgaggtaatgcaatgcagtccaaatgtggaagcagcagtaccagcatcgagggcgtgcctcctcggcaagcctgagtctcctgccagccatctgaaggacaaggcgccgaggggtgctgcagacctcatgcaggtggctggctcacatggcagggtctgggtggtagagatcagatggcaggatctgagttgtcatgtctgttctctgtccctgaacacaccaaatgccactacaattctgatctctgttcttcaatggggatctcttagtggggagggcaaagaagcttgaaaatgagggtctggacctcagaaccacttacccaggtcatggtgagtgatggtcaatacaactactcttgaggattaggatggttttctcagtaaccgatggcttccctttaatgatataaaccttctcagggtctttcctaagcacagttctagattcatatttgggccagaagtccacactcaatctccccattccagtccatttcctatgactttgtgtcattggcaatgtccgctacgaaggatggaggaattcaagaggccactgtgggctatgctttcttctctttaataagactcctgttccaggagaaaactggcctctcaaaaaaagtcttctgaggaatagcagctaccaggaatcacagttggttccccatgaacatttcagatcaattacataaataataactacctattgtcttctagtgtcagtaccacaggagtaactccacatctttgagttaataaataaatttacttacttattcaataaatattctggactctttacggcagttctgacaatgttctaaatgtataggctatggtggtgagcagaacaaagtccttggtctcatgaagctaacattgtaaagggagatacagacaaaaagcaagagagctaagaagaaaatgaaagaggataatgaaatacagggtggctagtgattgaggcaactgtagttgggtggtcagggatgacctctgtaaagaggtaacattttagctgagacatcagtgaagccaatatggccatgagaagttctaggagaaaactccctgctggccccagaaattaattacaatatgaagctttagggaaggccacagggttgaatacctaagaagaaatatcccagtggttaaggacaacttctgctttgccactcagagagaagcagagcttgtcattgagctagtacagtcctgtgcactcgtgggagtaaggtcgcctcctttccccaggcacacagtaactctgctggattgctgactcctggcagtgtcttgtagcaaggtagactggggggtggcagatgcaaactctccctaaagaggtatcatcctcagttatttccattcacccaaaccctttctttcctccaaatcacactggctatatatctgaatgttttctttgacccagatcctattcttggcttctgtagacattgtcttgtttgatccctataaaaatctgcaagatggatgctataatttgcatttgactaaggaggaaactgaggctgtaagagataaggcaactctcccaagatggctcttttggggagacgtagaattgaggtccaaactcctaagaaagatggaactttggccatctccattgaggatgaataactcatcaaactattcctgggaaagggggtggcagaggagagagagatattgagacaggctacatatcataatatcatgggttaaaccaacagcaattttagaccccaaggggacaattcgcatagctgcagacgtttttccttgtcacactggggatgggtggggagcgctactgacatctagtgggtagagacctgggatgaggttctaaatgttctacgacgcacatgacagtgccacagcaaagaattatttggccccagatgtcaatagtgctgaggttgagaaaccttcgattaaagtcttacagtgctcactgctctctgcttcctctgtcttccttctatggctgccctcggggttacttacacactggatctctagatacaggactaaagtcataatggaaatttaagattccatttggatgctgatttttttcccaagctctcttcactatttattaaatggttagtgaagggaggtggaaagcttgatctccaggcaagtgagtcccttggacgtggggtggggagggtgaagctctggtgtggtactgcatcagcctagtgggaggtgcttgttaaccctctgtgctgtggcttccccatctgtaaaatggaggtgaaaatacctcctcctgccacctctcaggtttgctgtgagaagtcagtgatgtgtaagtgctttcataaaagtactatatacgtgtgttattactaattcttatatcatgaataaaatgaaatcatcattctgcccctgacaacaccaatttgctgaaccattagaattctgtacattacagtcttaaagagccatagagagaactgtaagggacctcaagaggtcatgcggtagaaaatggccagtgagacacttgggaatgattaaagtgaggtgggaagacacatggcatcttattcagttactcaactctcctttgttcacttccttgcatcatcattgcctttaggagtaatataataactgcattaataaagttgttatcctcctcccacccctgccagagctctgagggcacagtctaaacagaataattaattaatgaaaatgaagagaaaatagctcaagtgatggctataggagatcaaatagcaaagagaaagctgcaaaaacgttcgttgttatttgacactgagtagtgcaaagagggctgggagagtcccaggatccctgatcaacagagagagagtatcctgggggtttcctctttactttttctttttctgctctgaaaggttaggaaagatcctgagggcataatctgaccatctgatccaggccagcatactgctggagaagactgtgtcggggatgaggtggtctgagaagctggaataaatgcaggatcagctgataaggagggtgaggaaaaggtgagcttagtgtctgactttaaaaatatgtagatgagctccctaaataaaatacccctccacactgtactgatgactgaaattcctttaagagaaaatattttcgttctacaattaaagatagaatcctattttttccagggagaagtaatattgtcttaaatttatcctacattactacatgttgattacaaaaactgaagaatctattttctttgttttttttccagtttttatctccatccccatcttgcatcttacaaaggacccaatagaagcttcatggggtacaggaaagaatatagcaaggaccttggaggcctcaggcctcaatctggctctgccattcaatagtttgaccttggagagcaatcagaattctcagggccttagatcctctgcccgtgaagctgaggtattggactggatatctccaagggccctactaacaataagattatggactggggatggcttttcttctttccattttgttcaaggaagcctcctcttcgtcatttctcacctaccacccagctctgtattttcccatatttcaatgtcctttcatgaagacatataaacagtggccatgagtcaaggggatgcaagggtatctgtggttcaagaagatgcacgtgatgaccacggctagttgatccctcttggcatattgttgccatctcagaaagacaggaagggtgggttacagctgccagcaccatcaggattaaaagcaggaggactttaagactcaccctcgatgatgcagaactcaaaaggtctctgcttcacagctctgggccaccttgaagggcaagttgacaaaataaagcaaagcccagacagccttacagagtagtagattctgcattcctcattttcatggataattactgtagccttcaatttgaggaacatggcagtgatttgtgtgcagtttactcttctttcaggtgatggaaccagagccagaggcgtggatgtgactctgttgccctctagtggctagaatgcagtagcatacccagcaccccctcagacttggcttggtggtgccgctgacacgtgagcaagggttcctgggacactgactgccaagggggctcgggattctttcagcacaactcctgacctgagattctgcagagagagagagagagggagggagggaaagagcatcatccttcctatttctggaagtcagatctgtaacacagagggcctgtttcgtctagagtaaccctgtaccagctgcagcgctgggacgctcctgcctcttctgcggtcgcatgtccatgttttggggcagctaaggcacctggggtctgctctcgcagtcacacatttgctgtgtcacttctgcctcagttagatgttttctctagcaaacagatatcattatgtggttttccaattatcacttcccaaagggagctggttaatatggatgaggctttttaacatttggctttgaagacagggttatatgtagttgtagcagagggagccaatatctcggtaattggctaaggtttgcagaggagcaaggcagtctggggtatgtgccatctctgggacgcggggtctttgcagaatgtgttattgtggtgtagtctttaagtgagttctcagataaactggaaggtgggtctaggtggagattatttcaagaaggttagaactctggtctctggttacaataaaaaagctggattgctgaagatcatatgggcattgttgatgttgggctcaggcagagagttcttagtagggtcttcttaccctgacggttgccctttgtaacaggcaataatacaagaggattaatttatggagaggctgaagaggttagtggaatgagaagagatgcagcatgcagggacaaaactcagtttactatatcagcttcttttaccctttgggacaagaatccccaatttactgggcaaaacttccctccttctacttcctcttccaagagtttaactcatggaaaggaaatgaggggaaatagcacatttcatggcatcgaagagggcatctttgaaacctagcggctttccacctacagacatttagaatgcaacttatgctggcaaagctattgagggtttaaatgatatgctttatagcgtgttgcatttcttcctttgaaaatgaggagcttgaattacctttcttgcttcataatagaaatttagtcttatttctcagtctatagttaacacatagcaatctggtgccttcgagtgacaatttacctaaaagtcagcgttacatagatagttctacaaaatccaaacttacatgctttgtctgtacacttcttggtcttccaaccttcaggatcaccattgattccttttcctgtacccctccaacccctgacactgttaaactccatttcagtagtcattcacccagtcctgcagattttttgtccctacagcctaacattagttttcaaccagatcactctttttttacactattcaaaaatttctttagctttaaaagccctcatgagccaaagtgccagagatacttgtggtgttctaaagtatttgctgggacagggttaaatggatagggaaaaaaagaaataataggagggaaaagggtcccatgaaaagcttgctgcctggtggtggggaagatggagtaccaccagctatcattataggctgggccaggtgataggcagaataaagtgacttaagaaatttctggaagcacttcactgcactgcaagtcatgccactcttcctcagctcacagttggcagaagcaccactataaactgggttcagccacgtgtcccttagacacataagagagggagtgccaattgggaggacaggtgaccgaggggggcagagggacacattcatttattacccagttttgtcctggattgatgctggtcttgggtatccgacagtggaaccactctagtacctgacacacctactcttgacccagctttttcactcccaatttggttgttatacagcaccacaaatagggaaagatggctgggactttgaagagaacaggtggctcctatcagctggtgctaaaagagccccaccttatagatatgtatcttacactcatatgaccttccctactacaatactgtcataaagtcaaaaatgtgtgtctcttgtccctttgggctcccccagctccatttaataccgttcccaatgtttgtacctaattacagatttgaggagtcataaaaccacatctcccaagaggtagatctgctttattttggcttctgtgacacctgattgtcctctttcttcattcacctttaatgatttgcttccttttgttgcttatcaaggacttgtgctcctgaaggttctgtccttgactcccttgtcttcccccaacattatctttctggacaatctctaccaccttaatgttaatgagcctcaactccaaattggcagcccagatcaccctccagggctctggacatgtgtccccagctttctattagacatctctacctacttgtcccacaagaacctcaaacaacaaacatctaaacctgaatttatcctctgctccacaaaagtcacttctctatttctcattagaagtatagaaatggaagaatgaaaaacttccatccattctatcacttggtattaacctagaccttttccccttgctcaaccccatctctccttttgccttttaccacgaatctgtcaccagatcttacaattctacttctcaaatatctttccagacagactcttcctctccatgtctactttactgccctagttcagggtttcatcaccttgatctggcctttgatatctgcctccatgtgtccaggacctgcatgctaatccctgaaagaaaacctggatacagttttgcagctgaattttattttaatgaaatctgcattcttgtggataaccttccaacacactacttcagtaatatcactgactgtagcaataataataatatcagtgactataacaaaaacttttggcttaaaaaaaaatccatttgcaatgacttcactttccgaagttctcaactgatacccagagccattctttttggtcatatgccaattttgtgagtaaaatatagggtttctttatgaccatacatttcctatgatggcgagcttatgagggtggtccttcatgcaagtttctcatctttctatagcctgaaaagtactgattctttttttttttttgagatggaatctcactgtgttgcccaggctggagtgcagtggcatgatctcggctcactgcaagctccgtctcctgggttcacgccattctcctgcctcagcctcccaagtagctgggactacaggtacccgccaccacgcccggctaattttttgtatatttttagtagacacagggtttcaccatgttagccaggatggtctctatctcctgacctcgtgatccacccacctcggcctcccaaagtgctgggattacaggtgtgagccactgtgcctggccttgattctttgaaaatgaactctttttggcaccctcatcttctgccatcttggtccattttgcttatcagagtaaatacaactggtaaaaaggtttatgctatttattctccctccagtcttggttcataacatgctcagttaaatttctccctcattgagtgtctcctcaaagataaatattttaccttggaaagtctggtcatttctaaggttaggaaaatgctatcagtcactttggagttgattgcctatgtcaggttggcattcttggatgaactacaggtttaagatttgctgttctgcatgcatcactgtgaagtcatctgagatgggcgctgacctgtagctcacaaggagtttcaaggtcttctatcatcctcctttcaaacactcacagtgattaattctccagaaatcactactggtgctatcaccttcagaaaacaattttctttctgaatacatgtagggtatataggcttctctggtttggtttgcatttcacattagcctttttttttttttttttttttaaattccaaggaactctaccttcaaaagcaagcaaagcattctcctcccaggtggcccatgtactggattttggagtctgaattgttatttcctcactcctgccttcctctcttcttggctttctttctagggcacctgacgtccttccttattactgatggcagcagagactgaacccctgggagaggaaagtgaactgagtaattgttttgccttttcatgtctgatgtatcactctgggtcagtgtagctttagttgaaagagtaatgttgttacccaggagcagctgtagtgtctccagacaactccaagacctctccagtcccgcagaggtcagtttctggtctgggcataatggtcttttttccaggggttgaagcccagctagaagcaaattcctactctgatttctcaagactctgaacacccacaccggcccatgagggcagagagtggtggctggctttctaaaccagccttgtgtcttcagagtccttgatcagagataacttggggaaagctgtgtctcataaatccactttgctactgggtcagagagatgccttgagaatgaccttagctagggaagggatggaatattggtttccctttgtcccctgcccttcagttcatggcatagggttaagagagtgtcaggagcctgcaggcctgttctgtgcttagcgtggggagacatggcagcaagttggcaagctggggtcttcttattccaaattcaaccatttcttggcactttttttgtttctttttctgagaggtagtagacagtggagctaaataaaattttctcccaagaaaaaatggttagaagcagcgtgtcccctgcccaggcctgaaatctcttcattccctttccctttccccagggttcccaaaggtcttctgcattgcccacctgctgctctctttcctgccctgtttgttttgatggcattaaaaggcctgcctgcctactttacaaggaccctcatttctttacccatcatgttttgatatattttttcttgctttttcttgaggtttgcaatcaagagccctttaactgaaatcctgggctgcctgcagcagctgtggggttcccagccaactgccttgtcctctgagggataaattccctttgaccgtgccacttgtgaaaacacagagcaagtgtagagtattttacatataatttagaaagagagaggacttatcggtgggtggtaggaaaggacagaagatggattaatattttttctttatcacttggcatgttaaacttaattatatttcttgaaagacctctaaacagttataattagaaattatgataatagctgcggttgccttacacatgttcattttactgcttgcttctttgtgaatgtgggctgtgattaataaataaccaccaacatcattaggacaagacctctccttgcctgctgggacccctttgactttggatggacagtgtcaaggatcaggagcacctagactagccccatgagccatggccttcataggctagatggtcattggaaatgaagttgttggcaccgacagtcacagttatgaaaataagaatttggatctcagatttttctgctccctcttctcctgtgtattagtccgttcttatgctgctaataaagacatacccgagactgagtaatttataaaggaaagaggtttaatggactcacagttccacttggctagggaggcctcacaatcacgacggaagatgaaggaagagcaaagggatgtcttacacggaggcaggctagagagaattagagccaagtgaaagaggaaacccattataaaatcatcagatcttgtgagacttattcactaccacaagaacagtatgagggaaactgcctccataattcaattatctcctaccgggtttctctcacaacacttgggaattatgggagctacaattcaagatgagatttgggtggggacacagccaaaccatgtcatcctctcttggtcatttgttttttttttttttgatttacaagtatcgtttattcactcacttatttttgtgcagggatgacaagagagtcacaggaatatccctaaatacttacggtatcattgtaaagagaaataacccaagaagagagtgaaaaaagaacctcctaaccaagggctgcagttgagtactaactactctgtggtgagaaataggaaatttagtattaagttaaagcaaaatcctttttaacatttctgaggtctattctcatgttgattataaatgggaaaagtgagaattagcttacttctaacctagctgcctgtttggccctgcaaaggattttagagatccccttcattctgtttattttatggaagaggaatttgagtctggaggagttaagacattgactgggcaaagaggcccaaccactcatgttcagacctccctgtgagatgccatataagaatatcaagagaaaaccttttaccctctaggctgttcaaccttagaaattcataagagcccccttagtagtcaattatgaatgataacaataaagatccatgttcaaagtattgaaagcactgtttcaataactttcttacagcatgggtgtatgacagaccagagactaaatacggagtcctaattctcaagacagtctcaaaggatattcaagatcaaatttagaaaatatattgtcagaagcctgttccccagagtcacattcaaagatttttctcagagaaattttcctaaaggcatgattctaaagagatctagtacaaggcaaaggatttcgattttttttcccctactacttcctcatctccaccccacaagttgacctggagtcatctttggtccttttgagttttaagtcatcatcttccctcaggctcaagaggaagcctgctgtattttgatgagacaactcacctttgatgtcacagttttcactcttcaagaacaaggagtcattagtatcttgacatctaactgtataagttaaagcacttcctggaagctcaaagggaaacactgaactcttaacacacagattctgctggaagtaaatgactctgccctataaaaggaggagaaagaaattctatttgagtaatgccgttgaaatattaaaagaaattcagagggaaaaatatccaagtgaataatatatattggatctctggcctctaatttgacattcaggtcagatcaaaactaaccctgtgagattctggaatttaatgtcatataaaaatgctactgggcaaggaactttattacacatgatcataaaaatatatgggaggcgccatctctgggtatttttctatcaaatctttactcattttacagtctttacaaacagaagccagaagtgctatatttgaacatctacatttgttgggatttctttaaaaaaaataaaacaaaaagaagaatcacattttatacgtgttaaatggtgtagtagtaaaccatgtttaaaaaagcttcagttttcattggtgtacaaagctgctacatgtaaatattggaaccactttttaaaagaggattgctgcagtcagattttttaaaataataaaataatcacaaagttcaacatatggtgtcttcatgtgattataagtgtgcgagtgtgtatacatgtttttaattccttaggattagcagaatgacaaaatgtgtgaagaaggatagatgatggttatttcaagcagcacaagaatttgaggaggaggtggagactaagaagagagaggaaaaaaagatcaagcaggacaagggacatgggtacaagactagaagaaaagctggatttctttaaactagaaaaatcaaagacatctgttccccttatggcaataaccacatttttctagaaatttacacattaacatctaaaaatggatttgtgctaaaaatacaagctatgctcaatgcatgactcttgaatgactttcccctatgattcctctgtagtcatatggcaaggccatgccctcatctgacattttttttagtcaggaaataccaacttcagttttctttgatcatgtgatttccttggcctggaaactcttctctgtctttccccctaaccaactcttactcattcttctagactaactcagctctttaatcactgagaaaaccttccctgcctatctttgtcccttccttagttttactgaatttgcctgccctgtactctgatagcacattgtatttaaataaacacttacggtctctcccgctaggctgtgaacttcttaagtgaaaagccatgttttattgaaatctatatttctggaacctaacacagtgtcctagatgctcgataaatatgttttggactaaaatatgctgctagtttaatgctccagttcctgatgaagccagggctttctttcccaggagacagtcaactcagggggcatgtttggtttagtacctgccagcgtgttgttgacaaacaccatatactctctgttgcaaagccaaaacatgaccttttccacaaatggagtaagcgtttattggggaataaaaaagtatgatgattgtttttaagtaacgtataaacctaagtgtctcaatagaaattgtgagaaatatttatttactgcgagagaaacattttccttaagctttcattgttttaggtagtcttcgttttcctgttccccatcctcctaggttgaattccctgattctggctggcatgctcataatttctatgatcacagccccattgtctgttggagctgagggcattgtaagtttttgtaagcagcctttgataagttttagaggtgtagagaaagagctctgtctcctccctgggagaatactcctttccctacacctcagaggaccaaatcatgtctttattaatatgaagcattcattccagtggcatattttattcattacaagaggatcagtagtttgagcaatcagagatgaattctaatatatggaatcctttcccgctgagcttccatgaaagcatttgatcctttttggcctgccccctttgagctggctcctttattaatcctaaaggaccaaggtgtaagaactcaggcaggacaactgtctctttaggcaaacccaggctttgatccgcttccctgacacagtgatctcacctcctttggctcagtcctctccttcgtcattggcccagctatgagtctggaagtccccacagtgccttctttgggtcaatactattatcgtgcacctgctatttgcctggtgctgtgctagagactcaggatacagatgtgtagagggaagagtgtttattcttgtgaccttatcatggagagctttcagatgagatttattcctaccaaatttattatttgagtgaaactgaacagttccattctgataagtaagggaagaaccaggcatactatgttgctattctccacgatctgtgttaaggtttctgtggatgtgtgtgtgtgtctacttaaagaaatggcagtctatccctcttacatcctcagatattcacagagcccctcagtgacattttttggcctaggctttttaacattctagagtagaagagttgactggtaggaacatttctaagtgctcttttgcaccataaagcaagaggagtgtagctgttaggggaacttgagaagttggttagtgtgtaagtgatgtgagaaaattctaagttttccagtttaaaaatggagacaggagggaaatggccctttgttaagaaaataatgttaaggtattaagaaaacaatattaaggtataaagaaaaccagagacatgaaacagaagttggactctgagagtcttggcggagatggtggtagttttagcctgcataggtctgggataggagtcacttgctgtccactggcatcagaggacacaacggagtctttgatgtgggtctgaaatgttacaacttcccacccccacttaaggatgcttggatggagaataagagatgtcagttgtgttctgaaaaccctaacctagatataccttcagccaaaagagagacatgctaccatggttatcatccaaagccactctgtagaatatagcccaaacatcactgtgtattaaaacatttctctttactgttttcacataaatagattaatttatacagatttgtatttatttacatatttgtgtatatgctgcactaaatcctcactagtgggacattgtttaggaatcctggtacagggtgtagtaccaacaaggaaaaccttcttattaagctcagtgtcacttgatccattatatttaatgccaggaagggtatatatacagatttagaaattaccttatttctttgtcgactgagatgggtaatctactcaataaccatttaatgacaatgcacaatgttccaggatgcagaattgaatagcctagcctgggtcgctcccctctgagaagattacagtgtaatatgataattattaccatagtgctacccctggggcagaggacactcagagaaggggtatctgatttagacatggggatcactacagctgcctggaggagaggaagcttaaactgtgttgggaagtgtgagtaggacacagattggtaaggtgggggtggagaggtattccagaaaaagggctgggcatagggaggcttgtagcaatctacaatatttgggaagctatgggtgggttaatactacgggcattaagtatgctttgggagggagtgaatggggataggattcagggcacagctgggccaggtcacgaagtaaataagatcagaaagactttgaatagctcagtcaggatggagattcatcttgaaactaatagctggagaccttgattgacttgagaaggaagagaatcatgtgatcctatttacacgtggaaagatcatgctagctgtcatttggaggaggaagtagttaagggcagggtagagataggcagatatcatgagataacctccatgaaaaaaaaaagggtgaggtggcacaggtgaaagtaaacttaggaaagtaaagccaggattctaatgaaagatgttattaattaaacttactgtttaggaggatgatggagaaacccaggtcctggcaaaaacggtcacactactttaaagtttgggactaagaaggaaatgaataggatatcatgaaagtaggctctgtgattttcttagtttgtagggagatggtagaacttagtggttaagcacttgagctttgagctctgaaagatgtgagtggattcctggcctgatctcatactagctgcatgaccttggttgaccttcagcattctcatctgttgaatggggtaataataatatatgactccaggagttcttgtgagaatttaatcagaaagtacatgttaaatactttttggcacctagtaagtgttcaataaattaccactttgcttatttttataattggtaattaaaagccagcaaaagtatgcttgtagtggaaaaggcactacaggcacaagtactaatggggcttgggctgccaggaaaataccctgtgatctccttctgatacctggcacacaattttcagggatcttggaaaacgtttacctcatatgcaagtccatgcatggtaccagcaaacagggatccttgaagaagtgaattcacagctgtctttaccttctactatgtaacagaatgtgagatagagagaaggagagggaggagagagggagggagagagagagagagagaggagagagagaaagaaagtgacaaattagattatggaatggaaagttacatttgggaaggtgaagagttttgtcaagtatcttagcctttcttagcctcattttaaaatgatgttggactaagtccagctgcaaactgacagcccatgcaactagcacgtggaaatattttaaaaagctgagccaacgtttaaaaattggaaatttgtcaattgaggtagcttcttccataataagttcatttttattatttattcaaagctaaataattttattcaaaaatagatttctggattctgttgaaaaatcctaagatctggccaaccaggctcctgctcttccaagggcgtaagcattgctgccccttttgggcaaagaatcaggtttctaggtcctcaaggctcatcacttggggtgtgtgctggtctctcatgccaggtccccttctcttatttgcaaactgtctctgtttgatattaaaatttgtaatggggaaacactcactggtttctaaaaccctatgtagatttaagtagttgatgattctgtgaaaaaaccaaataccttctagagaaaacatacaggttgggcagagcccaggtattgatgtccttgatgaaactggtttttgtattctgaatgttggagattgagagatccaaagccattctctaaggttgacaccaaggtgcaggtgaaaccatggggggcaggtgtggggagaaagggaaggagttgaaggaagaaatctacaattactcggaactccacatccactcagctgctgtagaatatgagttgagaggaaatgcagaggagaatctgctgcataggaccactggaatatagattgtgttttggaaatgactgatttatcaggtggaagcagagaatgataagccagctccatgctgttctctcctttgtcatgttcccctgcccctggcccttggccttcctctcacttccctccctgacaccccaactccatgcagcatttgctccccctccacccaactcctccttgctttcctggcaggttcaccaagaaacaaccgggcctccatggcaacgtgaagacagctgaaaaatggcagctaaatgcagctgcccctcatttaatatcgactctggcactgacagaacagataatgggcaataacacaccattatgttgtgggaaaatgaaatgcttcagcagaaggctgtcatgctggggggatttatttgttactgtaccagcaccagtttctatttacttcccttccgttctttttgttccctcatttccatgccagtttctccctcctcctggtttctctcccattcctcccttctatagcttctcttttttgtacttcctttccctcctcttttttttttttccttctctctgaatcacttatggatataccagaaagcatacatatataatgcaattatttgcatgatgacttacaagttccaaagcacattcaaatacattgctttttcatttggagggtgaggcaaccctatgaagacaggtagggcctagacactgatgtttattttgcagatttttaaaggggctcagagaagttgaacccaagatcaggcaagtaagtgtcagcagctgcattgcaagtcagattttctagcccctagacaggactctttcctttctacgacatgaaaaacttcagagtcaccaatttctacccactttactagcaccctatcttcttactgaataatctgcaggtgcagagaaagtcttctaggctttgagacttcagaaggtctttagatctttacttatattgccagtcacttacagattcttccagacaagtgcctttgaattgttgataagattggtttatttttgttttcatttttactctttaaacccaagacgtctatctgctcattacctcctattgcatcattatataatcatgaaatcttggtatgcagaagggcgtggtgtgctctttgacttgaaagtgggggcattttggtggccaacagctttctgttttgcaaaagaccgtggtacattgaggtccagaggacatcactgatggacttggcatgaggaaaacccttctctaagttgttgctgtagtttaaacttgctttcttacatcctgttggttggattgtcatagcaccctcatcttctgttgaaatatcatttagtagactctaaattctggaaagatctgagatcaagtttcttagttctttgggtcttgaaaggattacaaatggagtgagaatggctattgcaaacatgttttcatttctagttatggctggtgagggaagaactaaatgtcaaaaaatatatgtgtacatctgtagaaggtacagtatgagtaatgaatatagtggttttcaatcatatgaaagaatgatttatattgataaagagatcaatgtttgtacttcccagcaaatattttttaacctgggatctctgagccccttgaaaacatgtgcaaaattttgtatggataaggcaatgcagtgcagtgtttcaacccactgatgttgaacatactgaccaggattttggctctgccacttgccagatttgtagctttagaaaaattacttacactcttcagggcttagatttttgaactagtctggtactcagttgagatttgctattctgtattgtttcttttctgtctgtaatgctttgttctcattcctgcatactgaaactcttcctgcaggtttttctctctggcagccatccccagttttagctgtggaaactcaagtaggcctctaacaaaatgttctgtggtggtgagaaagctaaggaaaaccagctgctaaaattacagcaagtctctggttgctgttgcttggtttctttccctgtatagttatttcccgtgcatggttcctcaaagtgaaatgaaccttagtgtcatatcacataatcatggaatgttagaactggcaggaaccagagatgattccatttctgtggtctgccagttcaaatccttgctgtgtagaaagcaagtccttgaccaaaggcctgccttgccaatcagcctccttgctattaatatattgtccctctgactcctttaacttgtttaattgcgctaagttcttaagtggatttactgccattccttatccagatctgaggctgtatgatataaagataactagtgtttgtttagtatttatgccattttagtagttatattttattcttaaaaagtaaaagtgactggttcaggaaataagtactctcaggattgagacatatttttacatgtttcattattttgataaattttaaaattagattttgtattaagaagactgttcagaaattatccccattatctcatttttattcattattcaaagaaatgtaagaaaataataagccctttatctagctattggaattttggaacttccgaggcaactgtgaatctcaagttagccagagaaaagggggcacagagtctttaagcaagaggagaaaactgtctcacaaccatagtttttttttttttttttttttttttcccttggaaaggaatagagctagccagaggacttagggtctagtttccataccaggtgggagggttagagacagcaagtgaaattggtggagaactttggaagttgtcaaatcttcattgagtgagaaaaataaagccgggacagaagtaccccaaggaagaccacagaaggaaatcctaacagaacatacatagctcaggagaccagaatcttttaggtcaaaagcaacaacctcaagagaacttaagaaaaccaagtgcattcttaaaccagaaaagtacactcagaaatcacggagaactcaagcaaaggactttcaggcaccaacctctcttacaagctctattatagcaccagtgaaataattgatattcatgaagatcatacaattttagactctttgggttggttgtagcttagagattatctagttcagggctgctcaaggtgtttcctgcacatcagtgccgtccaagagctgtttgttactaatccataaggatataaatatggaaactgagagtaagcatttaagcacttttgtagtaattccatgtgtgggaacacacaggtgagggagagtggactggtctcattcaagagggtgtcaaacagttcagcattttaaaacttacttggtgagtcatatgtggcatgagctggtagttcttcacagtagggcatgtattgatctgaaaggatggaaaaatctaaaaaacaaaataaaacaaaattggctgtttactaaaaagatcttgtgaagccccaatctagtgaaaaagcctacttttacatatgaaaagatagatgatttatccaagaaaatataaaaagatgatggcagaacccagaatatgggattaataacattttattaattaagcaaattatgcccaacatactctgcttcttaaaataggcaaagcatgcaacacattgtagaattaaaaaaaaaaaaagacaaacatttgagacctgtgggctcttaaaggttgaatcattcctccatggacttcacatttcaaataagattttgctatatatacacatacaactgtatcaccccacagaaaacatattttgcacttgaagtttgttgatctcttggggcattattttgtttctgggaattcttaaagaatataaggctatgctggatggcaattttctgggtcaattgtgcccaaggcactccctacagcaaattaggtaatgaaacaactcttgtgggcccttatgatgcaatttagggcactatagtggtaatagactagctgggggctcagcagctagtggaactctagggacctcaaagcatgactaagccttcttcagtgcccagttttctgccgtgggatggtgttaggcccgggaagaacagagcctaaatgcacccctctacccacttccaccgggatcttgacgaaggtagggatgctcctcgtatttccatggttagattaggctaattgtcccttacaagttgaggttttgaaacaactggaagtggatagaatcacaatggtcatattaccatgataataacaatatcttacatgtataccattgaacttttatctcattaggtcctcactatagtctcactataggccaagcagctacttttagctgctttgtaataagtaagccaaataaaggctcaaagattgaacagatttattgattttacccctcagttaaaactaagatccagggccgggcgcggtggctcacgcctataatcccagcactttgggaggccgaggtgggtggatcacgagttcaggagatcgaaaccatcctagctaacacggtgaaaccccatctctactgaaaatacaaaaaaaaaaaaaaaaattagtctgttgtggtggcgggtgcctgtagtcccagctacttgggaggctgaggcaggagaatggcgtgaacccgggaggtggagcttgcagtgagctgagatcgcaccactgcacttcagcctgggcgacagtgtgagactccatctcaaaaacaacaacaacaacaataaccaaaaaaactaagatccaggatgggtacagtggctcaggcctgtgatcccagcactttgggaggccaaagtgggaggattgcttgaggccaggagtttaggaccagcctggacaacatggtgagacacagtctctacccccaaaaaaaacaaaacaattagttggatgtgggcatagtggcatatgcctgtagtcctaactactcaggagactgaggtgggagactaaggcaggaggatcactggagaccaggagtttaaggctgaagtaagctatgattaaatcactatactccagcctgggtgacaaagcaagatcatctccaaacaaaacaaaacaaatcaacaaaaccctcagattcatccccatgtctccatctctactgtcactatccaagtccgtgccgccatcactcatcacctgcataactgcagaagcctaccaatagtctccctgactcactcagctcctccagtggattatttacatagcagccagagtgatctttttaaagtataaatcataccctgtctctctaagcttaaaaccctttaatggtttccatttttcttaggataaagtccaaacttcttggcaaggtttgcaaagcccagcaggtagcacttggccacctctgcaacttcctcttacactgctctcttgttactcttggtgcatttgccccattagccttcaaattcatcaagctcttttctgctctccctcccctcccaaaggctaactcgtactcatttgcaggtttccgtttaaaccctgcttcttcaagagcttccttaattcttcatctaaattagctccttctactttctctttcctcttattccaccctgatcttgtctccacggagtttttagcacgattcaaagttacgtccatctgtaggcttttctttgtttgagggccgtctccctcactacaatgcaagattgatgaggacaagccctatgcagctttgttcaccagtgaatattcacacatagctctctgcttcagagttctcttgctataaatatgtgataaataaaaaatgagggaatgataggcccaagagggcacagatgggcaagggtgatgtgagataatgcactctgcttctgaaataattcctaattacctttggttttgttcttaaaacacaactggagttcttagaagaaatatgcaatctggcatatagtaagggctcaataaatgtttgaatacatgaattaatatgtaatgaaagaatgaatgccatcgttacaaattagctgagttctccatgtgtttgtaatattaggatattactgtccccaagttgcattatcgacttcctggctttcagtgggcccagtgtccccacatgcctgctcaccccccactgcactaacctaaataatctctgattattttctttttctcttgctactaccaaattctgttctgagtgaggaagcagcttggttaaaaaacaaaagccctgatatgtatatatattttttttcctgaagaataccatcaggatgaaggctatgattaatacacataattgctacaaatggcagctaactgcagaaaaccacctcccagctgttggaggaaggaaattgctgacagccactccccattgggtggctaccaaaagagaggagctcacaggagcaggagagaatacacatctccatcccacgtgacccatagagatgacccatagggctctgtcttacatgtgagctttgccataaaatggtagtgttaagagtttttagggctggggtttacagccaggctttccatggctggggctggttttataggacatgctgtcctgcagaatgaacatttagaatccctgtggcccagttggtattactgcaaaacccaggttgaatcccttcaggaggagacagatgattcttggctggtcagatttcttctctcatcctttccttgttcatttgccctattctaatgggatggggaatgcacaaacaaggaagaagctctgggttgcttcttggagtctgctttgtgacctgagctcgacccttcactttcctgggcctcagtctcttcagtctataatgtgaggtgttagactagaagatcactgtttccttaattttaagcatctgtgttacaaaacatacgtacaaagtatgtgtacatatcatattaaaatgtatataaagttatatctatatctgtctatctatcatctattctctagtttctattagcttggtgcaaaagtaattgcggtttttgccattgaaagtaatggcaaaaaccgcaattacttttgcaccaactttgtatcaattatcacctatttatctttcaacgattattcatcatctatccatccacctatctatctatttatcaatcaatcattcttatgtatctccatacccccatcttctctgtctactgttttacagttagcacccgaaaagttatttgtacttgtgttagtgttaacatgtgtctggcttaactagtcccttgttcaggtgcaggaatttatcaacatataaatcagaagacaaaaaacttcaagcctaacacacttaatgcacataagcttctccaggccaccacttacagagttgtgctatacctttttttttttttttgatgtggcaaaaacaaaacaactcagcagctaaacagatgaaaagccaagctgtgggctaaggtatgtatttgatgaagctctctcttctctagatctttagtgggaagagttttgccacttgacacatatttaccccgcaaacctacactggcaatgctaaggcagtgagcacagaacacaggcctgaagtgtgctggaagttagctgaagggcaatgtcagcgcaccagctttgaaattacatgcagcgcagtcaccgtccctctggaaaactgtgcattctgtgaatgctgactctggaagtgcacacgctgagcatcagggctggaaaacagctgagagagaatgttctcccaggagaacaaaccttagcgagcttcctccatgtgttctgtacatctgcatcatctcatttcatcttcaaacaatccatgaagtaatgcagtcttctttatatggtaggaaaactgaggatcagaaaaattaactgattttattcaaggataccctgttagttgcagccactggtggtaacattttttagtgctttggtgccaaaaaagaaaaaaagaaatttttgtgctccaaataaaagaggacttctgtagaaattaaaataaggcattattagaactttaggaattttgcttctttctttgtcctctgattattcctgtgactttatgtatgaccccttaatgcaatggctgtgttctaccagttgatttggacatgtacatagttgaccttcaaacccattactgttgcatccgagactatccccttgaggagttccatcagggagggaggagcatcgtctagaagtcagaagtctttgcctgctgttagtattctccacagagctcctcctctccctcagttgagggtcacaggatgttagagaaatcaaaagccactggacatcagggaaagattgaggagcctgttacctgtcaccttttcatttagacggccttgcttctaaaattatattctgaattttccatttattcttgctgctatagactgaatgtttttccccctcccacacccactgttcatatgttgaagccctaatccccaatgtgatggtatttgaggtaggtagggaggtaattaggtttagatgaggacatggggatagagcccccttatgggataagaaaatgattataagaagagtgctcgatatggttaagctttgtgtcccacccgaatctcatcttgaattgagattcccataatccccataatccccatgtgtcaagggagagaccaggtggaggtaattgaatcatgggggttgctccctcatactgctcttgtgatagtgagtgagttctaatgagatctgatggttttataaggggctcttgccctctttgcttggcatttctccttcctggcgccttgcaaagagggtgccttgcttcctctttgccttccaccatgattgtaaatttcctgaggtttcccaagccatgctgaaatgtgagtcaattaaacctctttcctttataaattacccagcctcaggtagttctttacagcagtagaaaaatggactaatataatgcccttagaacaagaggaagagacaagagtcttccctttttctcggccatgtgaggacacaggaagaagatggccatctacaaatcagaaagagggcactcaccaggcaccgaatctgccagcactttgatcttggacttcctagcctccagaactgtgcaaaataaatgttggctgcttaagtcacccagtctatggtattttgttacagcagcccaaactggctaagatactgtcttgtaggtgaaacagggctaggagttattttacaggcataaagttacctgtttttacactcttgagaatcaattagtgggttggtatactaatggtagggtctaaaaaaagaagaaaaacaccaaatgcatttgaagcgattccaactttgggacactttttattatttcagacaaatgcagatagaatgtttactgaggtgtctccctggccctttatgtaatatttggatagcgcaatccttagctgcatgcagataatgtgttaggcagctagaaaaataacctgcttgtactgtttctgatttattccccctcctccctcacgtctttgttcacagtaaacacatcactgcagagtagctagcaaatgaatgcctttttatcagaggtacatgcccagttggtggctacgaccacatagaacagcagatatggccaaagggggaatcactgacaaaacaggcagaccctcacccagagtggatggtgtttcttggcatctgagaatcagaatatagaggaagatgaaagcactgtcgtgtttacggtgctggaaattatattgaaactcaagtaaaataatgatgctgctgctgctgatgatgatttgttgagtgtttactataggctctgatctggcatgctttccatgtataatttcatttatactttactacaacctcaggtgagagctacagttattatattattatacctattttataggtgaggaaaccgagacatagagagtttaaataacttgcccagtgtcacataggttaagaaccaggatcaagataagagctttcctcaactacccaggaaggaccaaacaagttaagagtctccagaatttgagaggaggaattatgattctggaagttccaatctttctctccagcttcagaaggatcaaccaatattttaaaggaatgtttaatccttgtggtatgagctgttggggtaagaaagaatatgggctggggtgaagattgaatatgagccaagttcagtctcattacaggactaggaagacagagaaataccaagatctagagcattgagggatattttgatgaagctctgttggctcttgcatggtccacatgaatgcaaagcattcattttttttctagatgagaggcacaaagaaataagacagcatttttcttttttcagtaaaatccctttagttttgactgcactaattctgtattttcctaatttagtcatgttaagctaaaatttacctttataccatgtaggttgagaggaggatttataaaacaaaaagagaaagtggtcagcctattctatcggatcaaatcagtaaattactaccaatcttcactacttcaggacaattattttattcaaataacaaatacactaattacaaatgaatgtccatttttaaatcacttgcaagagtcccacacacatttaacagagtggttttcttttctttaccttatgttcttggagataataaatcaacatttccctcagaaagcatttgttaattttttattcaatcataccaatcttttgcccaattaggaggcattagtgtaattttttcccattaaattgtacataagtactgtcgtccttgtttgaataattaactttcacctagatgccctatgtgtttcggttgatgtatttgctcacttgcatctgcggtttgctgtagctttgaaactactgacactttcaagcaagatggactaatgtctctgaaatgaagctggacatttggatttgtgacagtgagcttgacacttattaccttactaataggtagtaagcatataccaaaatgatttacatagagggtattagtacctattagtaccttactacctattagtaaggtaatatgtgtcaaagatttacatagagggtatatgcttactacctgttagtgctaagacattggttctgtcagatgaggattttctgattggcaactaaggaagttatgttcataatttaaagtgaaggggtgggatgggatagagctggatcaatgccccatggtactacagagtgagtgataacttggagaatattgtccccctgctccccacccagctgccagtttgactagcctttcaaatagcattcacttgtcctcaattctcacccaagacaaaacacccatgacttggaacaataaagcaaacatatttccaaaatggccatggcagaacagtgaaaaggtactttggtatatctcatgccacatttcacagatcttctgttctgtgatggtttatggaagtgaagtactttattatgtaaaattcatcctgttttttgtttgtttgtttgtttgttttgttttgtgatactacagatccatttcactatagccaaaggacatgcgtttggggtctggggatccatcagaggattcttctctcttcttctggtcccacaaagcaatcgtgagctttagaaaggaatcctaggaaaagtgaatagtcttccactgacatctgctctttcttatagcttacaatgaatactgcctcttaaagtgtcttcttaaagtggcacaaagagagcacctctgtgagtgcagggtgattgggcacgcagtaggagaagcactcagggttagcaagtgattttcctgacacaaaaccatttgttggcaagatctgtgggagaaacattctggattttgtatttcttgacctttccgtgctttcatttggtaaactttgcaaagcagaagctttatcttaaaagttgttgtggttttgtattaagctcttttgaagtaactgatatgacttattttgctttaagacttaaagtgcaatttttaataagctggtaccatttattaattacttactaatgatcccagcacagtgctttctgtatattatgtctcttcgtctctacaaaaaaccccaggacttataaattattatttttctctaatttgcggatggctaaactgaagcttaaagagattaagtaatttgctgaaaatcacatgacttctaaggaaggttgagattctttctgactccaaagcctgagcattatttcatcactgccttcctttatacattatgtatgttaattcaatgttttcctccctctcaggctacagaactcagatttcatgagagtttagagttctagtctccagagtttttcagtaacccttctctcttttcagtagaaagggagagttgttttaaaaatggataactacttaagaaaggcctttgacaatctctaacgtgtgaaaaattctttttggccactggcttctgatgactcaaattgtcagttgacttgtttgctaacatgttttagcttccatcactcccttccacagatggcatgaagaattggccatagtagataaccatgctacagtagatgccattcatttattgccattcatttatagcaaatagccattctatagcagatgccattcatttattttattttatttttattttttgagacagagcctcactcagttgcccaggctggagtgcagtggcgtgatctcggcttactgcaacctccgcctcccaggttcaagctattctcctgcctcagcctcccaagtagctggtatttataggcacacaccaccacgcctggctaatttttgtatgtttagtagagacggggtttcaccatgttggtcaggctggtctaaaactcctgacctcaggtgatccgcccaccttggcctcccaaaatgttgggattacagtcatgcgtgagccatggcacccgggctgatgccattcatttagagtagtcattctttcatagtagacagccattctgtagtagataccattttctatagtagcactaccccttaccatccgactagaagaagaataagtaagtgattagaaataaggctcctggttatagggtttgttacccaatgaacatgatgacttgattagcgtgccctttcagcccaatgtaggattttctatggactatgattgagagcagacacctacagatttgtttgctttacatatatagctgaatagtcaaaatgctatatccacctcaaatggagtcaggataagcattatgaaaagtcagaattggcagttgctaggtgatgtaatttgagggacttcatggagcataccctccaaaaaactcttactgatgcctgaaatttcacagttatgtcttgattacattggattgagcaacagcccctcctttaaaaaatgcaaattcttctcacacagggaggtagctattatgcccctgacacactgggtgcttattaagcactcgaagcagaacagaggatgtggatggatgaggagatggaaaaagttgtgcagtgaacagtttccctgagagctggcatggcaagaggggggcggtatgcccactgcacaggggcggggccaggtgctggatcctgcacagtgggaacatgctcccctctgccatcttttgttgggaagaggctcacacagcctttccagaagagaattgcaggaccaagcaaggtgaactgggaaagagaaggatctggaagtctaggatggcaagatagattggagagcaatacacagacaacctggggaagagacctcgcctgggtctgaggtgatggggtgggagccctggctctgcatctggctagctttgtaacccagtcccacgtctactgaccccttgacttcctgttcctttgtgtgtgtgtgtgtgtgtgtgtttgtttgtttgtttgtttgtttgttttgagaaggagtctcgctgtgtcacccaggctggagtgcagtggtgcgatcttggttcactgcaacctccgcctcccaggttcaagcgattctcttgcctcagcctcctgagtagctgggactacaggcgtgtgccaccatgcccggctaatttttgtatttttagtagagacggggtttcaccttattggtcaggctggtcttgaactcctgacctcaagatccacccgccttggcctcccaaagtgttgggattacaggcgtgagccaccgcacctggtccctgttccttatctttaaaatgagggcatttgactagggacatctccaagtttccttctagttatgaagaatacatttttttaaaattgtactggaatcttatgagaaacacgagggattattctttttgcttttaagatttatccatgatagagtataagataagccatgggacttgcttctctcccaactcaccatacccaaaagatattaatcttggtaagatcccacaaccaacactatgcttttgcaagagcatccaaagttgtgattttgggttttgttttgatttcttttgttggttttttaatttagcttgtgactaatagaaaaccagaaatactaatctcttacatcaaaggaaggttactggcaacctccttgtactctccagggaggcatggttctcttggacttagcctgggttgtctgcatctgggaaggacttggacaggaaagagctaggcataggagctgaaagggaaccttcttatcttcagactgggaggacacaggttatatcctccatcagaggtgtagaagaaatgatgctcaacaatcagtcacatcctcagaacttccccaggcttgcatccctggaaagctgaagtagtctttggggcttcagagaaggcatcaattgatggatctcagtccatgtgtgtgtgaggctcaaggttacctggcaaggcagtacagggcagtagtaaagagtgagtaaaggatttggggtcagcaaaacctggttttgatcctcgatgctacctctttcaatggacaggttaccaagcctcaactcccatgtctgtagaagagactgtcacaacacttgtctctgagttgtgacggctccacacaatagtccaggcaaggaggtaagcctggtgctcagcattgaccagccatctagaattggtcattgccattattattaaacagtgcagccctatggccagtgaaaaacaacttttaaggcagcaaggcacttgcagcatccaatctggggaaccactcagaaccccggaaaggtactccagcaacacctgacccttctcagattcacttccctttacatagcttgttacgtggtgagctttaactacagtgcgcagctctcatctcttcaagggtgggaggattgcactgcaaatatgtctaaaaaggcacctgtgtcaatatagtttgtgtcatattcaacagggagagcaaaatgaaatgcatctttcacagatctgtagaaaacaatcatcatgggtgcttcctaaactccatccagagagttaaaggcatcaatcgttattattttttcccttcaaaatacatataaagaatttaaaaatacatataatttttgacttcaggaatgtatgtttgtttacaagtaattttattgcaaaatatcaagaatgttctgacctctatgtgaatggatgtacatatatctccccaaagtggtctatgtcaatgtcagataaaaagtcattcatgtatttcagatgagatggaagaggaaagcaatttgccaagtagtgatgacataaaggaatgtgcttatagggtcttcagagggctatccctgcctggagggtttttgagggtaggtaggaggccaggtggttggctcctctgttattgaaaaaaggagattgtctttcagagagcactgaggcctagagcactcttatcacttggaatgcccgtcagggctcacagagagtggagaagcattttatatatcacaagccattgcatgccataacttctccttcttttcttgtcctctttattttcccctaccagcatggctctcagatttattaacagccctttcatgccttctacagccatcaggaagagaaataaagaggtctgggagaatccaatcttctttagcttgtcctttttcactctcttagcttttttgtttgtttgtttctctttccctcccttcctccctccctcccttctctctctctctctctctctctctctctctctctctctcatttttattagactgctctgcatcaggctagagtttctttttcaatttccctcttctttcactgtttttaattgtttcagtgcctttgtttttccctagacttgagcacagtgggaaaggtcagctgtcagaagaggggctgtacacagctgataaggccttcaggagactggattggagtcatttaggcagcattctctccctgaagtcatagaggctacactgttgcagtggaaagaaaaaaagagctcaatgagtagaaaaggcaacttacatgaaatgagcagcttggctatgtgagcactaagcagtgcattacttacccagagcccttttccagaggcaggtgctgcccagtgccagctccagtgactctgggacgttgatggaaatgtgaatctggatgaggcacacatgcaggaggcttggagtaaggactcaactgggaattaggaatctaacatcctggaaatcaaagttgtcccctgttaatatatctgcttcatggttattttacaactaatgaacttatataaaaatcagaaagcctaggttctggtcttgggtatattgctaattactttgggaaagcatgaaactatactagccttgtaaaaagaagtagaaaatgtgtggtttttaaagcacttttcatagataatatctagaattcatcttcctgatatcatttgcaaagtagaagtgaggagcataccccttcttggacatggctatgaaaaccagttaattcctttttatgtaagtaccttgaggtaaacccaaagtcaaagcccttggaactcatccaaatagcctatgcaaaaattcatgatggagtgctgcagagcttttaaagaaatggtggtcatcttctggaatgggaaaaagaatagttgatatggataataccatagcattgcagagttctttttttttttttttttaagagaccaaatcttacgctgtcactcaggctggagtgcagtagtgtgatcatgactcactgcagcctcgaactcctgggctcaaacaacactcctgcctcagcctcccaagtagctgggactatagacacatgccaccgtgcccagataatctttttattttttgtagagatagggtctctttgttgcccaggctggtctggaactcctggcttcaagtgatccttctgagtcaccaggatttcaggcataagccaatatggctcagcaaattcttcatgttttcaaaacaatttttttatacttcacaataacctgatttaaggatacttcctaccataatgtacctgaaaaatatgacatgctaaaatgtgacagaactcctgttttcactgtcaacctggcacatgacaagtgttctcaataaaggtttgctgaatgaatgaataaaattattgagtgagtgggtaacttaaagccttcaagtaacacacagttaactatgtttatttggctctccctggccaaccccagtaatggttgggtacaaagaggaattggggtagataatgttggccataaaggatatgtaatctggttatattggtagttctgctgtcttgccatagaaaagggagccaaagggttttaactagagctctgtcaccttgggagaaccctcgggaaagaaccactgtccaggctagcagccacagaagccctagaagatcacacagtgaattgcttagcttctgctctcactgcagtgccttttacccaaaacaaactcttgttttggtaggagaaacaagaaggttggagttatacccaattctagcttcattctaaattcccttgtcaattattattctaattggatgaccctggacccctaaatctcagctcccctccttgaaaactgtcaataataatacctaaataggttgttgtgaagattctatgaaacattaatacaaagccagagctaaagccctgatacacaataagcttcaaaaatggtagctggcatcatcactatcatcacccccatttcaagggctctgggagtttcctggtatgaaacagtgataatgatgcttactgtttaaggttatagaattgaggagactatttgtaaagggcctcttgcgatgacaggcacgtaatagagaaaaaataagtattggctcctttctctctcctttcttctatgatgtcttcttacttttctactttagccgaggtagtggtacatcattactctttcataaagtgacacaatgtcattgaggaatgctcaaaaggccccagcagatggatgctcatagctggttgaagcagagttaggagggtagcatggaggggaaggaggaatgagcagcactcgggaatgcaagacagatcttttctgccaaacctggatgcactggaggctgccatcctaaagcttttgtgaagtttctgcctgtttctggagttatccatgtaatccttgagagaacacttctgtttgcacaaatcattccatacaacgtaattagctacttataatacagaggacacttgtgatcccaaattcaaacaattgcaaaagcaaaagcagtttattcatggtggtgtacaatgataattgataatgagctagatgactgtgaggtgctatggaatctcaaagactcttctgaattctcaaagggagttcaccttattcataggatgactttaggttagcagaaaataatgactttaaaaagtattataccataacaatgaatacattacttatattgttcatgtaattactagttcttcaaaaaccaaaatgccaaatttacaatgattagaaattaatagctaacaaaaacatcacactaactcgatgccctttatttgccaatgattctagctaatggagagtttttacttgatgtgctttattttttaccttctgacatctgatccatgtagaatgaccagccttcctggttttctaggaaccagctattttagcactaaaagtcctagtgaacttctcatttctaggcaaattgggatggctggttattctacttgaagcacctggtggacctcttttcaggacagcaccatgtttagactaacatctgactgacaactcaaaacgaaaagaatctctggttccagattatttataacttttggatcttgttgatgaagaaaatttttatgaaaaaagaaaatagagttgactacttttctatttatttaaataataacattaacaaattttgtctatccttgccatcattttataagacaggaaattacaaaaccaaaaaagtagaaaggagtagaatgtaaattttacaagggttccagagtgatgtgtttatcactatgttcccagtgcctagcagtgtgtggtgtggcatagatcctacataaatatttgttgaataaatgcacagtgcataaatttagcttttactacaaatgtactacactcttcttatttttctttctttctttcttttttttttttttttgttgtttttgagacggagtctcattctgtcacccaggctggagtgcagtggcgcgatcttggctcacggcaagctccgcctcctgggttcacgccattctcctgcctcatcttccagagtagctgggactgcaggtgcctgccacaacacccagctactttttctgtatttttagtagagacggggtttcaccgtgttagccaggatggtctcgatctcctgacctcgtggtccgcccacctcggcctcccaaagtgctgggattacagacgtgagccgctgcacccggccatttttctaaatgtattatagattgatgaaaactttcccttagaccattgcttggggatcaatagttgaaatctaagtctgtggactgtagagttttttgatagtaagtttttattgtaaattattttaatggcattctgttgtttatcctagtctcatgttcattatagttggtgtggtcaacctcccatgagataatcattcagataagaccaagtttccgggcctgtaaatcagagaatcaggttcatttaacatcctcttagatctcaacttctatcagtagcaagatacatctttgcagatacctacatggagatttcactacatctggcagggatgagccaccggtcctcattttcttaattcctggacaaggtttttgtgtattctaaccaagtattcttgcttttctttgttctgattcattcatctacaaagtgtggtcagaaaccttgaccaactgctgatatatacaaatatcacaacttctctaagtctgggatctcctaccacagttgagatatccaaatcattcacagttttgtcataactcgtggattaaaaaaatcattgataaatcatatccggtatttctgaagaggtttagaattttggtttcatggatagcataggaaatgtaaattatccatcacaaatgtctttacaagttacaaaactaaaccaatttgagtgttcatttcagagaggcttaatactctcagttttgttgtttcttttaatcacaaatcaactaaccatttccctttctgcagctaccttgcacaatccctgagcatatttctgaccttagccctctggtgtcatagctctgattctagctgtttggctttggatggggttgttggggtgttgcagcatctgtaaatggttaaaggagcattagactcaatgtatcaggctcatgcctgtaatcccagcactttggaggctgaggcggcaggatcaggaggatcaggaggatcaggtcaggagatcaagaccatcctggctaatttggtgaaaccccgtctctgctaaaaaaaaaaaatacaaaaaattagccgggcgtggtggcggctgcctgtagtcccaccttctcaggcggctgaggcaggagaatggtgtgaacccaggaggcggagcttgcagtgagccgagatcgcgccactgcactccagcctgggcgacagagcgagactccgtctcaaaaaaaaaaaaaaaaaaagtggatttccttatttatgctctcataattaagataattttagcatttatatcgtgtagtgaatatacacaattcccatgatttttttcctattgttttatgatccgtatttatatcccaaagtatatggttaatacctctaagtttttgctgaaaatctagccttgttgagcagatacaggttcctttagcagctggtgaagggtgcttatactttaaaaaatcagataatgtatgtgaaagtggtttggaatatgtgacatgctatgcaaacgtgtatttttttttttaaagaaatgaatagctcgtctcccacaggcatattattgacaggggtctttgcaaaagatacacaaacctaaataggaagcagcatgatctaatggaaagcatatagtctttggaggttaacattggcttgtattttggatctgctttcaactggaaatattagaaggatttagtcccttctgagccttagttttatcatttgaaaaatgggctagtaaaactttatttcacagggcttttgtgagggataaataagaaatatacaaagtatcctaataaaaagttctcatttcagatgaaatatgagcatgtagatatgctatctctattaataattcatttgttctgtgttgttttgaactcttgtaactttaaatcactaaaacaggttaattcttgtcaaatgctatttacatcgtgtttgtttcattgaagcataatacaggttcaataaatgttaatttcctgttctttgtatgctatagcaaaaataaaaaatcttctgatgcttaaaaagactggtaatagtcggctgggcgtagtggctcacgcatgtaatcccagcactttgggaggccgagacgggcagatcatgaggtcaggagattgagaccatcctggctaacacggtgaaaccccatctctactaaaaatataaaaaaataaaaaattaaaaaaaaaattagcctggtgtggtggcgggtgcctgtagtcctagctactcgggaggctgaggcaggagaatggcatgaacccgggaggcagagcttgcagtgagccaagatcgcgccactgcactcagcctgggctacagagcgagactctgtcaaaaaaaaaaaaaaaaagagactggtaatagcctgagatgaagaaatgacaaaaatgaaataaatactttcttctagttttatgcaccatattagtactataattgaatatgcaatcactaaagattttcttctttatttaggtttcttgaatcaggtcaccgatttttaagtctgcatccattttagagaactctccctccccactccccttcaacatatcccatcctctttcacctatccattcagattctttcatttaattatttcagaccctgggaattagcagtcccttcttgaaagcattggaatggggcagttttaatttttattagtatcagctttctcctcctcactgccatatttacttctttgggaggaaaaggaagtgcatatgtagctataaaagaagacatagcccaggtttctaggatttgcacctccgcattggcaaattttcccagtctgtgtctccaaacagggttttaatcacctgggctcttgtccttggcattgaaagctttaagagtactgcagaaatggtaaattaaccacatttaacaaaatagaaagttttcattgtgtcataaaaagccctattgatcttgttcaggcattgactccaggtccttttaacaagccactctgtctagacttgcaggctagagcccacagtgctaacaaaggaggagctgggctgccctccctccccctgcaggggaaggctaagaggatgggcacagattcaggcttctcaatggggattttcttaaagaactagcatgattttattctgctgtggaaaggaaaagcattaggagacttgtggcagatgtacctgtcacttactccagactccagccttgtttgactctctgtgtctgctgtggaactaccccatcataacagattaacgtgtcttccatatccctcagcttccagcaacatttcctcctgttgcccttaggaaggtaggctgaactctgatgccaacgcacggagcagtgggtctccagaaagagcgtggaaagcaacgatggggcaggaggaggaattggcaactttagaatcactgtgaccaactcaacttcatttcaattcaattccacaggtctttacttaacaaattctgggtaaacaggagattttgaaaaggcaagaaaaattgctgctcacagcgtatggttaaaaagttgacatccataaatcaaataaccaaagaatcattcaagatttattgggcggttagacgttttattggcagcagagatttaacttttcaaaaaatgatgaagtatttcaaacataaaacatgtagaacctatagtagaggatattgcaaacattgctttacccatcactcagattgaacaaatcttaatgttttgccatttttgctttatatctttttgtaaagacttagtcatgttcgaataccttcctggttccatttattctcttcctcctccaaagtaaccactacctgaagttgatggggagattttctgtatacatatttcttattcttgttacatacaaatagagctgtagtatcaaataattagtgatcactatatagctatgtgtatgtatgtgtatatatatataaattagtgggggtcaattttatcagcccctcatcatttatattcattattctctatatattctgggctgaaggaaggacatgttaagtaaaattctttaataccttatacttccctgttcatcacccaagcaaaacttggtaccacctctagatcccactttcctgttttaggatcagaaagcatttggctcctaaaatatctgtaggaagtttcacataatatctgattgtcttgttttctctagatacttaaaggtggggagttttaccaaaaatataatctaattgcagatttattaaggcaggaagtagattacattgtcttctaagatttcttctgatactatggtgataattgttacagagaattctttacttgttttcatcttgggctaaagagatatttgatagaaataaacattttaaagttcatatggtaaaaaattcatacttattgctttgaaatatctaaatatctgtatgagttttcccaaattctgtaaaccttcatgacttctatattattttctaaacatgtatgtgtgaatatagtgagtatctaattttggtagcaattagtgttgatatgtgtgctactgtatataaaaaacatttcagatgctctactttgggctctagattcattgtggatatttttcattattattaattttgtttgtatgaaaattatacaaaaatatacagtgttactagggacacagacctctcctctccagctctgtgtccctcctaacatttttgtccttatgaagtccacagaatgtagtgtgacagcatggcatttgctattccagtataatcgccttagttattgagtacttttgatgattctttttggtcttggccaagggtgaaaggatatgtaagtttgtgagtatgtatatattgtacaattttttttgttcaaaaacttcaaaattctatgtgaaacttatttataggaagtcaattctggttaagttctccaccatcctaattacttatatactctgtgtaacttcaggaaatgtatttttaggaaacactgtaggctagagctggctttgacattattgatatattttcttgtcattgaactcatgtggctccagatgtgcctattatccctccagtcacagtgaaagcaacccaaggaccagtttgatatcctgaatttctcctgatacttttattttggtgcctatttcaatatttgttgagcgctgaggtgacaaccataacatttccctctgatttctgaactgattgtgtaatagacataagagtcaaatcataattgtgtcaaggatccaaatatcagttctattgctggtagagttagagcatgtggcttttactgcagtaaaattgggcttctttataatttttcctttgaattaaactcagctactcagcaacagttagaagagccagaaaactgcaggccttcttccataagggcagagtttactgtggtaaggattactgcatgggactgcctaaaggagaactcacaagccttgtagaaagaaatagagtaaaaggcaggtcacctgggaatagtgactatctaattacgaaatgtagaactagggtatcagacccttactacagcaccaagcagatgaatcactgcaggagaatgaataaaggagacatggtcaaagtgttactccaaaatgatctcttctggggaatggggaggaaatgttctcgtggagtcacgggggcaggaaaatggattcccctctgtaagacggagtgcactatttgtgttcaatgcttgtttgattgactgacccataattaaaatgagaaacgaatactgaaagaagcataattacagttttgcttatatggatctggtggttgacggaaagtaaaatatacagtacattacataaattattgtaagtgggaagacaggcatgtgcagtacaattggcccaggttgtgtatttctttttttattttttatttttttagcaatatccgtcctatcttagaaatgtctcctggatccctatattacataaattattataagtgggaagacaggcagtacaattgtgtgcagtacaattggcaaacaattggctcatgttctgtgtttttttttattttttattttttagcaatatccatcctatcttaggaatgtctcctggctccctcttcacctctctagccatttgtccacccactggacccctggtacaatacaagtataattgtgccactcattagctgaatttcttctctgctaattccccatccccagtgctcaagaatgtagagaaggccccagtctgcatcttgagcctatacatgtgtccattgctctagccaccttgcacttttcaccttctcctaaatactctgtgctcttctaatgaccacaccaatggatatgctgtttcttctaattagcatttcattcctccctttgtaggtaaactattcataactcaagacacattttaagtatgacctcctgtatggaaacttctcttatgcccagggtcagttattccctcttctgtgtgcctatatcacctaccaaacccttactacactggtaattatttgcttgtgcataccttctcaacaacaatgatagctaacacttctatggctgggaactgggccaagaactttattgtattcctgcctcacagcaactctatgaaatatgtactatggttattcccattttgtagattagggaaagaagggttagagaagttaagtaataagctagagttccatagatttagataagtttcagagctggctgccaaacccgcatctgtctgattgaaagcttttctcatcacagttcataatgtaagtccactgttcaaccaggcagagtgccctgttaacatgaatccgttgtcagggcctggcacatagcaggcattcaaaattttttagctttacaatttcttttttttgtaaaatgtcagctaatgatttatacttacaaggttgccatgtgacttaagtgcattcagcactgaacacattacctggtgcatagtaggcacctgtgaatctttactttttaagtgaataaacaaaaatgtaacttttattgtaatgcagttgacagcaattcagtctttaggataccattagctttctagtgatttcagtgaagcgtggttttccaggccattcttctgtggacggaggcagcttccctcaccaggatgctggctgtttattttccaagtgacaagttgatttactattttccttctcatcactttcaagaagcatctgcaggctagtgagtgacccaggcagtgtggaaaagtctatttatttctctgctgcatctttcctacggagagtctgaggataagggttggaaatggcctcaggaggtcagatttcctgtgtattttcttttgtagtgcaggattgctcagggcgacacaatttcccgtctgctggtacactctgcttttaaaatacctgtgtgatgggatgtgtcaggtaaagaattttgttgtttgtccttgggggatggctctgcagcttgatctctcttaatgctttctttggccctaaaatacattgtaagggaaatgagacagggagagccaagagtgcagttcacttgtgcaatcttttgccttttaacacaatcattctgttcctccctaaattctagcaggaaatgtcattaagtgtacaatagaattcactccactaaaagaatttctactttcccctcacttttgcaaatatgatcatctcacagctcagcagataacttggatgtctgctcacagcttcctaagaggctcttagaggtaggtgttcctgttcagtatattggattcttagcaggttggatagtaaggaaacagacttgtagaggaacgaactcatacttgccttgttcttttgccagcaaaatactcaaattgctgttttagctcaatatacctttcagcactgagggtatatgcagcccctccatcccccaggaatgagtagaactgtgcaatcgtggacttattccctagacgtttctttctgcagttgtgtactcttttgccttggagccattacttcttttgtcattactgaggcttctttgcctggaaagcactggccagaattgggtgatctgtgagttcacgacttgagaacctccaacctctgattgcagttgcactggtggagaaggcacaatatagcccctgctgggtttgtcttcacagagagtaaatgagttcacaggctggccacaagaccacaggccatctctttgcctagcaggcaaggcaatagtagcccacgtgtttttgtgcctcattagtttccaggtgggccaggccaggatgggcagccaggttatctttgcatgaatacagactaaagtactgcactgtgctgctgtacgagaccaatttgaaggacaaaggctgcatgctacaatgagaacaatttcgctgtgtctctgaggctcatcatcaggaagctggctcccactcctttctggagctcagcaggtgttcttcacaggaccactggctacagccacttcagaggggtcagcattttaacgggctcttctaagtatctaaaaattccatttctaaggctctctgttggaggtaaagagtgttatcttctcagattggcttttttcagcttgttgttgagaatttggaaagaaagtcaacctactcccctacttgcctgctttgtttcctgctgcctaccagggctcttgtctaccattgtcagtagttttacctttcaacaggttgaacctcatgcagctgcagaatatcagatatagggtgctaggcatctgctttgggaatctgagttcctggcaaagtagtggtatggtgtagtaggaaaagcaatggaatgaaaatcatagcgttacagttttggaaatggcactccgtagtaccttgtatgacccctgtaaactctatgtgtctctatttcctcacattggtgtaatcatagtaaaatgacctcacagaacattgagaggatacaaataatgattaagaaggcatttggaaatccatgacacgtccagatgcatgtaaatacctgcttgcaaatggccctagaatccttctttatcaatgtctgacatgttttcattttcagtcctttcttgactaattctttgtctttttctgccaaattttgcctttggtctttggctttccaatgattgcatttggatcttaagtatccacactttggtttcctcctgtgttctctggcttgctgtgcctctgcctctcttaggttgttctgctaggaacttctgcttacattcttgcccagtgaagtgtaaacctcactatatccaggaactatatcaacatctaggctgaaccagttccaggcaacccctgaaaaagtagttcaaatgtatttctaaaagattatgcaatctcttaaaaatacaggttgaatccttctatccttctcagtaaaattatgcaatggttccccataacttatagaagttcaaattttttgcccttaaagcccagtttgggtttttaagacaccaagccattaggaatggcaggcctaattaaacagttgcatgcattttccccacacttcttagattgcatagtaataaaatataacactgagtattttaatctgctttggaatttctcagagaaatagagtgattattatataaattataagttgggtgtcttttagggggaaagaagtgaagaacagaattaagtaaatgcttattaatactaagtatatatcagtattgaattaatcagccatttgaaagatcagtacttcatatatcttatacaaactgatttaaaatcttgagttatacatatctagattgcatctagtgtttaatcaattggacacttacaaataatggataaatgatttgttgtcatacagagttgagctttgcttttcatgcagtgagaataatacttttcatttttacacttatgcagttgattgtaaactttgggatgatataatttaaatggatctaaacagtccattagctatgtcagtgcctcctctcttgccaagctatagttttatgctaagctgttgtgtactgtattacataatcccctgcattcattttctccacctatttagcttgaataaatacaaggtgactgcattgtctcttcaacctacttctcagtaaaaacaccaagtataaaaaacagatttttgggtgctattttgttttttctaatggaggattcaaaggattgaataaggttagaaatgcatgtttgtcactatttggttttgccccttttagttacccttactgtcaacttagtatggttttcaaggtgataagagagtggttgagtctcagctactggaaggaaattaagatagattggaggtcttagaagaaaaatcatgtcagttgtgcaagtggacaaaacaatgatttcttcaaggtcctcatttttttctccttctcctttctagcccttgatttgctcttttaaagactgggttattgggaggcagagcttgcagtgagtcgaggtcgtgccactgcactccagcctgggggacagagcgagactctgtctcaagaaaaaaagaaaaggactgggttatgcattgctagtgcctcttaccccataacatgtaggggaaaattattccatcacttgaaaatgatatacatttgcttatgtaggatacgattcagagagaagctttcagttgtctattgtttgttgaccaatggaggagatatcccaacatggtaatgctgatcttggtagcctcctctgactcagggaagaggtaaactgagaaaattcttcactggatgaaaagatggggaaggttgtgaatggttacagcaatttctgttaaatatttgcaaaggaaggcacttggccacataaaatcttcttcggtatagttgcatggagattagcataaatatgcatgtgatttgcataggccttttcttcctcacgttggttttagttcttatttatttatggtgatattctcttctctacactgatgccattttttcccctgtggcctcccacataaaagaagtgtttttgctttaaatacagatctaagggctgaaagggaaacatttcttttggtgaatgagtgattcatgtaaggtgagaggaattggtttctggctcaatttattcaaagtttgggatggtttgtcagtcaatgcacagttccatggaatcatctgtggcctttgacaagacaagtaggagcatctggaatatccagagtgatgggcaaagggaagataatgaatatttagactaagaaaagaccagacatgccccaagcccagagtaccacaaactaactgtgatgtctcaggcaactcacttatttctagtcatcaatttcttccttaataaaataagggcattaaatcaggccatctctaaaatcccttatagctctaaaatttattattttgacagactccttgctctaattatataaaaaatattaagcaccatgtagcacattaaataatatctggtgccttgctgttctgtcaaacttttcccctttgaagggtactggatgattaatttaagcttctctttataggcactactttccttgctcatttttctcagttcagtgggcacacaaggtataacttaaatgtttatagaagacacccattaatataccacttgcggtgccaaggacatgcacagtagttggctttgtggacatccatgtctgtagaaaaagagcttagttgtgataacgccatttgatttgtcaccttctactctagatcagggtcacctccaggtctcctgagcagggccttgtccaattgcattttaacaaagacgattcttcagaaatgaggggagagatcatgacaatagacagaacatttggggagtggatagaactacttcaaacacgcagacagtgttgaatttctgctttattatttttggggggctatttctgctaaaatccagtatgagttatgggctaactacttatacatgtgcaagctaccctgtgagcatttataggtgaacaggtctcttttgcttataccaatgtgtgtgcaagcagacatatgcaggtagatacatatgactgggctgctctggaacacacaagagaaacttgatctcttctttaactccctggagtatgaagctgaggctgatgttttaatgatgtcataatgctaagattaatttaacaatatgtagtgggtagaagtcttttcacattataaaatatctcctttttacagctcttactttatgatgaaaaaatattcattttgcctaagaaatttacctggggctgtaatggttaacacagatctgagttgaagtggacttggctttggttaattagcctggagtgtagttccggcagggaaaatataattctctcaaccttattttgtagcctccaatctttagagggaaactgtatacctcaactattgttgccattttcttttagtaatgaggtgcttttgatagcttttgaccaactctggtatgaagtagaccattctaagtaaggctatctggcaagaagacaaatggaaggtcataacactgtgtgtcaaaattatagatcgaatcaacaaataattaaataaaatatatttcaccctcttaccttgacaaatatacctttaaaactagttggaaagccaggctcaaatttagagtttttggattccttggagttctgcattgggaaatagcagcacaaggggaaccagccaacccctagtcctcaacccatggtctactcccttctcttcccacctttggctttgtcctatatcatgaagggtctggtatgaatgcatgtggttgccccagcctaatggagaagccttatccacatctctgcaaatagtctcccacggctactcctcagaccttgcaatatgtatggtttgcctttagaaagatggatcaagggctgggtgcagtggctcacgcctgtaatcctaacactttgggaggccaaggcaggcagatcacaaagtcaagagattgagaccatcctggccaacatggtgaaaccctgtctctactaaaaatacaaaagttagtcgggcgtgttgtcacacacctgtagtcccagctacttgggaggctgaggcaggagaatcgcttgaacccgggaggcggaggttgcagtgagccgagatcacaccactgcactccagcctggtgacagagcaagactcagaaaaaaaaaaaaaaaaaaggaaataaaaagaagaagaagaaaaaagaaagatggatccagggaagaggcctgcacaagccctgaaaaacaggcttaaggctttttgggtgggcaattacagggtcccagtctatgaaatattgtcttgaaagagtatatgggctccagtagaatgcgatcttggccccatggaactctagttctgtggggaaggatagttctgtggggaagaagagaatgccgtcctggccctgtggaactctagttctgtggccataggatagtccaaccagggtcttcaaaacaggataccctagagcagagagtcttgagtttaacagtggtattgctgtcttatcaaaacatatcaaattaattctcttcccctctccttacctgctgtatcacctgctcaggtccaacctcctacttaacaactcagccatgttccagggggcttaggactgtattatagaaaccaaagttagctgagttattgacagatgaaaatcccagccagatctttcggggtaatttatttttagttattggtcaataaaagctacctggagctagagagtcctttgtcagaacagttaattatccattctaaaccagctcttctacaagcatttaaaagcaattcctgaagcaaaagcaactcgagcctcacttgatcattttgcatgaaacctccctttaggtttttcttgagaaaattcgaaggaaaggcagcaatctcttttgcaccatcttgttttgtcttctaccctcgtgtggacacgtcgtttctctgcagtcacccctgctgctagtttccctggtgtttcgatataggacttgcagaagaattgaagggagtgctgtgttggtatcagcacaagaacggggcagtgcccctgcggtgtgttctctttggtatttgcataggtctgactcttgccagacaagtgctgattgctttcctcttttcttttcctatagctcgagaggagaatgtggccactttccgaggctcagagtatctgtgctacgacctgtctcagaacccgatccagagcagcagtgatgaaatcaccctctcctttaagacctggcagcgtaacggcctcatcctgcacacgggcaagtcggctgactatgtcaacctggctctgaaggatggtgcggtctccttggtcattaacctggggtccggggcctttgaggccattgtggagccagtgaatggaaaattcaacgacaacgcctggcatgatgtcaaagtgacacgcaacctccggcaggtaatggctgaggggagagaattcctggaaggctcatcttaggtggctgggtagtaaatttgtgaagcaggtgatgggtgtgaggtggagaggggtggagattcagggatggagatgttaacgtctaactttctcccagtctttgcaatttcacgtggaaaattattaaaatatgtttctccacatacttcaattctctctctgtgcttgttatttaagaaaaaaaaaaacaactcagttgtatagataataaaagttgtaagtactttcattccttttattctgctttcctttgatcattttcttaattacatttgaatcttatcgtattattgttaaattcaattagggactgcattttgtttctgcagcttcgtagattttcctcattctttgaatatatgtttttctttttaattaagttagccattgccacgatgccataattttaattccttccagaaaaagtcttccttttcctcttttaatttactaccctttcccaactatttttttcttttatgttaacctctagctttggaattaattagccgggatctttctgaattcctctgtttctctgttcttgatgcggtggtcctactctattgcccctgtctctccctccgagactcttcagttgactgggaggcctggaaagtggaaggacccaaataaaaaagtcaactttggagcagcctttcctggttctgtccgtgcttgggaactcccatcgcttgccgattctaagcaggcacctccgtcaggtgacaacattctcagaaagccttagccaagtgaagttgttttcaatttcatgactaataataatgataacaataataatacctcatcagctcacatcagtaaaagaaaaccgtttcctataaaaatcaaagtctgtgctgagaccgccttttccaggttgccattttcacttggtttttctatttgcgaatctgttgttaaacccagttggatggcatccaggctttattaaccagaaaacactatactttctgaagtgcttatcaaaaagtgcttaccaaattttcttctgccacatgattgatttaatgtcttctaatgtcaatgtgaaagcgtaagaaatgataggtgtctgcctacgttttctgtttgataaaagtgtaactccttacgaatactaaacaaatggtataggctggcacacatttgaaacacatttccacacttaggtatgtcaaggaagccatcctgttgggagattacatttatctcaggtaaaaatgccaaatgacacaagacttagagtccccaagcatcttgacattcatgaatctgatatttttgaatcattgttctatgtttttcctccaaggccaaagaaccctattgctaatatcttctttcgtcattcctcatccatacttacccaggagagaacgtctcaactgtcaagagaacccaaatcaaatatccatttgctaacacataagggcttgttacatgagagctgcagagactagacctaaaagtgaaatacaaccttttgctagttttgattggcaggtacaaaataacacgctttaggcattaatcagtggaggagagacttttcatgtacttcagagcacaatcaggtcatgattctcaccaatttgtttctctacctctctcccaccacccttccttaccattctggaatgattccaattctcctgtgaaaggctcacttttgtttctactaaaaacacttttctaaaatagtatcaggcacacttaagtcctttaaatggagagaggataaaccaaactgtaattcaaatattgtttgtgctgttttaatcagagcagctagaggaaaactaccctggatgtttttcccgcccctgcccttcatgttctaaggcccaactctgctctgtgcccttgggcaagccatttgacctttctccaccacagtctccatttgcaaaatggtggttacaatcttccgcagccatgtgtggtggctaaatatgcaaagcaccttatgttccagaaggattatgagctcatccatggtctaggtatagacgtgctgtgacgtgcacatgatctacaggctgagctttctgtttcaaaggtgactgcatctgtctggcaccaaggatgcagctaagtgcaattctctgttctagacagggatacagaggccctacagtattgggggtatttcttggcagagggagtattaatcttctgtgagaaagtgaacctaaaattgaacctcattgaaattctgactaaattttgcatccaaatgcaatttattgaaagaggaaaatctctgaaaagcaaagttgattttgcaaatgcaattattttaatgtgaataatataagattattattttgtccattaaaataatatttataacatctatttgagttccctgggatacatttgaatggtgggatcttcctgtctatttcaattaaactataaagagctccataaatatttgacaacaaacttatagcagccttattcatatttttggtaagattgaatggcttttatgacaaaaattcattgagtaaagtttacctggggtttcccggagtacttattaccaaatggagcagaagtctcctcatttcttccttcatgatcatctattcatggttttgcctttaagccaggtcaggaccaaggccaggtattttattgtggcttacaattaaaggaaggaatgtggactacctgtatctattgcaaactataactgggattagggaccaaggtagtgaggaatttgtgtgtttgtatgtggtagtggggtggtaattggtccttgacattgcctgagtccaaggtcatggccataactttcattgctttacctctatgtgttaacttttgttaaatcacaaacacaaaactgaggttaccagtcttccagtcttccagagggtttttctaatcatgtttaacctgccagtcttccctgctatccatacaataaattacataaaagcttgaaaagcattgttcaagaggaattgggggagagagattccaaagcattctggccaagtaaacaaattaatgaccttattgagtaataaagaagattctaattttttttgatacattctattaattctaaactgaaggaaaactgtttctctctggttgcacacatccacaaaaatgaaataggctgtagatgtttaattatctatggaaacctagagtacactacataaggcagactttctatgctaggtttgatctgtaaatgctttaagttttttcctttttgggaggatttcatgatcatttatccacattgtagtcatagtcagatgtgaaaaaagtaaaccccaaaatatttgtatttcagttctttgtatctgtttttctacatgtggaatggtacctgttggggggtctttccttttggaagaggtggaatgggtttgtgttagagggtgggaagggagtgggcggtgtccattcagaaagcccttaggaagtaagtatggtgctaattctaacgggtgaggtgtggtctgagagagatttggaagaagcagggagctgcaatggcatgtagactgcagctccttttctggctgtgccccaggtggcatggttttccatagagtcctggtctcattgtcttccccccactctctttttctgtgtcgggtgccttttttttgagaaactaacacaagatcattcatgcaatgtgtcattttactaaccgactaatgtactaacaccctaacgactcatctttgtttttagtttttttaattaacaatcgttctgttcacaatttttaatttcctttcttcccccttctccgcaaagcactcaggcatcggacacgctatggtaaacaaactacattgtctggtagatatcattcttattgtctctttttttgggtttgccgtgtgttgccccccttttcctctccaacccccccttttatcctctttagactcatttcttcttttaagattttgttacattaaatgcaagcctttctttttcttaaaaaaaaaatggaaggggatgcacttgtcctaaaaatgatatttggttgaattttgtggggaaggtttccttttctctagttttcaattttttcccccaaaaaatgctttttttttttttttttaaatctctatttggctaaatttgttttcttttgttttcttattttacaacttccaagttacatactagggacaacagagatttatagtgagaacttccttctttctgtgccttcctctccctctcactcttcctcttttctttttttctcctttcccactccttagtcccttttctctttcccttttatatggccacggctgccacaggtgatctggggaggaaagtactccacttcctagactctttcttacccttcttttactttactcccctaccgtggccaaaaggatatccaccaattatgttctccatacaaactctgcatggcatgttcctgtctcgtgaattttcctacctgcatcagaatttgtttcctcattttcctcctcattactaacaacctaccaatcatcaacccaatttcagtttcttctcttttatttttccccactcttcattctcctttcatctttcatatatttgggggttgggtttggactttttcttttcttttcttttcttttatttagtaagggaggtggcaggcagagaaaagactaccttttagttttgaatgcttttttttcacttccatcttgttcttcggtttgttcaatgcatgtaagtgtgaagtggattttgattctttccctaatttctccccaccctttcccagttttgtttttcttctgccttctctcttggttccagataatttctgcatgggtgtatcggtgtatggtgtgtgcatgctttgaggccccatcgtttctctctgccctctgctcctttcatggatgttgggtaaaagggtgctatttcttttctgtgggcattattatttttattgttttggttattattcctcatcattcattttattgttgttcttagagttgcctttttggtttgggtcatttcttctcttggaggtggtgatgggagccaagggagggtagggattggtgtcctggggcagtccatggcatgtatcatccatgaccatatcagaatcaagacccttctccttccctccctgaatgcatgtttgtcagcgtggtgtgagccaaaaaatattaataacaataaagataaaagaaaagaaaaaagaaaagaaaagaaaaaaggaaaaataaaaccatcaacaaccaaagaccaacccctaacaaatttcatcatcaaatgtcttctttgctgtttttcactaccaccatgaataacaatcatgtaagaaataaacaatcattttagcaatgaactgagacaagtgatatcgtctgaggatggttccattttctagcctgactgtgtaaagattgcaatgggtagaacaaggtgcccagcttggaaattctaacaaagtcatccatgagtctgcagggaaatactgaaggcttgagacccagggaggcagaccagaaaatggaacttggctgcacataccaaaatcaaatcaaattagaaagtatatctcatgaaaatcttaatgaaagtgatgccacaagtaggggaagccactgggttatgataggatcgtaaggtcattgttgggattttttttgtccctatgtccctccaccaggtgacaatctctgtggatggcattcttaccacgacgggctacactcaagaggactataccatgctgggctcggacgacttcttctatgtaggaggaagcccaagtaccgctgacttgcctggctcccctgtcagcaacaacttcatgggctgccttaaagaggtaaagttcacccaattctatttaatgcaccatgtgattgtttcatttataaacaaatgacatgtctaaatcaatgactggatctgtcctcaaatctatgagatgatagattgcagcagaaacaaccttgaacttggaagtaggtgtcctacgttttcattcccgcttaagctggttgcatgacttggggtttgtcactttagtactgtattagtctgtttgcatgctgctgataaagacatacccaagactgggtaatttataaagaaaagaggtttaattgatttacagttccacatatctggggaggtctcacaatcatggcagaaggcaaggaggagcaagtcacatcttacatggtggcagggaagaaaaacttgtgcagaggaactcctctttaataaaaccatcagatcttatgagacttattcactatcatgagaacagcatgggaaagacctgaccccatgatttaattacctcccactggcttcctcccactggctccctcccacgacatgtgggaattgtgggagctacaattcaagatgaaatttgggtggggacacagccaaaccatgtcaagtaccctgtagttctatttcctcatctaacaaatggaagctcttatcccacagatggctgtgtttataaattaaatgcagtcacacaggtgaaaggccattgaaatcacaaggaactagatgagtgcaaagtttgattttgtgattttgacctggcaaataggaaagctctagctaaaagtggctcaatctgttgttgtgtaccctgtctaaaatataacatatgtattattttaccttcactaagcctggtgttcccaagggtctcatagttgagacggaagaaaattcttataatgtgacattaaggctcagaagactggttttttcctttgcttcttcttcttccctgagagctagtagctgtgaaaaaacagtgggactttgccactacttgtttattaccattgtagctgatgtattgagacctctttctgagagcaaaggagcttcagccaagtgtaagttcaacctctaaggtcaattgttgaggcaaaaagaatcagactaaatttggtagagctctttcagaacactgtggcatcaaagcagtgcactgcacattttaagctaagcttcattgccgaagatatctataccatctccctggggatgttacttgagaagcaaacagtgttccttcttgtagataacaatcccttgtgacatcttatgagtctcctcttggggcatatgttttattcttactatggttatttgaaatttgttgaacatcatttgtatatgagatggcactgtccatgcattcattcatgccactgccctgtgagccttgtccaggcaggaattgtgtctgttaggcatggcacatagtagatgcataataaggatttgtttgtctatttatctgataatcattgagtaccttttttgtgctgtaactaaatttggtggctctttttaagccatgatctccatgctccaaggctttgccttgtaggaagggagatgagatcagtgagtgaataagtatagcataggagtacatgtgttcagtggcacatactaaatgctctaattgagtagaggaaacataaattttaggtggaagtcagttttagagaaggagtgacatttgaggcagtccttgttgtaataaatcatgtgcgaattgagaggaaggggtagaaaagagagacataataaaggagagaaaatccaattgtagctttgtattgttctcagcctgtaggacaaaataagaggagcacccaaagagtgctattatctctctgcaggatgttacctaggcttctgctggcttcagagatttcatcgtcatttctgatggaattatggtaggcatagagcccttcctcactgggatttactcctatttggatagaataaaggtatagactatgcactgtctagtgaaccctgaaagactcttaaacactgttaaatcacactacattggaattgcactctcatcagaaaaagactgcaacattcttgttaccaaggacatggctcaggaatgaatgaggcattggttgctgtggagtgctcattcagttttgtagtgcaacagtcctgagcatggagtctctccaggacaggatttaggtcttgcctttaggattaattttctcctacacacaattatattgagctacctctccattatatacttagagacaatggagcaatttcccaaccatgaatcttctatctattaatcaggaaggatgccctgaaaattttgaaacaagtctcataaaaacacaaaggtgtctctgatgactttatccatgtggaaacaaaagaaaataaaatacacacacacacacacacacacacacacacacatttttgctgcccagatagagagcagaaagcttcaaaagtctgtcagaatcattctgaatagcttaaaaggtaaaggcagttctgaaaaacagtgtcaataatagaaataactataatcagtgatgtcaatatatccttatcttagctagcagcacaaatatgcatttaaattcagaccaagttagaaaaaggaaagttcaaaacactaacggaaatgataggcaaagctagaacttgataaactcctgccccgtctgttttccctgtacagcgtgatagtctttctaagggactcggaagtcttcttatttgtctgagtactttgaacagatcactttgagtctaacgtagtgctggcatattatttctttgcatttaataattacacttcacttttctgtgggcaggtctatggagatacttctcttgttcttggtatttgtttttgataaatcagtaaacagcaaaggctatgttaggattcagctacctgataaaccccactcacccacttaaaccatagaacagtctttaattatttcacaatctcttcttccccttccttttcctcttgctgccttaaaaaaatcttctcttgccatttgtggctttaagttgtcctaaatgaaacaaggtgattttatgtgtaattttcttcaaattagggacatggcaaagggcctatgcaatttctgctccagatcatcaatatttctttgtgtgtggcacaaaataggttttgtctttgggactgtagttacttcacacctaaaagctaagttctggctccgtgattgtgccaaagggactggatattacttgtgtgcgtacttcctaacttcataccagtgtaaaagccacaacaaagcgtccacattgtcgtcaaactatgatggttctctacacaccttagttatcaatatgcagtttgtgtccacttaactatcatgaagtcagcatcttgttccttttcatgttttcacattttagtgtgtctgtctcatgtttgttcttgttgtatccccagctcctagaatggttcttggcacttagtggctctcagtcaatatttgctgagtgaaatcacatgattgtacattaataaatatctttcctaaatgaatgcttttaggtactattgaccacttgactttcctgggatgactaaagaacatcttgacatggcagtggttgaatctttcaagaatcttctctgcctccccctgagctatcagatatgagaaaaagattatattaaaagcctcagcaaggctaagaggaatgattggaagttcctctatgaaaaatgggttagaaaaggctatgagggagacatcatagtataatgaaaagaatactgggcttcagatcagaaaatctgcttaagaatgctagctttatcactggctatataataagaccactgatcttactccagtctcagttttctaacccataacaaggagataataaaacttctgttgcattcttaagaaaaaaatgaaatgatgtacataaaagtgaaatcatacagcattgcaaaatacaatgtttttgcttataataattattaaggattatatattgcattgtataaaatagtttacaaatagaaatgtaagtgtaagtgaatatccattaacacatggaatctctatatttctcatattagcaaatcattgtcaggaaaaaaaaccccatcattctgaggtttgccctacataaattctatcataatgcaaaaatagggataactcatcccacctgccctcaatgatgactttgttttttgcctttggtcatttatttgacactatgttttcctttattaaaatgtgaattccatgagaacagaggtcctatttgcttacaaatatttccccagcacctagagtggaccctgacattaaaaaaaatgcactcaataagtatgtctggaataaataaataaatgaatatgataacctcatggagctctgaaatctggtggagtttagatgagcaatgtgtaagtccagacagctattaaaaagtatcataggctgagtggcttataaacaacagaaatttatttgtcactgttctggaggctggaagtctaagaacagtgtgccagcctggtcaggttctggtgagggccctcttctgggttgcaaattgctgttttcttattgtgttctcacatggaaaaaagaggataagagttctctagggtcccttttataagggcaccaatcccactcatgagggaccttcatgacctgaccttcatgacctcccagaggccccacctcctaaaactgtcacattgtgggttagaatttccataaatgaactttggagaacacaaacattcagtgcatagcaaacaatatatcccccaaacctataatatgccaaggactgtgctaaaatacaaatatgagtcaaacatgtttcctgctttagaggaactcacattagtggggagaggcagacacacgcataaatgcaataaatagcagttaatgcacaacatgaggcattcttagttacaatgtggctgctgaggagaaggacctaatacatcctggggttcagggagcatcccaaggtgaggtgcttgaagccaagtagaagtgagcatggaagcatggggaaagaggtgctccaggatgaggggcagggtgagcaaaggcatggaggtagagcatgttctggtgtctgggtgaagaacttacaaacagcttgctaatttcaaggcccaaattataagactgggagctttggactggtagctgcggttaggtagggaccatttcatagaggcctttatttcatgctatacccttggactttgttctctaggtaacgggggagccattgaaggaccttatgcagcagaacatggtcagattggcatcttacccatcaggccttcattctttgaggagtaatgttaattcatctaccactttcccctgatgtatgtttttgtcctaggaagttgaagatcagggatagaaatggtggtccctcggccgagtgcggtggcttacgcctgtaatcccagaactttgggaggccaaggtgggcggatcacgaggtcgggagattgataccgtcctggctgacacggtgaaaccccatctctactaaaaatacaaaatcaaaattagctgggcgtggtggcgggcacctgtagtcccagctacttgagaggctgaggcaggagaacggtgtgaacccgggaggggcagcttgcagtgagccgagatcgcaccactgcactccagcctgggcgacagagtgagactccgtctcaaaaaaaaaaaaaaaaaaaaaaaaaaaaagaaaaggtggtcccctgagcttcggcattagattggcgcctgcctctctgaattttaacattactgcagacaactgcttccttctgactcccatttcagtttccaaaaaccctccctgagaggacatgcatttctcttttcctctgtccttggcattactgagctgttcaatgacaaatgaaatacaggaaggccaagccaagactgagttacatgagtagggtccccatcaggctactcaagcccatcacagtttcctcccacgtgttggaccttctgtgtagtttgatttggttatttccacaccatcctcttttctcctcaatctgacactcctccattttcccaagtggagaagcgaaagtgccactgagacctctgggacagactggactctctcatctctcttttctcatggcatctctaatggggaggaaggaaaagcaggagaattgggagaatagaacacatatttaaaggaaaaaggattggatagaacatcattgtgcacattacattccacatccctttgtgattattagccatttaaaaccgaatggagttttgcagccagagatagtctctgaacagatgattaatggcttaatctgtaataactttacattttatagaaccctgataggcgtccacatctggtgagccaagctatttaaggctgtgttaattctgttaattgctatacgtttatttgaattgctggcacctgcgggctttgggataatgtgtttgttgttgctttttttcttctttaaaaaaaatactcattttattttaccctgtcttgcttgctgtctcttgttgctatctctcatgctatcacttaatttcttctctggattttcttttgggttgtcctctttcttccttactcattttcctccctcttccccatctccgttccgtttttctctaattcgtttgtttcccaagctgttgttttggtagccttcctgatttctcaggtggtgataatgtctctgtccataagcaggtgaatttaggtcatagctttgggcctaaatattcctttttcctgtcatgaagactactgtgcagcgtagggctagtaaaacccaagtgaggcttttagaatcaacatgagacatgagaagagggtgggcttcagcagcacaagcccagggtttgagtcttgcctagactcattccttgctagttgcatggcttttagcaagccgcatgactgttctgagcctcggtttcttcatctataaagacagagactaatactgatttcatgtatttttatgtagggagcaaatgggattagacaaatggaggtgttttataaaatacaaaacactatacaaaggttaatgaagttgttatttatgttattaattgaaacaaaatcaattagttcaggccaaagaaccacttactgctcttcaccatttctgcaattaaaaacctgcagaagttaggagagtccaatgtagtttaattaaaaaggcctgatactgggttcagttctaatgttaattagaaaattatacaacttctctggatatccttgtcttgatctgtaaaatgaggatagtaatccctgctaatccaaatgcacactactgtagagaccttcttgtaaatgtagcatagaacacacattattgctttgggtagcaaggtaaacatcttgctgtacatctttattccattaaggaagatgtacggaaaagcactctgtgggtttggagataagagcgtcttgacagaatgggagaaccaacacaaaaggtgaccagaagaaataagagttgagcaaggtggaaagaagtgaagatgcaaatcagaggaaatggaggaacgtggcagaagaagaaaacaaaaagcaattacggcatctcaggagctaactattggcttgtcatgggctgagtgatgtcctctgcaaattcatatgttgaagttctaacctttagtttgtgactgtttttgaagatagggctttttaagaagtaattgagatcaaatgaggtcatatggataggccctcaaacaatatgattggtgtcgttataagaaggagtgataaggacatggatatacaaaggaaagaccatgtgaagacagagggagaagatagccatctacaagctaagaacagaggcttcagaagaaaccaaccttgctgaaaccttgaacttggacttctagcctcctggagtgtgagaaaataagtttcggtaaagtcaaccagtctgtggtattttgttatggcagctctagtaaattatagagcttttttatgggttgaccataaaaaaaagatggccatttttggctgggcatggtagttcacgcccataattttagcactttaggaggctgaggtgggaggattgcttgagtccaggagttggagaccagcctggtaaacttaaggagactgtgtgtgtacaaaaaacataaaaaaatttagctgggcatggtggcacacgcctgtggtcccaggtattttggagggaggtgggaggatcacttggacccgggaggttgaggctgcagtgagccaagatggtgccactgcactctagtctgggcaacagagcgagactctgtctcagaaaacaaaactgccattttttgtgtgtgaggacaaaaaaaaaaaaaaaaaagtcaaatattggcaatgtcgggtgattcaatttcagaaagaaatgtttgtaaagaggataaattgaatcttctggaaaagagatgactttctggattacaaggaattgaagtgggcaggaaagagagagagaaagaaagagagaaattggcaatgtcagtcgattagagattcccattcccctggctgtggttgttttctttataggtggactcctaatgcagtttggacccataacatacagaggcacagaggaagaaggagcgaaaccctcagctactggggacagggatacatttgaggcttatttcagtaggaaccaggtgtgaacatttagccaagcgtggctgtaaaaaagtggtatgggcctaaggaagagtgaggagcactgaggtctcaaagatctttggtgtttcggtgctgtgacagacagagagtagttcttcagttagtgccacaataaaattactaaagaaggatttgctgcttacagttgatgggttgttgatgaagaagtagatttatatatatatatatatatatatttggcaactgggtattcattctgccttcatctgatacatgtttcttgatttttattcccctcattctcaatccaatgattcagtggcacctgctccactcccagctccgttagtgagcatgtgatccctaaatcaattagagactcctaattagagactcctattcacctggtcatggtttctttcttcataggtgagctcctaaaccaatttggatccataacatacaggctcagaagttttgtctatatgttgtagggaaacagctctctcctgctttgggctagaacttggagtggtgttaaactaagcttctggccactatcttgccaccatagtgaccaaaaaggaagccaggatagagaaaatcagagccaaaagatgggaagaaactaggccttagtgacatttttgaaggccctggtttaaacagttttcaaattagactaccccttaatttccacttatggttgaataatgtacctctgttgcctaaacctgttgtggctctattttctatcatttgcagcaggaagccctaggtgatgtagcagaattcctcatgttcctattttactcctgttttttgctaacaaaaagataggtccttggacagggaaagacagacaaaagtaggaaatgtaatactggaggatcttagaaatcagataatttgctctgtattaattcaaatttcctgcctcagatgaatgctatcccaggatacagagagaatttgtaaatacaatttttgaaacctagttggtggtttttgaggaacgctagtgaataaagaaggttcctaaagactagacaattgaaaaatgtagataatgcaaacaatgaacttatgagttgaactgaaatctggataacattttggagtgcaatattaacagaatgtatgagcccatagcagagaaaagagtgatcaatataactgccatcactaattaagagcactaagaaaaagctatatcatatcaaccaaattcacatactcattcagtagtattaccgatgattcagaaaagtactatggacctcatctagctaaatagcagcaaagtttttgaagacacattttgtgatattctcattaataagatgagcaatagggtttagatgcaagagctatcaagctattaaaataccaatgggccctgattaagtggatttttttggcctatatgaaagtttttgtaagatggcacaaagctctgtcttatattaaggacttgaagagacataagagaacatggcttgttaactttgtggatggcagggacagaaaatggtagaaattgtgcatctgtgttatctgaggttgaattaatagaggtctgacctgtgcaacaaaggaggtaacagttctgcagtataatttattggttaagaaagcaggctctggagttagagtttctggctgcaaagcctaactctactcccagtagctgtatgatgctggataacatacctaaccttctgttacttattaaatgggaacaataattatacctacttgatagggctgttgtattgagatcatgcatgtaaaatagctgacatgtagaaaatgttcagcaaatgttatttattttttttctgagacagtttttttttttttttctgagacagtgtcttgctctgtcgtccaggctggagtgcagtggtgcaatctcggctcactgcaccctccaccaattctcatgcctcagtctccgaagtagctgggattacaggcatgtgccaccacacccagctaatttttgtatttttagtagagaaggggtttcaccatgttggccaggctcatctcaaactccttcaagcgatccatccacctcggcctcccaaagtgctgggattacaggcataagccactgcgccaggcccagaataagcttttaacatgacaactaattgacagattagaatatctttagagctgagctgtaaaaaaaaaaatacccaaaaaactaaggcattcaagatcctaacaacgttaagaaggcttaactaatagaaccagggtcatttaacctgagaaagtgaagatgcctgtgcccaaggtttgagagtcgtcttcatacatgaaggactgtcctatggaagtggaagaaaatgtggcccatatatccttaagaagagaaactaagtctagtgagtggaagctgggtacttaacataaggaagaactttcagtaagagctgtccaaaactgccttcaaagtaatgagttctccaacactcaaggcatccaagtagagactgggcaaccattttgctgaggttatcgaggggattctggaatcatatgagtggttttgattttatagatagatctatagatagattgattttatatgatagatctatagttctacgatgaatgacctatctgcaaagaaagaataaggctaactgattagctcaggttcatcatgtggaagactttcctcattaatctccaaatcagttggctttacatgtcccacaaacatttattgggttgcccttgtggtaagagttgaggttcccagccactatcatcacctattactcacttacaagaatttatctttactcagtcctttacttgatcatctcgaaaaccgttacaaccacagcaattataatcatagcagcaacaataaagactagcaattattgaacacttaatgtgaacacatgtgaaatgtgtgtctacatggtgctatgtacttcagacttattccctacttatttcctaatttagttctcacaaaaaagcttatgagctggattctatgatcattactaacttgaatttaaagagagcgagtgtctttcccacttacatcattctaagtgttggagttgagatgtaaatactgtcaacatcctgattttgctgccctttctaccaattcagtcataagagttagtgacgaagaaaaggaagctcctctggaaaaggttggtgattctgtgtttaaacttactgtaaggaattgtctctcactaccgcttagagtctctacttcataggaaaggtcatttaatcaggcaaaaatgttctgttgggagactagatacaattacctatttctttcaccttgccattgattgttctgagaggaaggcagtttttgcttgatttcccactttgggcaaattgatattgctcaacctgctaacggaggaatgattttcattatggtacctgagagggaagatgctgctcttagtataaatgccaagcagtgcaatagtttcgtcttgagatgggcagcacattgtttctttttgttccagcctaatattttccatgaagttggagctatttgcctttaatgccttcaaaacacccaaataaggagcagctactatttagacttattatgaattttcagtctgattttgggaatcacttacttagctttgcatttttttttcttttttgctcgtcaagataaattcagtggaactcattgctttctaaaaatgtcacttatttacagcaaatgtaatctaccacaacattcctactgagacaaaatctcttgtgtctttgaaagcctcaaaggagattaaaaaaacactagtccttgtacacatatacctacagggataaagcaatcattgagctaattaattagcttatgttttcaaaaattgttttgcaaatgcagaaacgactattccattagtgttgcggtgcttttgtaaccttgtgttctgttcctcatgtggagagtgtgccacaaatagttcctgcatagatttcaagagagatacaaggacacatttttcacttctcaaatcagtgaagatgcagcttagggcagcaacactgcacaccaattatcaaccaataaaattctcctccttccctctcccttagcttttccctcaccacccaatatcagcagatgttctatctcatactttgtagggaaaatagaaattgttcaggtaatgcttgctaagcttctctctctccaccttaagacttaccttcaaagattctcattgctaccttcttcccctcatcttacagaatgaactttcccctcctctcttgcctcttttgagatttagcccctttaaagattccctctcttaatcttcgatctcccattctcctctgctccatcccttcagctagagacatactcaaaatcacttctttgatactgtctcctgctcaatttacacctaagctcattccccactttcaatgaaaaagttcttgggagaatggtacatatttctgatgtcccctacttcatggttactctttaaccctctacatttgcatgtcagactctgaactctaggatccttagcactttagtggaattgttttcttgttttaccctgcttaagttagaagtactttattatatgctcctatagctctcagttcaaaacttcaatgcattgcaattgttattatagtcctcatcacattgcactttaacatgcactgtgttcatatgtttcctcaatagactgagcttctaagagacaagaacaaagatttatgtagattgcatattccctctgaagttaaacataggtcctgacacatgaatagatgggaaatattcttcaataaattaataagtatttgtgaacatcagtgatagaattattgttccaaagttccaatttctgcttatattcattttgtcaacagcatgccactcatttacttattcatgaatgcagtaaatattcatggaatgcctactctgtcataaaatctgttcaaagagtgggagtgtgtggtgaatgacagcatgtataaagtctatgaccctatggaattcacattacggttgaaggagactaagaataaatgcaaaacagataattcagatactttcagataatgataagtggcatgaaggaaatgaaagagaataatgggtgtattagtccattctcacactgctaataaagatatacctgagactgggtaatttataaaggaaacaggtttcattgactcacaattcagcatggctgaggaggcctcaggaaacttaccatcgtggtggaaggggaagcaaacatgtccttcttaacatggcagcagcaaggagaagtgccaagcaaaggagggaaaaagccccttataaaaccatcagatcttgtgagaacttacttagtatcatgagaacagcataagggtaaccaccgtcatgattcaattacctcccaccgggttcctctcatgacacgtggggattatgggaactacaattcaaggtgagacttgggtggggacacagccaaactgaatcaatgagatagtgagttggtctccaggagcctgagtggtcagggcaggactctttgaggatgcaataattgagacctgagatgaaagtagcactcagttacacacacaaaaccttggggagaggccattccaatccaaggaagctactaggacaaaaaggacctaaagcaaggaaagcttggcacattcaagaaaagtccaggaggcgatggtggccatggctcagtgagagaggtggtgagaggaaagaaatatctagggctggatatgttgcttttctgaaaagatccaggctaggcaatgtcaatttatcaagcttatctctgcctcagagtcttcattttccttttatcccatatctaggttgattttctctttttctttatcctcgaaagtgaggtgtccctctatctttgtaagctcacatgttactgtgctcagtcagcatctccttctctccctttcaacttccgaattactcagttattctcattctttcttgcagtatatatctatatattttttcttttaaaaattgtggtaaaaaaacacatatcccaaaatctactcccttaacacaattttaagggcatgctacagtatttttgactatattcacacggttgtacacagatctctagaacttttctcttgcacctttgatatttgcctatttgtttcttcttctcagagttaaaaacaagtgttagtctatcctttcataaaacccctctcttgacctgcactttattaagctcaggaagataaaaaatgcctctttccaggagacggtagggaaaaagccaaaacaaaatggttataaggtttgaaaaaggaaagataagaaaagcagcattggatgacccataacttctagaagccagggtgggtgcagtgtgctaaatgtgagaagaatggggcgtggttatgtagaattcaataggtttagaacagctcatactgtcattacctattcactcgagttagaaacctcaaagtgagatgtgatctttctttctcattccccttcttcctttttgccctcatttaatcaaacacaaaattcccttggcaatgccctgtatatttctgactcatctctgtcctctgcttcctggtcctttcactactgcctctccctctgcccccatagtacttcgcctatcatggtgtcatgatgagtctttccacctctgttctctctgctttctttccatgctgcattctgccccgttttgctctttgtgccattctttggaaacatccagtgcccagcaaagcatgtcttcttcagcctcccactcaaggccttctgcagtttgtcttcaacttgggtgccacctcctcatagttcctccctaaatttaaccagagtagtcttttcctattactctaaatgtatgttttaagttctttcttctataacttgtttatttggttcttctagccaagaatttctccctttctcttttctgtctgatgcttaccctttcttctagaacctagctcatggtcacctgcttgactgatcactgggttaacagtggtcttttctcacttctgaattccaagcacacttaatataatatagggtgtttcagctcagatttaggaggtagacttccaggttgaaatttttgtttttctacttactacctatgtgccttggacaagttagttagtgtctctgaaactcagtttatttatctataaaactggtatcttaatagcacttacctcagagatttcttatgaggatcaaatgagatgatgcaataaagcctttagctgaatctgtttcgtagtgagtactcaagaaatactagctattttgtcattcagttggtccttacaataccccatagccatttgttagcttttctggcttgcatacaatccctttgaaaacagagtttttgtagttacagcaatgctgtatataatatcaaattattaaagacagtggaaaagaatttatatcccccaaatgaatgtcttgactgactgtaagaaagttgctgtttctccttattacattttgaccacaattgaaatgtggtcaaaggagaccatctgccaaaggagaataattacttcttcacagacataggaaaaaaaactcactcatggataaatatgtgtgcatatgtgaaatatgaatgcagtgatttcacatttttaaaattcctggcaatcaaatgagattgtgatagattatcttttttttttctgagatgaagttttgctcttgttgcccaggctggagagcaatggtgtgatatcagctcactgcaacctctgcctcccaggttcaggtgattctcctgcctctgcctcccgagtagctgggattacaagcgcccgccaccacgcccagctaatttttttgtatatttggtagagacgggatttcaccctgttgaccaggcaggtcttgaacttctgacctcaggtgatgcacccacctcggtctcccaaagtgttgggattacaggcgtgagccaccgcgcctgaccaaattatctttcttagagtaacttttcttcatagatattaatgtaacagttcttatggatgatgtttaaaatgcttaaggaagcaaaacttagctgtaaaattgggtattgcttgatgatcaccagtgtcccattgaggtctaaaatgcttatgaagtttaaattgctttgcagtgtgttatgatctttcaattatctttaaatgattgatttaatgagcttctattattatattttaggtatggtgtttggaatgcaaagtgaactggacagtttctttcctggaagatcttatagttcaggggttgacagcattttctataaagggccaggttagtggcttctcaagtggagacaagtttgaccccaagaaatatttgacaatatctggagactcttttagttgttgaaactagggtggaggagtggttggaggggagtaaagggatattgaagggaagatgctgctggtgtgggcagaggccaagattgttggtgcactgtaggcctacaatgcacaggacagcccttcggtgacaaggaattatccagtcctgggtctcaacagtgccgaagctgagactctctggaccagacagtaagtagttttggtttaatgagccatatggtctctatcacgactatcaaactgtcattgagcatgcgagcagtcatagatactgtataaacaaataagtgtgtctgtgttctagtaaaactttatttagaagagcaggaagtgaattgaattggccccagagggttagtttgctgactcttgctatagttaaatggcaggcaaaacttgataattataatgcaacatattaaactctatctatctatctgtctgtctgtctgtctgtctgtctgtctatctatctacctacctacctagatctatctgtctacctagatagatagatcagtcaaagttttcacaggtttacaatgaagccccagataagagcacttagcctgatctgagatattagagatggtctcctgaaagagaaagaacatgaacaaaagttaaaaaaaaattttaagagtgaggagttagacaaaaacagtaattccatagagagagaatagcgtcagtaaagtcacaaaaatgcaaaatagcatgataagcatagagaactaataataagctaaaggaagtagaagtggcggtaatggtagtagtagtagtagtagtaatagtattgttcccggaaagggatcctgatccagaccccaatagagagttcttggaccaagaaaaaattcagggtgagtccataaagtgaaagcaaatttttaagagagtaaaggaatgggaataaaagaatggctactccgtaggcagagcagccctgacggctgctggttggctattttatggttgtttcttgatgatatgctaaacaagaggtatatatttattaaatacctgctaaagaccaggctctgtgctaccgtgctacacaggtagtttgattattacaggtctgaggcctgtttgtccggatgattttagttcacacccatagtgacacacgggtctcttcttgcttcattgctttttccctttttctgggaaagggaagaaagggagggcgattcctggaactgaggattcctctcctttttagaccatatagggtgtcttttaacatgctaataactataattagtgtataatgagcagtgaggatgaccagaggtcacttttgtcaccatcttggttttggtgggttttggctggcgggatttttttaaattttatgtatttatttattttttattatactgtaagttctggtttacatgtgcagaacgtacagttttgttacttgggtatacgcatatcctggtggtttgctgcacccatcaacccgtcacctacattaggtatttctcctaatgttatccctcccctagccccccaccccctgacaggccccagtgtgtgatgttcctctccctgtgtccatgtgttctcattgttcaactccctcttatgagtgagaacatgcggtgtctggttttctgattttgtgatagtttggtgagaatgatggtttccagcttcagccatgtccctgcaaaggacatgaactcatccttttttatggccgcatagtattccatggtgtatatgtgccataatttcttaatccagtctatcactgatggacatctgcgttggttccaagtccttgctattgtgaatagtgccgcaataaacatacgtgtgcatgtgtctttatcgtagaatgatttatagtcctttgggtatattggccggcttctttaccacattctgttttatcagcaaggtctttgtgacctgtatcttgtgccaacctcctttctcatcctgtgacttagaatgcctaacctgggaatgcagcccagtaggtctcagccttgttttacccagcccctattcaatatggagtttctgtagttcaaatgcctctgacagcaatagcagttaacttttattgagtgtttaccatgtgtcaggaactctaagtattttacgtgtgctaacacatttcataaacatagagctcagtgttgctggagtaatgtaaaataaggtttaagatgtgtgcatgcaccagggctagggccttatttttaggtggatataactgggtatgagaagaccaacaaggaggtaatgagtaagatttattaactgattggatgttccaggtaagggcaggaagaagccagaagtttctggtttggcaacattaattgaatgtaggtatgctggaggagaggcaggcctaatggggaaagtgctgtttttgatgggttgagtgggaagtacctgtgttaactgcagaacaaggtcaagtcaaatagctggagttgtaactgtaattagaatataagcaatagagttaaattaattgaaattgatgagatcagttaagaaaccacatcaaaaggaagaacaatgtattttaaagaagacttctaagagtaactaatatttaaaagaaggcttaaaagggaaaattagtgaggtaggagaagaactagagaaaacgttgtcatcgaagctaagaaagtaggaagtttccaggtatatggcatagtcagcagaggtcagtgccaaagagaggaccaatacgttgagaactgaaagtgccctcatagctgagaatttagacattgtaggtaatcattttgttttgcttttgaatgacagtgataatcattttcaaattcagagagaaaaaaaggcagtggaagtggaaaagctaaagatataagaaaactaaatgttgaaacaatatcccagtgaataatttcaaacttttaaaaatgtatttattaaataaagtacatataagaaatgttgctattgggtactatgctcagtatctgggtgatgggatcaattgtaccccaaacatcagcatcacacaatatatcaacctgcacatggaccctctgaaactaaaagttaaaagtataaaaataagtaaataaagtcaaacatgtgaaaaaaagaaatatttcataggctttttttcagttgctctaaatttttaaaaatacgtttatgcattttcctataatttgtgttttgcatttatattctccttttctctaattgattagctctatcattagatttaactgatacttagagtttgattggctcaccatctatttatcataatacattgaaaagtcacagttgaaaactataaaacctcaaggatgtatttatgtgtttagcaaatggaacacaaacctcatagatttgtaactttgagacaccaaagaatattgggagacacttatcaattcagttgagttcaattcagtttaaggcatttgttgaatgctatgcatttttaacagtgatatgacaggatttttctttcctttcaaagcagcttgccatcttatctgtctgtatgtttattgcataaagaatttacagcagataaagatgtagttggtgcaaaaaatatacagaacttgaaagatctaatcataaagaaatataacaaaatgctatatcatatagcagagtcagtgatacaaagcaatttgtactaaagactttgggagggagagaccaacatgaactagaatattgtgagcatctccatctaatgtttctgcctaaatgctgttcttctctagacagaactcaaccaaattactcttaacagaagaacaaatgcaagtgatgaagaaccaagggacaagcaaaggcatcaatatattgtttgctatttgaggaccaactgtatttatttatctttgtatctccagggccaggcactatggctaccatgtattaagtacatgcagtcagtgctgaattgattacttctggtcattagattagcacagctgagctgaggtagcttggaccatgtgctatgtggatgcttccctattaatgatgctaatgacaaagagaatcaggtccaagagacagtgagttgggagtacgccacctatagaggactaggagagaaaatatttttgaaagagaagactaaatgctagatgcactattaatgggaattggtcacgcccacaggactcttccctctagcataacataccgatatataaaaacatgcttgctgtgtgaccgaatgagccaatcctggcttaacatagacaaacaaaaaagaagttgccaatgccttcttcagttcagtatctcatgaaagaaatgcaaggtgaagagaaagcttaaatgaaaaaaataaagtgaaatctgtaagcctggttctcatttctaagggtttattatactggagatttcatgaaaatagtattgagaatgactactctgtgatttttgctagcttttagtccctataggcagaaaagcatttctaaaagagatttgaaaattgtggactctgataacactgctagttgtcatgtttttctctaatgaacagcttatcagtaaatgtgctcagtggttaattaccacattagagtttattggcatcaaatgtagtagaatgccgattatccttatgcaaatttggatttactgcaggttaaatcctgtgacctgaaatctaagtcacctgtcataaattaataggtccaggtactaggcctgctgggattggcagtgacaaaagaccccatgagttgggggaatgaatcaaacctgcatgggcaagattcattctttggaatgtctcacaaagcctggtgcagccaattgtgctgcagaggctgtgtggtgtttttgtgttgttttgattttgtttcattttacagggcagccaggcagtccaagcaatggttcaagccactattgatgccagcggtgtcatccatgaggtggcactggcacttggaggttataggagtcaggtggagctatatatggttccaaaacacatgtcaagtttggggtgtgggtacgaaaataaagacagattcccagatgtctccgtcagttcaggctgccctaacagaataccatagactgggtggcttaaacaacaaacatttatttctcatggttctggaggctggaaagccgaagatcaaggcctgcttcttggtctgcagatggccttctttttgtatcctcacatggtggaaagcagagatcatctctcttgtttctcttctcctaagggcgctaatcccactcatgagggctcctactcatgatctaattagaaccaaaggtcccacctccaaataccatcatgttggagatcagggcttccgtatatgaatttggggaaaatgtgaacattcagtccatggcaccttccgtaggaagtcttgtcatggcccaatctaagcaaactaaagttcacagttatctcaggttttttgaggggagtggaacgtaagacagcatatccaagaccatcatccaaaaacctatgcctatagtgggcccatgtgacagagcagatatggctgccacccagtggccacatggcagcccatagctcatgagtgctctctgggtttgcagaccgaactgcctatcagaaactgggacagaagcagctattatgcctcctgtccctgtcaggactgggtcaggaatgagggcattagggcttttgtgtgtctctcagattaaactctgctcacttgaggttaaaacaaggcagaagctggcctgagataatcaaagcctctttcaaatctatttgcttataaaggcaaggtgtttttggtgtctacaaacttctaacacatttgtaggcactgattattctgcaaataatgggggacctttctgaagccctggatccctggccaatgcaccctactccaagcacattgaaatttttaacaaaatttttaataaaattgagagatccttggcatctcaagaacaggaaaatcattacttcttcaaatgaatcattggtgctcataagggaaaagtctttcatgcctagggcatgtatccagataattttggtggggaataacatttcttaccacattgtgagtgtttatgtggctggggcaaaagaagttgtggtttcggtgctgatccattagcagtgagtgtggtaggtgaaagttccttaattgttccccagagtaaaaacatcccagtatttatagactattaggggagagggggttggagaggcaggtgacttttcagccctacactgatgacttttatgtcttccaggtcacattaaaatgttttgcttgaattagaataaaagtagtcctttttgtccactctaaattcagtgtcttggttgaaagtatccacagaaaacattcctcagtcttcataatttcccatttacaatagagaagcaaggctctctgtacttaagaatagtacaagctattttagatgtcagatgtagtctaagaatgattgagtcaacaaaggagcatgaagacagtgatgagttctccacacagcaggtgctcagtgtagggtgataaagaactagaatggcagctaagtaggtggcaccagactctgaagaagcacttagtcattgtctagaatgtgccagaccaagtgcagttttaaagctctctctggtctccttgtcctgtgaacagacataaggcctaaataagaggcagaattgggaggctttttctttgcacctcaccttccttaccacctggccttctaggcattggagacagaagagaatctcccacatgcaaatcagcccccaggtcatcttatagcaacaaaagcctgggcaagaattaataaagaaatgagtggaatctaaaagtctctaaacataaagaaatacctgtaagatgtctcttctgagagcccattatatagaaaggagtcaaaggaagaagagaagccaagtgcatggatccaggagagtaactggtccagtgcatttctgtttaccatacctttattcctctaaattttttcagcagttctggagtagctccattagatccttgatgagttaattttgccctagatcaatttcaaagcttaaggatacagtgagaagagaaggtttgaaataccttagggaaattacaggatcaaataaattttattattatgccagctcagacagattggtagtgttgggaaagattctagtgtcacaggaaacaactatcctgaagtttctatggcgtcttctgggccatattttaaaatttgactattcaggcatacctcattttattgctctttaccttcttgcacttttgagttattgaattttcttttttcaaatggaagttttgccgccaccttgcatcaagcattttccaacagcgtgtgctgacttcatgtctctgtgttgcattttggtaattcttgaaacttattattatatttgtcaatggtaatctatgattagttatcttcgatgttactattgtaattgttttggggtgccatcacccatgcccatgtagaatgttcatagataaatgttgcatgggttctgactgttccaccaaccagctgttcctccagccttctccctcccttcaggtttccctattctctttgatacaataatattgacattaggccaattaatagccctactgtggcctccaagtgctcaagtagaaagaaagagttgcacatttctcgctttaaatcaaaagctaaaaattaataagtttagtgagaaaggcatatctaaagttaagataggctgaaagctaggccttttaggcctagctgtaaaggcctaaaagttagccaagctgtaaaggcaaaagaaaagttcttgaaggaaattaaaagtgggcacatgaatgataagaaagtaaaacagatattgctgatatgcagaaagttttactgctctaggtggaagatcaaaccagccacacatttccttaatccagagcctaatccagagcaatgccctaatgcttgagttttatgaaggctgagagaggtgaggaagctgcagaagaaaggtttgaaattagtaaaggttagttcaaaaaagccatctccataacataatagtgcaaattgaagcagcaagtgctgatatagaacctgcagcaagttatccagaagatctaggtaagatcattgatgaagatggctacactaaccaacatattttcaatgtagataaaaagccttctattggataagaaaccatctaggactttcatagctggagagggaaagtcagtgcctggctttagaggacaggctaaactctcttttttgaatctaatatagctggtgactttaagttgaaaccaatgctcatttgccattctgaaaatcctagggccctaagaattatgctgaatctactctgcctgtactctgtaagttgaacaacaaagtctggatgagagcccatctgtttacagcatggtttactgaatatttcaagccaatttttgagacctactactcagaaaacaaagtattttatgtaaaaatattactgttcatcgacaatgcacttagttaccaaagagctttgataaaaatgttcactaagattaatatttttatgcctgctaacacaacatcattctgcagctcaaggagtaatttagacttttaagccttattatttaagaaatacagtttgtaaggctatagcttccatagatagtgatttctctgatggatcacaaagccttttagaaaggattcaccattctagatgccattatgaacatttgtgattaatgaggaaaggtcaaaatatcaacattaacaggaatttggaagaagttgattccagctctcatggatgactttgaggtttggaagaagttgatcacaaccctcatggatgactttgaggagttcaagacttcagtggaggaagtaactgcagatgtggtgaaaataggaaaaaaaaaaaccctggaaggagagcttaggatatgactaaattgatgcaatctcatgataaaacttgtatggatgaggagttgcttcttatggatttgcaataaaagagcagtttcttgagatggaatccactcttggtaaagatgctgtggacaatgttgaaacgacaacaaaggacttagaatattacataacttaattggtaaaggaatgataaggtttgagaagattgactccaattttgtaagaagttcagctgaaggtaaaatgctgtcaaacagcattacatgctacaaagaaatcttttgtgaaaggaagagtcaatcaatgtggcaaacttcgttgttgttttattttaggaaattgcacagccaccccaacattcagtaaccactagcctgatcagtggttatcaaaactgaggcagaccctacaccagcaaaaagattacatctcactgaaggctgtcaacttagatgactgttagcattttttttaacaataaagtgattttaattaaggtttgtacattgtgtttttagacataatgctattacacacttaataggctacagtatagtgtaaacataatttttgtatgcaccaggaaatgaaaaaacatttgtgtaactcactttattgtgatagtctctttattgcagtggtctgtcactgaacccacaatattaatatttttgagatatatctgtatgtgtttatgtccttaagcaatatatattacactttgagtgttcaaaatttatataaatggtatcatactgtgcatatctgtacagcttactttttaaacataatgttttgtctatgttgataagatttatctatgttgatttcattcattcatattaactgttacttcatgctccatacttttttttttttttgtagagacagggtttcactgtgttgcccaggctagtcttgaactcccgggctcaagcaattgactcagcttccctaagtgattggagctaaaattatctcccaccacacccagctactccagtatattttcatccacagttgtgccagagtttatctagtacatatacctagaagtgcagtttcctgctaggtcataagctggatgtttataactttactaggtattgccaaattgctttccaaagtgatgtacaaattcacactcccaccagcagaatataaatattccagtttccttgcatccttgacagtttttggtattgccaataaatcaaataatgtagtataaaccaactcaatatagtgtaagccagatttaccctgtaaaacatatgcctaaagttcccattttaaggtccttgtttctactgagaatccagaggcctcaaaggtgcatatattgcacattacctccctcatttcctattctactaagccccagtgagtggccttccctgcaggtgtcagcttggagctggtctcttctttattagcaccaagttgctgtcttttaaatttagaactgttgtagttcttctagtcctgcagaatttcattactctggcctcaattgctcacatgtaccatctttcaaaaatgtcaggatagatgagaagatcacagggccatactctccttcagacgataaagcaaaacacaaccaaaccctcaaagcagatatgattactgcagcaacaggaaataaaggcacaaaaattgttataaatgattgttttcatagaaaaaaagtattaccaaaatacattcattttttacccactgtaggcttccctctttggaggcattgattagtagatacgaaatccttatcttctctctagagtttgaaatgtataattaacaatggagtctgccagatcaacaattctcatcacagaatgtcctgtgttttagtctttgtggaccatatggttgatctaccttatcattgttattagtgtggacccttttttgtgttagtctttttcttacattttctacaatagttaaacaaaatatttatttttgttgttatatgattttaaaaaccttatattattcagcttagcctgaaagcccaactgtgcaacagaaaatggctcttctcttaattaattaatttcaatttgatgaattaactttaataacatgctaatgtatagaaagctactaaatttttcagaataagtgtattgaaatttctcttccaagagtgatgccagctttgcttcctttatttgtgagtgggaagtgaggtttaatgctacaatggccttctagaaaccctgaagcagtagtttgacaaggatggaaacgttgagatcattgaattattgagcttgaataaacttctgagcattcattgattaatttatcaaataaccatgtattaaacacttccatatgtcaggcactgtgctaagtgttggagataaaatgatgatcagggagaagatatccttctcctggttcaaatccgttgtctagttttcatcagcttttgagtcaatataatgtttaaggacatgagattctacagccaaatagaaggatttctattgctctttggttttgacatttaacttgaaaagtaacactaataatgactaatctataatctaagattatataagtatatgtataattacatataattacatattttatattgtgtatatatgcatatacatggatggaactggaggccattatccttaccaaaccaacacaggaacagaaaaccaaatactgcatattcttatttataagtgggagctaaatgatgagaacacatggacacatagaaggaaacacacactggggcctgtaggaagacagagggtgggaagagggagaggatcatcaaaaataactaatgagtgctaggcttaatacttggtgatgaaataatctgtacaacaaatccccatgacacaagtttacctacgtaacaaacctgcacttgtacccctgaagttaaaagttaaataaagaaaagaagcaccttttctatttattactgaaaaaatacatattgtaaaccttaaaaaataagagacgacaggttcttgagcagaaactgtgattcagaattttggattggctgcacttgaaatactaacataaagactggttttgccagtggaatctgagtttggaatttgactcctttttttcctgctactcccttccccagcttgtacatgaatgcagtcttctagctcatttaaattagttctttaacttatagcaactgaaagtagagtggtttgattttatcaactggaacaaacaactcaacagtttttgtagtttttgtctgttgctgtccctctccttttcagatgtcattaagtgactttcctgggcttaagagtctaccctgaggacctcaatactctggtttctgcccaagttgtctggtctacctcctgaactagcatgtctacaatctgaggaaatgcaccctaaattgataccctgatattttcagtgggctatggattggcaggaagagaccataaacacacactttatttaatttctgagttaattatccagggataaaagtattatcagaaacatggtggctacacaggaaagcaacagatgtagtattcactaaaacagcttcatttggtacccagagtccttcatagcagcaagcagctgatagagacactccatttgggggttgagtccttccaaatctttctggaaagctcaattctttctatgacacagtcttatgtgcttggggcttatgtcacattctaaaataattgacattgacaatcgatgcatgcccatttaaaggattgtttttgaacactggaatctgtcagttcttaatgcaaatgtagcatagcaaggccacatcttcttctggagcgggagttagaatccacgtgcagatgttctggacaaatggctttgcttccagatttgcaaaatgttcttgaaaacccttatccctataggcacagataccataagagaaaaaatagaaataagtaggaatcgggattgggatttgcttgaatctttacagcaagaccctctccatattttcagttttcaaaatcagtgaaatacttcagatcagtggtttgtaaattgctctgtggagacctcagattctttgataatgccagaggaggaaacataagtatttttcgtttgttaggacctcaatcattcctggataatgaattttcagaggggaatggacttggtttattttatagactgtttgagcctaaaggaaaatgactacacctcccaaagcagatgactaattttcagaaattgttttttggaaaagtgggtctcctttttaatttcccattcgcaccccatgtatgttctcttatcagtgaaggagatgagaagccactctggggaaaagacacgtagaagatcaagaaagctcttttcctcattgcgtgattgatactcggttttgttttttttgttgttgttgctgttgttttatgggagtcttgctctgttgtcaggctggagtccagtggcacaacctcggcccactgcaacctctgcctcccgggttcaagcaattctcctgcctcagcctctccagtagcagcgattacaggcgagcgccaccatgcccggctaatttttgtatttttagtagagatgcggtttcaccatgttggccaggatgatctcgatctcttgaccttgtgatccacctgcctcggcctcccaaagtgctgggattacaggcgtgagccaccacacctggccgattgatacttttttgttggttcattccagtgctgaaaattgggctggatttgccaaaacaaatctgaaactggctttctatgcctgtggattctgttcctattgtctgtccattcactgttctgtttagttcatggattaagactgtcagcatcacgaagtatcagcagtaggatgtttggtgcagggaagatgtgagcacctgcatatcttccctgcaccaaacatctgatactttttttttttgaggaaataaaagccccaaggaaccaagtacgacactttgacagtcattgggctttttgagcctgggccttgttaaggcagctgcctgtaccgttgtggaatcacttcagctactgtctagtcctcagtgctacagcctcagggcattgattttagctaataatagtggtcaacattaattgagcatttactatatgctaaacagtgtcctaagtgcttacttgtaggaactaattcagtcctcgcagtaactctaggagacagatactacactgtcattgtggatgggatggggtttgggtggggaattggggtggggcttgttggggaaagaatctaaagcacaaagatagctttcccaaggccatgctgctgatttgggtttggaactgggattaaaatccacattctcatgggttccaagcccatggttatagtcagtcattatgttccacttcctcactagctcttcatcaagtattatcagaaagcaaggaattatttttcagactagcagaaatttactagtgacttagtaatatgtcagaatgtcatggtagaaaatcattccagagctttgctgtttagtacagtagccacaatccacatctggctgctgagcacttgaaatgtgcctggtctgaattgaggtgtgttttacgtttaaaatcacactgtatattgaagacttaataccaaaaaaagtgaaagatcttagaaaaagtttcttatgttgattatatgttgaaatgataaaattttggatatattaggttaagtaaaatgtattattaaaactaacatcactggcttctttttacttttaaaaaatgtagccactagaaaatttataattacatatgccacttattttatattgctattggacattattctagagaattaaaaatgtgcaaattatccacagccatttcctcatacctgtgacactcagtcattcatccgaattagcttgtggtcagtttgaggcagtttgtctaacgtttgagttacgagatcagagcaagaggtgctggtccattttagacgtgctttatttagtttgtagaaaaacacactgaaccatcctattccgctacagagtgccccagcttcacaaagcagaatatggaagggtagactagtgaaaataagtaaatacagataaataggttatgacatgtagttgagattcagataagtggagcaagattccgcagattgcactgtattagtgacagtgagtgtattctaagagaggagaggatctttatgtgtggtaaaagtagctggggaccaagttgttgagaattttgtatgtcaggaaaaggaatgcatttggagtgacaaacttttgtcactttccaaagactccttttagaattctttattgatcaatagaatattttgtcgtgacttacttcataatttatgatatgttaaaatttccaaattttctgtttattttatgttagttacatcttagattgatgattccctggtggaatttggaaagacatcttaatcacaccagcagtatttatgtaaaccatttttaaggatggtttacttcttagttaactctaaaggaaggataatgtcatctattgaataaagattctcacttttctacttggagatcatattgtcttcttaaatctttgtcccttaggctttgataatggactacatctcatctgggggcctctcttctctgactgtattaaccatacttatcttggagttgaaagaccttggaaggaagccaggatctaacagtcagggtctatggatctttggcaagtattacaggcaggccctggatgtgtggagtaacagaggcctctaacgagggggcacaatagggttggcttatgtggacattacattctgaaattggcacatgaggttaaaaaatgcttataatcaaatttggcctggataaggcttttaaactactcctaaattagacgcttgaaagctccaaagccaggatttagcattgttgattttgctttgtatttcttctgagacacccctttccaggagacacggaagtcaggtctacttggaatgaggaaaagggttatgtggtaaatagaaaattctcagtccaggcacaatggctcacacctgtaatcccagcattttgggaggctgaggcaggagggtcactcaaggtcaggagttcaagaccagctgggcaacatagtgagtccccatttctacaaaattagctgggcatggtggaatacacctgtagtcccagctacttaggaggctgaggcaggagggtccattgagcccacaagttcgaggctgcagtgacccatgattgtatcactatacttcagtttgggagacagagcaagaccttgtctcaaaaacaacaacaaaatatcctactccctctcattttttccccaagagtattgaaagctgaatttgtgtaagttatacataaatatcatgcaacttcattgtactgcttattttcctaataagttaattgacttgtattatgctttacatattttgggcttgttacttgtttgtgcctaatgtatgaaaggcagctagaacctatctttctaaactgaagagctctaaatctggttagggaaatagacaagtaaatcaagggttataatgcaaattaagaagtactttaacaaggcctttcctcagtgctttaggaccacagaggaggagccattaaagtgatctgggcatgagtaaaggctgtatgtgacatcctagcctaagctaccatcatttctcattgcattggtgcaacaactttctaaatgctttctctgtttctgtttttgcccctggatctccctctctcccaagtctatagctccctagcagctgcagtattcctcttaaaaatgtaagaggcacatatgctcctatctactcaaaaccctccagtggctttccatcttgctcagaatcagagctcaagttctaaaaggcctataagaccttgtacaatctggcccttgctgcctctctatcctcatctccaatgtgcacctcctcattcaccctgatgcagccacaccaatctccttgatgttctttgaacatgctgttcacatgactgctcaagacttttgtccttactgtagtctgtctgcttggaattgtcattactcaaatgtctgtatggcttgttctctcatgtttccaaagctctgaagaaatgtcacttttttttttttttttttttgagatggagcttcactcttgttgcccaggatggagtgcaatggcatgatctcagcccaccacaacctccacctcctgggttcaagcgattctcctgccttagcctcttgagtagctgggattacaggcatgcaccaccatgtcagctaatgtttttctttcttttttttttttttttgtatttagtaaagcctgggtttcacagtgttaggctgatctcgaactcctgacctcaggtgatccacccacctcggcctcccaaagtgctgggattacaggcgtgtgccaccgcacccggccatgtcacagttttataggcctttcctgactaccctgtacaaataaaaacaagaataagcctccaccctatcctagcactccttcttccgtttagcttgtccatcaccatctaacatgccgtaaattcacttctttatttgccccatccccttagattttaaagttcatgaaagtaaaactgcatctgtgtcatctactttggaacagttcctggcacttagtattttaattcaatacatgtttgttgaatgaataacttacttttctctctggcatggcttccacatttatttgcctaatgagtggatcgataaatgaatgatgactatattctcttggcactagcagaatctgttatttcccaatgtaccatttctctgaaataactttacagttctttattggaacaaaagactttatcaggacttgtcaggagctcttggattctgccaagacagcatctcactcacagatggaaattgccattaattgtctgctttgatggtggagcacaacattggaaaagaagacgcctcctggaaagcaggttttgccattggtgagagagaataagagtgaattgggctggccacagcctccctcatattgagaaacccaattggtaatactcagctagcatacagattagtaatgtgtgagtgtctgcatgtgtgtgcatgcttccgtgtttatatattaccagtgtatgtgcgtacctttgtatatatgagtaaaaatatatatgaagtaaaaaatcaaaatctaataactcaaaatccaaagacttgaacaccccaagggaacactgaagtctcagcagaacccttgatgcttgggaaagtagaaatatagggaaggtttgcataattccctgtgttcacttctagctcactgaatgtgactttctgctgagcctaagcatacagcaatgaataacaacaatagtaacaacatgaggggtccctgctttcatagagcttgcattctagtaagtggggcaaaaagcaagcaaagaaatctaagttatatatggtggtataaatgctatgaggagaggaaataaagcacaatgagggagaagatgatggagtgcattttagaaatgggaattgatagaatctgggatttgcttgacaaaaagttgaaggagaagcagatgcaaagacctgagattcaggtgcttgttgaattcaagggacatgaaaaagaacaaattagggaaggtcaagttatataaagcctttaagccatggtaagaagtttggattttattctggttacaatgaaaaagccatcaagcgctatttagcaagggagtgactggtctgaattaggaaaacccccctggctgttctatggagggtggagtatggtgtgtgctagaagagacagaagatacatagatggctgttactgcaacccagggaggaaacatagcaatgtggattagagtagaagtgatgggaattgtaagtagatgagtgtgggatatattttggaggtagagtcaacaggatttattgatgaattgtacattgagtatgcgaggtgagtaactgaggataactttattagtcaagataagctaggctgtgttgtggcaacaaactgttccaaaatctcagaggcttaacacaaaagaggtttatttctcagtaatttgtatatccctgtgttttggctggtggctttgctttgtttattattgttcttactctaggacatgggatggcagggtaaccactaactggaacattgctggttgacattgaaaagggataaataaaatttaaagggtttcaccctgggagtgattaagcatttggcctcgacatgacacataacacttctgctcaaactaattggccagaagtaatcatatggctccatcctgcacaaggggccgataaatacaatcctgtcttgtgccaggagacaaaggactagagcctactcagacagcaacaccaatgactctatagtatcttcctggtttgaataactgttaatggcattatccaagtgcagatatttgaaaggaatgagctggggggatgtgaaatccatatttcttttttagccttttttagtttaaaagcctattgagtggagatgtcaagaagacacttggagatatgattcttaagatcggagaaaatctaggggtagagaaataaatttgagcatccacaacatgaatatgacacttaaagtatcaggacttataggtacctgttgagaaccctcaagttctatctttggattcctataaagaaggaattcctatagagaaggaatccaaagacagaacatgagggctctcaacaggtagagatcttacagagagaaaaccaacaaaggaaataaaaagagagaggttctcatggtagatagaaacacaagagagtattgaatcttaaaaggcctcaagaagtaagtattgcaagaaaaagggaatgctgagaggtcaaggaaaatgagatttaattattggatctggcaagctattgaccattttactggtttggtataaagaagaggctaatttaaagggggctgagaagagaatggtaagtgtggaattgatgaaaatggtcatagacaacttttggaagagttttgctgtaatcatagcagtaaagtggggtcagtagtgaaaagggacatggtgtcaagaagataggtggtcaggaaagggagcaggtttgtgggccagatgatggttttgtcttttgaaatatgctgacctgataaaaaggtattcaaatgaaaagcattcagatattagttggagatataagtcagacatagagaaaaaccagtgccagcataaacatggaggagccctcttcatagagaaaagagaacagggaacacagatgggctctgataggaaaagtatagagaaaaaagattgagcgctcacattaataaaatcaggagaaaaaagcagattatgtcctagaaatcaaggaaagaaagtttaaatacctttgcaagaggtttttcttcactttctatgttcctggaaatatgtagtctatattctgtactctctggccaaatttgaaggggatagtactgtagctgattaaatatataatctaagaactgtggaataaagataggattaaaggttttttaaatctcaaatcagtggggttgatgctctttgtgtttctgttctttttgttattgttttctcttgttattttgaaatttctctaaaaactacttaaaagtatagttagtgccatactcatcgttgtatttttcttcttttttacctcctcctcctccttcatcaccatcttcactaatgattatcactagcaaaataatcatcaccatcagacttcattaaattaactattttggtattttaataattcagagctatttttcataatttggttagaactactgaggggcattcattttagtataatagaacatttttatagcacttcttgttatttgagtacttattaaatgcttactttaaacatgggcataatttctgccctaagtccttttcagttaaatttcctaggaaagatacaagagttccaggatggaaaagaagtgctcagagggaatacaagagattaagaccacaaatatatggtatcactagaataatttggcagaggtttatttctatttaggttagttggctataataaacatatgtagataaatagtataggaatatagtacagggtaaaatggtgactcaatatcttaatatcaaatgaaaaatgggctgcttcctccttctaggctggaataatgtactattattgacaccccttctctggagtataatttggcttagttctggtggtctgttgagtggcttggtctcactctctttctctctctctctctctctcaacctctctcccctctcccccttcctcctctttctctctgcccttccttctggctgtccatccttctctccctcctccgctcctccccactatctctcacttctccaactcagttctttctatcagtgtcttgacatctaactagttaccctagagacctcaaagcaattattctttccttaaacattctttcaaaacccagtcgttccttaggcatattgacttgaatcatgtctatctttgccattgctaccttcttagttctaatattcatcattattttctgggttacctccatggcatcctaacttgtgcctgcctcttttgttttattccactccaatgatccctcctattcacatgcctctcctccaaccttctcccatcttagttattgtgcttaagaaaattatggatcatagaccaagtataggatagcagtgtgaggaagtagattgaaggagggagacataggagttggagttagaactagttcggaagttagattgtacttgtcaatgagagacttaatccagattccatctctctaggacagaatagaccatttctatctacatggagtatcccttacatgatatccatatttctctcttaacatcattgtacacatatgtttacatgtgtaacacttctactaaattgtaagctccttaaggtcagagaccatgtcctaacattcagtaagctctccatggttgtttgttgagtaaacaaataaaatatggtcttaaatagaaccagtgtcagaaggaatagggtggagaaaatgaatataaaaaagattggatatggaattaaatggacttagtaaaatattaattctgggacaatgaagagagaaggttcagatatatctacacaaatttgagcttaggtgaccattaacagaaataaggaagttgggaggaggaaccgatgagtttgcttttaggcaggttgattttaaagttctgtagagaattttaattttaggtggatgaattgttccagcagacaattcagatttgaagcctgaagctttggagggagttttggtctagaagtaaagatgtgttagtgagtgaaattaccaagacaccgcagtgaaaacaggaaagagagccttcatcagatgcgtgggggaagcctctttttaagaaatttggaaaaggagctgacagaaaatgagtctgaaaatgagaggcagaaatgagtcatcaaagagttacttggaaagtgtacagtcaggaaacccaggaaaagaggatgttgaggaaggagtgagagaaatgccagctattgcacagatattgcatattatgagaatggaggcctatataaatttgagtagtagaacatcagtaatattattttagaattatttgctcttgggttaaatatgttttctcttaggaagcaactaagttaaaacacgatatttagagtgctgcagagacaaggttgtaaaaattctctcctatatcatcggtggttgaataaaattcctttattggtttttcttggaactgtaccctctagccaaacagcccagtggaatccagtgatagaagccaaagaaataaaagctaagtgtctcaatttatcctgttgtcactttcagctttctctgctcattattagataccaagataagcaatagatttaggttttttgatggaattctagtggatgccttggctctctttgtcctggatctagggacactctagtcagattctcaaattttttcttttttcttttttgcacattcatggcttgaataagggtaagagagcccgggatagatgctaacaatctttcagattgttatctgaaatagatatcttgagatatgctgttagtattttcttcaaggcatgccatgttgttagcattttcttcaaggcagcccatgattaggccagaggaggaggatgccgctattcacttctaacctccatccttgaattatggtaaatacagaagatgcttgctggtcagaagagagttgactcattatgtcaggtagtaaaccaaaaattttctccctttatgatgaaagaaaacgcagataaaagcatgaccaataaacaagccataagaatggggaaaacagtgatgacacggggttagtgctatagaagttcccagaaaggtgtttgaaaactctgggcctataaatttaattatgtactattatttactaatattatatactaatatttactttgtttggaggtagaaacgctttactatccacttgtctttagtgtgaacactttcttaggaagcattaatgaaacacctaatactacctgcttccatggcagtccaaaattaagctctaaagattgaggagtcagaggtaaaggtcggtaggtttttctgtggtcttgacttcttctcaagatatctatttgatttccagtaataggaagtggctcccaattacatctattcccagggtccctccctattctcttgtcatcttgatttcagtttggcctgattagatggtactaagttttctatatggtaatttatattacaagaaaaattggtaaatggtgggatactgcttcaaatctgcagcaatataggtaggtgtctttggtgaggttttgtttgcaattataggattccctagatggggactctttcatgaaaaatcataacagcaagtggttgaataaaggttatttctagactgttttctccagactaattagagtagtacaagggccaaccatacagcctcatagtttcaagggtgctttgggagtcagatggacttgagtttaaatcttgcctctgccacataaaagctttgtgagcttggacaagtcatttacttctctcagcctcagttttctcatctgtaaaatgagataattatggcatcttatagaattgttgcgataatttcagatagtctaaatataaagcatttggcaggccaggcgcagtggctcacgcctgtaatcccagcactttgggaggccgaggtgggtggatcatgtgaggtcatgagttcaagacgagcctggccaacatagtgaaatcccgtctctactaataatacaaatattagctgagtgtgtggtggcacacgtctgcagtcccagctactcaggaggctgaggcaggagaattccttgaactcaggaggtgggggttgcagtgagccgagatcatgccactgcattccagcccaggcaacagagcgagactccatctcaaaaacaaaacaaaacaaaacaaacaaacaaaaataaagaaataaagcatttggcacagttcttggcacttagtatctagccttcattattagtcttagatggaaaactggatgcctcaatagacctggccaggacagcattcccacagtctccatcaagtcagcaagctttatcagctttatctctgatatttctttctagacagttcctctcctttttcatcattaccactactgctgtagacctgggcactaccttctcttagttggattttttggtaatacttatacacggttgccatgtagttctcataaaacttgttttgttttgttttgttttttcccccactgctcaaatacctgctctagatccctggtcctcagctttgtacttaagactatgatttggtatgagccagttttatcaatttaatcatctattttttattttcttcacgcatttctccccaaacacacatatcatccccaagccaataataattcctttcaaagtactttttgtacttttggtcttatgtatgtcatgttgcaatagcttttcaagttgattttcgtgtgtgtgtgtgtgtgtgtgtgtgtgtgtgtgtgtgtgtgtgtgtgtgtgtgtgttctcttgctttcttttagttcattccctatgtgaccaccagattaatcttttatataataccaacctgacctcgtcactcttctgaaccagagcgatttcctagtgcctttaggatcaagttaaaacttctacatcagctggatgcaggaggtcttctggggcatttttcagcctcaactcaactgtcactcccactatactgtgcaattcaactatattgattgctcttgagactacacatatgccaagatttctcactctcatttcttgccatccgtgctatttcttttaccttcctatttcaaaacctggctaatgccactcatttatcaggtctcaccttagtactccatcctttcaaaggcatttctgattgccccttccctctgcccacagcttgaattaagagctcatccctgatttcatggtagtttggaaatatctttttagaaacctttatcatgcaaattgctcattttgattttctgactgtctcctcttctaaaagaaggcttacttgcagtattttttaatctttgtatttccatagagcatgacactcaataaatatatgagtgtgtgaaaaactgaataaatgtgtgtatgtctgtttcttttaatagagtaagttattttagggaagggccaatgactcttttctgcttgtaggctccacgtttcctagcatggtcctttgtatataatagttgatcaataagtagtgtctgaataatgatatacatgtctatcttccccagatcattctaagtttttcagcaaaaagattgtgtcataagaattagatagcctccagcacaacgaattacaaatacttcatactctaatgcacatgtttaatttttgcttggagttgaacttaagttatggtgccttatgagagagtcaggcagcttctctgtactacataagcatgtactcgatgaagcttggggtcaaaaacctggaaactaagtttagttggaaatttaaatgctggagactggatgcatcctaggagtggattactagtattgatactcctagacaattttctattcttatttggttctttctccataaacctgaccagtccatgtatagcaagcctcaaaggatgcaagccttgttctggtgttttttattgcaagtcaaagtctatcaggagctgaggaatgagcagcagtgggagggtgtattaatttcctgtggttgctgtaacaaattatcacaaatttggtagcttaaaaatagtaattttattttctcataattctggaggtcataagtcagtttcactgggctaaaataaaggtgttaacagggctgcatgtcctcttaaatgtcaaggagagaatctgttgcttgactcttcccatttctgatagctgcccatattccttggcttgtggcccttaatctctatctccatattcacatcatctctctgtctgtatgtgtgatcttcctttgccttcatcttataaggattcaagtgcttgcatttagggtccacctggagaatacaggatagtctcacctcaagatccctaacttaatcacatctgtaaagactcctttccaaataaaataatatttacagtttccatggattaggatatatctttggggaacattattcagcctactacagagatacctttctctttttgtagattcaaagtgcttgatcttctaagaacattgtttgcttacagacatatttcaggagtaaatgacttccaaactgatggtccgttgaaaaaaagcctggggctgctgtcaggaaaggtctaatttaggtcagcctaatgccactgaacagatgtatatggcaacattcccaactcccattaggaaaataagccattaattaatacttattgaggagctgataagtaactggaagagctggtctgagttctggacaaggaatcagtgacaatcagtttccactgtctggctgttgtgggtagattgtggtccatctctgtaggataaagtgtgcacagttggcttggcactcactcttctgtgtccagcagtagctcttgccatctgtcttatcaagagaataaaaatgggtctaagttgtcactgggagattactgagtatcagtggacactatgagctcgagtgggcaaccccatgcaaggttagagcagggacttcaccaatgtttgaattagggaacttcagtacctaaaattgggatgcagatgtttcttgacttcttcatgtcttttccacctctttcatataatctaagggggatatggaccttggaggagtcttcctcaaggctttggcaggtgctcctaaacatgcttcatccatgcctacttgagtgtaatctgctatcttaagccacaggcaggagagatcaatttttctagtaacttcttttataatccagctagctgaagaagtgtgatcaaagaatcttaaaagtgtgatcttgaagaatcttagtttctcttctgttgtagagagaggatagtaatagttgctaagcctataggctctgaagccagacttatctctatttccatgctggctccactacttaatagctgtgtgagcttaggtagataataaaatctcagattcccagttttctcaattgtaaaatgaggataatagtaaccaatatatgcaaggtgccaggagatattctaagcatgttacatgtatttaaccttcttattctcacatcaaccctatgaggtaaatgtactattgttatcctacttcaaagatgggaaaactgaggtacagagagattaagtaacctgtctagatcacacagtaacaagtcgcagaacaagaatttcaactcagagtatatgcttcaactcagaatatacttcaactcagcatatttgctgttaactatattttatgctgcttcttgtgcctcagattgtgaggatcaaatagggtggccatctattccaggtcaccttggaaagttctgggtaatatctcctgtccaggtgaattattaatagtgcctccttcttttattctcaaaggtattgtcacatcttggtttgaatatatttcacatttggattaaatagtctttacatgtgaaacactaagaacaatgaccaacccataggaagctctctgttaatattagctatcactgtttctactactgccatcaccaccactgtcaccatcacccacattcatcccaagtctgggacccttagggttaggggattaacccaagttctgcaaaggcatgtcatgggagccactgttcccagttcccacacccgtagcagacattgctcgttgatcacagtacaacagtcttccttacttagtgtcatagacaaccattcgtgatagatcacgtttgagatgtgaaattaaaattatttatcacacctagttttatttaatctcagaatacaaaatcccagcgtatggagaatctgaatttagtctgagcttgtggttttatatgaaaacttatttgattcctagaagtgataatgaatttgggacctctttagacatcctatgtcccttttctccaatatttctttctacctatttctctattatttctacctcttcttttatataaatataaaagaaatttaattcatcagtttcctattctctgcctataattttatatgttataataaaagactattgaaatactaccaaagtggacacaatataaataaggcaacggagtgagtcatcataggaattacagttggcacccaagatcaaaggcttagaaaatctatctttaaatgtgatttgtgtaactggtagtgaaattcatttcaggttgattttgcatggcataagggacatctagtggtgatctaggtctctgcagatttactaaaggtaatgcaaactcataggtaaaagtattagggcctatataccatcaccttgaaagggagtcccaagaaaggaggggaccttttgttgcatgactacttttaagctagcaaagtgtaaagaaaccttttttggaaaaaaattaattcgagtaccagcatttctgtctatattattgtcagtttgcacccaactcttatttgctgcctcctgtaccaggttggaaatcattctgttatcagctacctgccaacctgacatattcttcctatcactttccccacctcttttgctgattgcagaggggctctttggagcactttgaaaagccacctgattaaagccttcattaggctagaagcagaagtgcttcacaggccaggcaagaaatactttgtaattgcttctgacgggcagatctcctttggcggttgttgagccatcaggaagccgtacagcactggtccacgtgtattttgtataaattagtgggcttgacattacaagaggttgcccctatacgcagtcatcttcttagccccagagttctggaacttacccattagcctgcacctctttatagaacccgtcttacgcatggttctgaactaactgcttctgtcacctggattgcttacaatacctgcttgcctcatgtgctactattgtttccaaccaactatgctagacttcttaaaggttctatttcattgaatgcttttacagtattttctatgactcttttgtctttgagcctctcagattagctttttctacaaaagctgtttggcatgcctattgtcatctattttctttcagagtagctgctaacagccagaagctgctagttatggccaaaggcctcattgttggagagtcgttcttgttctttgactctaggtagagaggatgaaggctctgagatactgtctcaaaacattcatgtgttttctatgacaagtcaaagctacattgtcatattagaggtgtccagtagccccttagcgtgcctcagagtgggaggtagtgttggcaccgaactttgtcagccagtctcttagaggatcttactggagtttgtgattgagcttttacttcttctgttagtgttctgctgagacatatacactaatgatagctgccactctggggtgcagaactttccatatagattgccttaaaaataaaagcaaattttctatgcatacatgccggggaaaactctactaaatattcagtggttccaagaaatgccttttaaccatttgtaatactttagctttctaccttttcatctcattacttattttcaggcagaatagatatagaggcttctttctgcattatagtcttcacagacttaaaggcatcaggaagtagcccttgtgattttccttgctcttcttcttcccatttttccacctcctcctgtaagcacgtactttgtgtcaggcattgagagatacagagagaaaaggcataggtttctccccttgagaggctcctggtctactggaagaaacagacaattccagcacaatgtgatagatacaatgatagcagttagaacatgaagccatgggggcggagaggaagaaatcagctgtgggtgggaatggagtgggtagaaatattgaagaaggtttctaaaaagaggtgatgcctaaactgtgcttcaagtggcgaatagtagttatccaggtagagaatccaggcaagatttatccctggaatgataaattggaggacctgctgaacttttgtcaaggctggtaacaatgaagtgaggactagatcaggaagaggtttttatataatgcttcaaagtttgcatttaattctgaagttgataaagaaccatcgaacaattttaagcagagaatgacatgttattcccagacatgttaatagtgagacgattagagtcatttctagtcctcggaataaaaataacagtagtttcctagtggttcagcaaggtatgttttaaatttcgtcatctttttaatcaaactgcttaaggcttcctttctactctaatagttacctttttcccctaattgcataatgtatatatttttagagcttttcataatcaggtaccacctattcacctcatcttaattcctctgctttgtgacatgtaacttttactctactggagttggtgccctcatcaaatattctaaaacagaaggaaatgtaggcattctctgggtaggtttgtttagtgcctaagaaaatgcaggaaatgagagtgtgtatttattgagcttctactatgtgccacacactttgctaaatacagggaatgcattggttatcacatcagaaacacacaacccatgtgtttatgacgcttagtttagaggatcgaaacagtgccatccctagcaaccagagggcacagaagtacagtttcaatcaagtttatggtcataggtccttgtacattaattgacatgacaaatatatctcactccaattttgatatgaaaaaatattccccccttaattgtccttcaactttctctgtgcatgttgttggcagcaattgtgtctcatggtctatcctccatggtctagagctaaagatacagtggttatttagtacatttacatgggattttgtttctaatattctaatatagctaatcaattcatattaacttggcttttgcgttagaggataagaaaagtggagaataggttcatctcaatttctggctctcagtgactggtagttaacctcctggagcactaccttgagaggattctgaggcttcatctgggttgagtggaagtagaatagaaatatgtctattgatgatgaatgccatctgctgggaaaggagggtagaggcacatatttgccaacatggctctaagaaatgggagagctgctatccagttgtgtctgaaaagattaactggcagctagaaacttttaaaactacccattgactagttctatctcggagaactacaccccctacttgccagttcatgtcttatgtctctgcctgggtctgtctatgtcaagttcttatttgttaacttagtagaagcttagtggactctgtgaaaatgataaagcttgaaagagcaagcctgtgatagactgtgatagactgagcctttatagtatccttaatgctctagaaacttgattgactggaaactttttctttttctttctttctttctttttttttgagatggagtctcactctgtcacccaggctggaatgcagtggcacaatctctgccacctgggttcaagcgattctcctgcttcagcctcccgagtagctgggattacaggcatccaccaccatgcctggctaatttttgtacttttagtagggacggggtttcaccatcttggccagcctggtcttgaactcctgaccttgttatccacctgcctcggcctcccaaagtgttgggattacaggcgtgagccactgcgcccggcctggaaattttttctataagatacacaaatacattgcagcctgttcctgatcagccatttaagtggaataaaagtcctaagaaagttcttcttgagaagaataaaattgagacctccactctgaacaggcatggagcattcaataaggcaaagggtcagaaatcttgcttaacttcttactgttcacatctgtaactgggcataaacctataggatcattttcctttcacaaagaatccatcaaataaatacttgttaaagcctacgcttaacttgagcaccggtagtaatgactcgcattatcagcggggcttttgggcttgcactcatggctctgtgattcatgagggcagaaaaactgactggcttacagctgtctctctttttctggctggcctgcctgcatgcctagataactgaatggcttttttcagaatgaggtatggtctaaggattttgctacttcaacgtcagtttcctggatcttttcttctactccagcttgccatatgtcccttttatattttcttggccactctcttacaaatagggccatagatcagagatggtggccccatctggtgaaatctagctttcagatacgctttgtttgacccatagagtgttggatcacatagaatttttaaaaattaattaactgtcaacattgtactattgatttcaactttatctggagtctttttaacttttattttgagctctagaacttggacattttctggctcctgccttgcaagtctgaacctcagttccagttttctatttttggtgcttagtgtttttgtctttggcagatcctgaccactgttaacaaaatataaagcatgaaaatggtggcatccatgcgatgcagcagttgggactatgagccccaggttggatgtcagctgtatctcagcaggtggagttagtttactgacccctgttagcaagaccagagatgcagatgtgactctggtcatgccagatattaggtttttcagactttgggatctaagaggaccatctgctgccacatttgtgcttggacttcactgttagagtttgatcaatggcatcctgtgatgaaaaatgatgttcatgaatatgaatctaaatctgagcaagtgtttggtgtgtgtgcatctcataaatgtcacattaggcaattaagtatatacaatttataaataagtatatgtaatttataaatacatatatgaagttcataaataaataatatataacttataaataaatatataaagttatgattttatagtttattaaatccagagtttttcttttgttatagccctgcctcttaggcttgacaattggcttagaagttatcctcaagagagaatctttctttttcttttcttattttttttgagatggagtctcagtctgtcacccaggctggagtgtagtggtgcgatatcagctcactgcaacctccacctccggagttcaagtgattctcccactgcaggatcccgagtagctgggattacaggcataccgcaccatacctgctaatttctgtatttttagtagagatggggtttcaccatgttggccatgctggtcttgaactcctggcctcaagtgatccacctgacttggcctcccaaagttctgggattacaggcgaaagcccctttgcccagcctgaatctttccttcttaatgactccatgctatactgtctgttgatttattctggcttttctcagtaaataacaaaattaatagtgatcgccatcacttattgagtgcttatcaagggtcagaaactatgtgaagtacttttatatgtgggaccatcatctcctttatttcttacagtcctatgtggtaagatattatctacattctacagtataagaacataggctgagacaagttaaatatcgtgcccaatgtaacacagttggtaaggtgtccaaaccctggttagggtgtctccaaaggccataatcatgaccatggcactaaactgctacttcaatctaacatctaatttaataaagatatgaacatttgttaagcacctatatagttaggagcaatttcagatgttaaaaggtgtaattcatatttcttgctcataaggtgttcgaaatctattgaaaagacaagacttgtgctgtacaaagataacaaagttgagagagttttaagtgatgagtgagtggagtggacagtttagcggagggagaaatcacagcaggcccaagtcatcagctgcctgagggagagaagggaagtggggcagagacagtgggatgtgtgattccgtggagaccccagaagcaagattctttcacaacacttcttagtcattcttttaccctgagtaggaacgttatgcaataataagattagcccagaagttttatctagaagctgtatcatcctggaagctgaagagaataagttcatttcattattatctattgtcaaaggattaaatttggaagggagataagtatatatttatttttttgcttgttgtgagtaaatgactttgcagttaggtatacagttgaaaagctttattgagatttgtagtcaactctgctccactcatggtaccccaatactggcttctccaccattccatttctccaacttcagaaaatgtccacagcgtccttactttccaacattctccactgatgtggagtggatcattggtgctcaggcctcaagtcacaaacctgtgagtgacatggtcttatccgctgacctggtgttttttattgaagttgtcctctatgcagatagtttaaaaacaagagaaaagaaagaccaggtggtaaacctcctattccttgtcaggagaaatagtgccaagaagccatctgggcactccagggcacatgcccacatcccctcattctttctagttcccttgctggagtgcatagggatggggcatttacaacagaacacgtggaaacacattctcagaaagttgagaacagagtggcctgggataagatggcagagggagagaagaaaatacttctctgagtggggactgtctctaattcttagtttattctcatgcacctgccttctaactcaaataccttggaagaatttgaagtaataagtgcatcatgtagggttagaatactctctctttttccaatcaagtgggttgggcaagagggcagacagcttcctcattggtaggtaataaaaggattctgatttatcagattgtgggatcaccaagtaccagagtagccagggaaattctcaaatggatttgaaaatcctagggaaggagcaccatttagagaggctggagagaagagaaaggcactgcagcctaggaaacccagtgaacaagaatgcagaagcaataacacctgggttcatacagaaacctttgaggtgacccctaagcggggaggtatagacatccattagaaatggattgtgcaggaggggaagggctttgcacatcaagatggacttgggtgtggtttttgtgcgtgactaaggggtttctgctttgtgtgtaggcatggggtacaggagggcctagaaattgccctctctggagcatatccttaccccagtgcagtcagagagataagggctcaagttctgtttatgcatttaatagcctacatgatcttgggcaagtatgtatccctgctgaactccatgtctgtaaaatggggctaatgctacctatttcatttgcttattgtgtatgatataaaacagtgtttgcaaagtacctggcacatggtaggctcttttcttatattgttccggctctcagcttgctttactcctggtattgctcctgtgtgtctctgtattaaagatcatggaggaatataagtatatttttttcctgagagactttgtcttaactttgagattctgtcctcagctgttttactgtctggtctcctaagcatgagtcacgtgtccaaacagcagtctttacaagcccatgggtgggatagtaagaccagcttgtcactgtttgtgactctgcttctgtacctcccagtctgtgtgacatcttcccccatggggagccgtttctactttgtctttaattgctcctcaccgaggcgacttgtcagccaaggctgctttctgtcatttgatgccacatctcttcctatttcagccagccatttggggacattcatttagttgacagtctgattttacagagaacattgtaccagacaataatttgccttgtaagggggtccagcagggtttcctgcctccatgctgacccagggtgccagtacacttctgcgtggctgtggctgtggttctgcacagagcaggtggggaaggtgaagatattaacaatggagagtcccagttgagcatcactgggctacaagtcccttgccctcctgtccttttcctcttggtagataaaccttcacagaacctcaattcaggaccctatccatttccaacagaaccccaacaccatgggagatgaagatataggattatttcttcctaggtttgtgtgccggtttagaattgtctgtgtcctactatgtctaacatcccacttgatcttgacaacagccctgtgagctgggaaagagggacagtttgtggaacagatatcgaggctcttacctttggaataaataaaatgggactcagaagggttattcagctgtcagtgagagtggtgttggctttttattcacaacagtgaaaactccatataaatagacaggtaatttcagggccatggagtagatagagcactcaccctcaaagagcctttgagagaagtctggttatctctgtctggccagtttctggcccttgcttctcttacctatgtcttcagaaatcttcattccggctattcaccttctctcccagtctcagttaggtacccttctcacagaagagttcctcttcactgctcttgtatcttgttaaaaggcttttttttccctcctttttattctgtccccagcctgctgtagcaatgcctgatctctctttctatttattgttccatggagccaaacctccttctgtccctttgggatgacctattgttatacattaataattaacctttactaggaactctagtcacaggcatttaacccaaatgcagaaaaagccaaagtttgtttatgacaaagagttctcacatgctaaggtataatagtgaaggttagaaaggagaagctgacactcattaaacttttatgatttcttttctggtttactcacttgagtgattgcctgaggatcctgcaatatttccctttgcacatggtcagcccagtttagctaaaatgaaaaattcagcttttgaattgtgaagttgagcatgcatgactttccatgtaatgttaaagataagcctcacaggtgctgctagtggggcctggttctgagcatatggaccctggggcccaaatgcctaggttcaagtcctgctctgccacttatcagctgtgtgcctgtgggccggttccctaactgctctctgtgtctgtttctgcatctgtaaaataaggcaatgattacaggtatctcaaatgggtgttgtctgtatctaatgggatggagaggtgttaaatccttaccatggtgcctggtggtaggtgcttaataagtgttagtatcattattttcaatgttattgactatggttaggtccacggtcaaggttacataatagtgagtcattttcaatgcttcgccatagttatatatcactcttgtaatatccattagaatgcaaacagctttgcttgattctctcctggtgatgagagatgggaactaattctacatttaaatattggggattatatgatatgtgctggagtgacccatccaattaactttgtctcacagatatggacagatgaggcttattttagaaattagccattgttgttttggagatgataatgcaaccttttcagggctgtggaaatagcgaaatgagattaacaataaccctccaaatagctgcgacttttgtgcccttatgatattgcattcctaagtgcttcacatgttttaaatcattttattattacaaaataaatagtttgtttattcctatgttcccaatttcaggagaggaaacagactcagaaaatttactttgccaaagtcacatagcttgtaagtagtaaatgtggaattcaaacctaaatctgggtcctgacttagaatttgaataaggtaatataaagaaaataggaaaatagttgggacgctcaatactcagatccttgtctatttcccttccattgttttctgcttattaagtttttatggatacgacattgctcagagatcagagcgccaaaaaccattccagggtactgtatcaaatttcagttcaaataagagtaaaacttttttgaaattctaatttcatggagaaagattaatttctgcttttagatggattatacctggtttagaaagtcataacagatttttttcccataggttattggggttcaggtggtgtttggttacatgaataagttcttaagtggttatttgtgcgattttggtgcactcatcacccaagcagtatacactgcaccctatttgtagtcttttattcctcaccctcatcacacccttcccctcaagtccccaaagtccatgtatcattcttatgcctttgcgtcttcatagcttagctcccacatatcagtgagaacatacaatgttcggttttccattcctgagttacttcacttagaataatagtttccagtcttatccaggtcactgcaaatgccattaattcattcctttttatggctgagtagtattcatatatatatatcacattttcttgatccacttgttgattgatgaacgtttgggttggttccacaattttgcaattggaaattgtgctgctatacacatgcctgtgcaagtatctttttcttataatgacttcttttcctctgggtagatacccagtagtgggattgctggatcaaatggtagttctacttttagttctttaagggatctccacactgttttccatagtggctgttagacagtcataacagatttttttaactgccatcctcacgttctccacctacctacccactctgcaggacagtggccatggctttgcagaagtgtacactaaccttgggtagggcatggaggcagaaagctctgctggacccccttgcaaggtgaattagtatctggttcagtattctttgtaaaatcagactctcaactaaatcaatgtccttgactgactggctgaaatagggcttcagggtgtctcattctaccactgtacagagggcacatgcaatgtgcaaaaaataaaaacaaaaacagacctctgtccccaccagcttttaacacttactcttttctttcaagtaatatatccacatggttgaaaaaaagtctaacactgtaagagggcacagtgaaaagtaagtcaccctcccactccagaatattaatcccgcaaatatactccccaatgacaattttatagttccaaagagactttatgcttactggagcatatatacatataatgcccccacgcccccacacttttacacaatgataacataatgcaccctctatcctgttccttgacaatttcacttaacaatgtgacctggagagcttccacatcaaaaccaaaagcaataccttgtttgcaaggcctgcctaatattccattataacgctgtgccatctgctattgatggtcatttaggttgtttctggtattttactaagggtgcttcagtaaatcactttgtatgaagtatgtgaatccatgcaactcgatctctcttgatttttatttgcaagcttatgttgtataactttctgacaacacaagaaattggccaggagacaaaagaaattctgtagaaatatagaggcttttttggagcttgtgtgcacatcagatgtttcttcagatacctttttggttcctgtgtctcattgtttctcatgttgttttgggctatgtcctgaagcctctttttgggtcatttttccaggtgcccagtgagtgatggatggatactgtttgcaagattgattcacatggcacttttgtttggcttttgacaggttgtttataagaataatgacatccgtctggagctgtctcgcctggcccggattgcggacaccaagatgaaaatctatggcgaagttgtgtttaagtgtgagaatgtggccacactggaccccatcaactttgagaccccagaggcttacatcagcttgcccaagtggaacactaaacgtatgggctccatctcctttgacttccgcaccacagagcccaatggcctgatcctcttcactcatggaaagccccaagagaggaaggatgctcggagccagaagaatacaaaagtagacttctttgccgtggaactcctcgatggcaacctgtacttgctgcttgacatgggctctggcaccatcaaagtgaaagccactcagaagaaagccaatgatggggaatggtaccatgtggacattcagcgagatggcagatcaggtaggaagaggcaggatgtgtgactgagactagacgaaagctgtagcttctcagtttgttttttggctttatgtttcttaattttcacccttgcatgcttgttgattcttttgctactctctttaatggctgttgtaaaattatgtttctgaaaagatacctgtctcatagatggctcacattctccgcttatctctcttgtcactcactgcgcaattgtctcagtgatagctctacgatcctggagctaaggatggttttacaagtagcatttccactgctaccagagcaactctcatgtcactggtgtgatccgcccccattgccccattctttgcttctctttttcctcatcaccatggaaaccgattgtgacatcacagatgctgcattatgtgattattttgtaggataaacttcactgtgcaagaatttatgcaacaatacacccttcagtaattggcaagagtcatgttgcatggagaaattatgacaagaaaggaaaaggcaaattgatttttcctgaagatacattcaatttaaagccttcctttggtgtaaaagcctatatttcactctttgttcagacctcactaactctctcttcctcttcataaccttttacattttgtttaaatggctttgtttctgcagctgcagatcaaacaagctagccccaggcagtacatagctactatggaatagtaacaaagtgggggtgggggtggggcaaaatagtcaggggtttttgaatgcctggacagtctgcctagctttctatggaccatgtggcaatgaaggtcacattctgtgctatcagaaagggcattttcccaagagcagtaattagagcatttgccatttcagactcatttcctgattctccatttaggtaggatgtactcaagaagggtcttggcttcatgtgccatatttatagagattcactttcctgatgaacattaaaaagtctctatttggatattttctttctaggtacatttggccagtaagagagagcaataagttccccaaaaggctgaaactgggagtgactgagctttggtgggttggcttttctgcataattccaaagctaggctgacggcagagatagcaatattgcccttaggaagagctggatgggttctttgcagagggcagatgggtggcagattgcagccctggctattttattgcccagtaggaatctttactggttgtctgaaatctgatcagaaccaagagccttcaaattaaatgtgctcgttaagcaagaatgaatagtgtctacccttttacacagaaaaacacccaaaaaattaatttctttggaggctaaatcccgccacaccccccatacttcttcttcttcttttctttctccttctctgcttttcagtaaaatgacagcaagagcagagtcagaaagctgttccagaattataaagaaaacactgctgttggtttttaagagcatgtgtttgggatctctgaggttaggtcacggtggacgggttttgtgtctgactaacctagaccttggcacagcataaaagttaccttacccgtgtctcaggcaggctaaaacacacaaaattgccatttgttcatttctgtctgttcctaatacaaatttttctttcaaacaattttgaacaaaggggaacagtttttgttgtttaaaccaccagtggacccaacttcaacaaatatgtttgaatttcagaagtcttaaatttcatacctgggagctaaagcactggctaattcttttctcttttttttttttttttttttttttgagacagagtttctctcttgctgcccaggctggagtgcaatggcgcagtctcggctcactgcaaactctaccttccaggttcaagtgattctcctgccttacctcccaagtagctgggattacaggcaccctccaccaagcccagctaatttttgtctatttagtagagacagggtttcaccatgttggccaggccaatctcgaactcctgacctcagatgatcaacccatctcggcctcccaaagtgctgggattacaggagtaagccactgtgccaggcctggccagttttttgaactactgatgaatttgatcaaagcctattaaaaacttactgagtaaacaaacaattgtcccatgaaagcagtataatctaaaattttaatacagtctgttaaactttcattttttcatgagaatgttttctggtaacttgttttagattataaatctatactaaaggatagttataaaaacaagtgtatctaaatgtggtgcctccttccctgataatcttgaagaataatataacaaacagtgatctagaaaaacttttatgatcactcctcacttgggcaagtcagtcttagaacttgttaagtgcattcaaaactgttatggtcacacattcagagaacagattttcctcaggttgtatttaaggctctaaaatttaaattgattctagtattgtctttacttggcaatagatgtctccccattttagttggtgatcagattagccctgtggacctgtgaggggtaaagaaagaaaactatgcaacagagaaaatagtaagagatagagacctcaacttcctcctttgtaagatagagaaaataataactcctacctcccaatattgttttgaggatcaagtccaaaaatgcacataaaatagttaaaatggtagccaggacattattgttgttatataagtgtttgaaagattgaaaaacaaaaggcaaagcatatttctctaggagtaaacttctaggagggagtagtgaagcagattgttaaattccccttaatatcctttctatgcttctactcttgtgttgactttgcactttatttattgtttttaactttagttaattaattaattaaatttcttgagagctagtctcactctgccacccagcttggagtgcagtggcacgatctcagctctctgcaatccccacctcccgggtccaaggaattctcctgcctcaacctctcgagtagctgggattacaggtgcctgccaccacacctggctaatttttgtatttttagtaaagatggggtttcaccatgttggccaggttggtcttgaactcctgacctcaagtgatctgcccgcctcagcctcccaaagtgctgggattacaggcgtgagccaccacacccagccgactttgtactttaaagtgtatgtttcattcttgatcacgtctgatcttcgcagcccttcaggttatatacccttcataactgaagaaactgagaatcagacagaggtgaaggctgactgatggatggcatgacccatttatcttgataccaataaagcacatcaagaataataaatacctattttaaaatttctgacaggaagtttagatatcacctagtccatttccttaattttccagttcgggaaattgagccataaagtggttcagggattggcctagggtcataaagacatttaggactagaatccctgctctcaaggtcccaggttagcttgtggggtttcatcttctacaatctcatttgatgctgtccaaactccaaccccttcctgggtctgcttagctctctgacttgatctcctgctcaccccctcttgccttctctattctagccacacatctgcctacctcagggcctttgtaggtgccatcccctctgcctggcatgctctctctcctggactttgcatggctgaatccttctcaacattctggtttcagcttcacttttacctgcctagagagaccttcagtgactctacattttaaagtagaatgcatgagtaactagcacaccacccattttactctcttcatagcaactgcccttagctaatttatttcatttattgggttacttattgtattagtctgttctcatgctgctaataaagacaaacccaagactggataatttataaaggaaagatgtttaattgactcactattcagcatggctggggaggcctcaggacacttacaatcatggtggaaggagaagcaaacacgtccttcttcatatggcagcaggagagagagaagtgcagtgccagccagagaaatgccagatacttataaaaccatcagatcttgtgagaactcactcactatcatgagaacaacatggaggtaatgtccccataattcaattcacttcccaccaggtctgtcccacaacatgcagggattatgggaatggcaattcaagataagatttgggtgggaacacagccaaaccatatcatttattttttgtccctctgttctggaacatctgctcaatgagaggagagacatgcctatcaagttcatctcagtgcctagaactataccagagacagaataggtcttccatacacatttattaaatgattaaataaggaataatgtttcagttaaaatgtgtcacagggaatgctcaaaatattcactggcagggctggtagtgaatgcccaatctagagagtaccagtgcatggagagagagacagaagaggaagttccatcttttgggggttggtgagcccttgaagaaaactcaggcaaacatatggaggcctcattctgtctcagtcactcttaaaagcactttgcatatattcactcatttaatcacaccaacctatgaggtggggacagttattttcccattttacaaatgaggaaactgaggcacaggaaggtgaagtcacttcttcacggttatacagctcatacatattagagctggaatttaaatacaggcaggaactgtgctgctctcaacctgtatggtctcagccaagagggttaagtagagaaaagatacactagatgttaggtcactgagatttttctgggtcttcctaagggccagcttgacttagctggcagagattggaaccaaacggcctacattgtcttttccattgtcttgtaacatctaattctcttgcttacattgttctctcctggccagccaatggctgggctcagcactcacctgttaggtttcttacatttggttaagcaactggcagactcacctgagatctgtcttcccaccccaggtactatatcagtgaacagcaggcgcacgccattcaccgccagtggggagagcgagatcctggacctggaaggagacatgtacctgggagggctgccggagaaccgtgctggccttattctccccaccgagctgtggactgccatgctcaactatggctacgtgggctgcatccgcgacctattcattgatgggcgcagcaagaacattcgacagctggcagagatgcagaatgctgcgggtgtcaagtcctcctgttcacggatgagtgccaagcagtgtgacagctacccctgcaagaataatgctgtgtgcaaggacggctggaaccgcttcatctgcgactgcaccggcaccggatactggggaagaacctgcgaaaggggtgagtcggcctagaggatggcaagtgagggcctgagtggggctgatgtgttacagttggatccctgggcagcccaagccttcgcacctacctgcactttctttcttccaagagtttttgggtttactgatttccagattgcaccctttctagttctgaatgcttgggtttgtttggctaagactgagttgcagaaagggaagctttataataaatattactgtgattatgatactttttgattaaatattttctatttagagagggtaaataattctcttttgggactccagggggcctagccaactggctgttttattcattcatttgacttgtgattctttagtgctttctacaagctaactcctgggttaggctttagaaatacaatgttgaacaagacaggtacatcgctgtttttatggagcttgctgcctagtggaatatttagccattaaataactgattacaaacatggtgagttttataagaggcagagtgatgtattagttaagaacataaactctggggccagactgggtgagaaatctggccctcatgcagtgatgggaatttcatcatggtagtcaatatctttgaaacttgacttcctcatttgtaaaatagaaatcaggtacctacctcacaagatactgatgatgattaaatgagttaataggttctcgagcatttaatgttagtgattattatagtcataattattctcatcaacatcattaaagagaaggtatagagaagcttgggaggcccttggaaggagacctaacataccatacaggttcactgtatagtgagcaaccctgacagttgaggacctgaacaaagtccagaatggactggatgctttgttcccttctgaaaaatgtccagaatagaattggggaactgttggggtggggaggaggggcatgagaggggaccaaagagatgagggctgaccctgtagactgggccagaatgctgggaggattcccttttcgttcaccacttcagtatctgacatttgcacccgatttacagtttaagtaaagggcatagataaaggcaagaagagggacaacatcaacacaaggagattccagtcaagctatttgcagattgcagcttggtctatttttttatatgccaagcacacagaatcaagctgaatatccgcaggctgtcaacttctatattcaatgaaaggataatttgcatcaggatcaagtttttgctaagggtatagctctagggctttgagaatgctgtacctgtatagttcttgccctcaagaagattatcatttatttagctgaggagttgagacatctatataataagctgtaataagatgatgtaagacagtagcatgttagtggacagaaaagaaggacatggagattcagagacagaagaacgttttgaggagagacctgcagggtctcatctctacagaccagtggccagtggcctatcagaagataggtgatgtggatggatcctgggccaggtctagaacaagggctgaatgaccagttttcaaggcctgtttttttgtaaggccaactgtggggccaactgtgttactagctaaggtatatttcaagagaactacaaaccctttttacagtcagatcagaaatagaatacaggacatgaggacaaaggaagaaaagagagctttcttggagcatatggaattaaaattaaaattcactgaattttcaagtcagcaaccaccagaacaggagctatgataaggaaatactcatctgggacaggaataggccacaaggggctggtcagtctgtcaggtgcctgggctctttccaagtatgtttgtagggtaacctaccctggtgctggttggggaagatagaaaggtcatttttgtctctgagatgcgtgagacagttttggtgtttgccaaagtgttgcagatcttctgttgtctatgaagacagtataaaggtcatctcagacatctcacttcttcttgggtctcctcttaactcaagcaagggccttgtgattgtcagaggcaggacacagtgactgtagccagctgtacaaggtgtctctgagctcacccatttcaagggtgaatcaacgggagttggtccaaaacttgccaagaacagtgaaagtcactgcaccttttacattgtcacttctgactagtcattaaaaggcagctgattggggatatatgagggacaattattcttggtgcagtgcagccaagagtcatccattctggccaaatgagaagaagcttagcaaatttaagatatttgatctatacatcgctcaaatcccagacggttcaactgattgttttgttcccctactaattgttttttgcccctggattgttcctgacaccatgttcagaatgaatcagtggagtgtaaaaattataggactcttctctgctagcaaagaaaagttgagattcccaatgacattgtttttctttatggaaactgattccttagtggagactcttttgagtatcttttgttcatttttcctgcaggaagttgacatatattgaagccctagtgtgttccaggcactatgtttgaggttggaaatgcaacaaacaaaaaatccaaaacagaaacaccaacttgacacggcctttacttgtgaacaaggggtgtatagtcctcccaggaagcaaaggaaaatgtgagaaatgtttaacatgtggttaatgttatggcagatgtctatagggaaacagtaggacaaacaggcaagaatggccacttctatatggaaggagtgatggcccagagaaggggatccaagctttcttggattttagatttcctatttctaactttaggcatccactctaggcacttctgaagaagaatgaagaaaatgtattgggtattctctctatacaggaatggaatacttttcggattaaggagccctgccccattcaccataacaacatcaacacaatcactcagtttgccattctctctctaatttttattatgtagaagcattctagaatcaagtctaagtctagaatggatcatttgtactaaatgtgttaagcctaagacaattcttaaggctgtgtgtcccagtagctcaaactgtgttctctactggaacttccttgggggtgagtccattggtataactgggcccacacatgaatgggagtgttagaaagaagcacttgtgtatatacactgaagaaagcatagatggaatgctgaaaactggagttttcatggcccaggtcagacactagacactacatcaaaatagaccaatgacccaagcaaagtcagcaacagataaatctaagagacaattcctggatcaaagtcatcagccaagtataagagagtcagagaataaggcctgggaagtagaaagtgtgtatatgatactaagattaatttgcatgtgtatgtttctcttacagtaaaattggataactcctgcttctaccctcataagagtgcttcttctgcctgtgaagatgagctactctaaatcttgatgtctaaaaataggcttgattgatattgtatttagatttttttcagcataatctgttgctattctaagatgtagctgtctctacctatcccaactgtttagctctaattatttttgttggctattcatagtgatgtgagagacgtctccatgacctaaacagcaaaggcctgttttaactacttaattctaatcagataggttgaaattctttagtatcatagaataccacctaccatccagtgaagtcctgttggacagaggaaacagtctagctggtctttagcctgctctggagttagtcctacttaaggagctatgatcacttgacctgggacaacatcttatctttgctggtatagccaaactgtctagttcaattggtgagcatcaagttccagcaaggcaaagccaagggtttgatttatttgtacatcatggagcttaaattttagaccattgctgaatctatgctcttccctgaatggctttttctaaacatatcctggcattcatttggcaagaaagtaaataaagctcagcacaagttcatcccaatgtcaagaaaaataacctacagtacaacatttatctgacatatgcaccagctgaacacgaagaatacaagtatttttacttctctccagtgactcttgttccagtgggaaaggcatgcaggcagcagctgctgctcctctccattcggggcctccctttttaggcaacctcctatgtgatcctgggtagcagcagcagcagcaaaagcaaatgattctgcctggaaagggtgagataccaatcttcgatgaggctggattgtgtcattgaaatgctacatatatgccacatggaaatcatgtcataagaaaatagtagggttggcagaggccaggagtggtggctcatgcctgtaatcccagcactttgggaggctgaggtgggtgggtcacctgaggtcaggagttcaagaccagcctgtccaacatggcaaaaccccgtctctactaaaaatacaaaaattagctgggcttggtggtgcatgcctgcaatcccagctactcaggaggctgaggcatgagaatcacttgaatctgggaggtggaggttgcagtgagccaagatcatgcagttgcactccagcctgggtgacagagtgactccgtctcaagaaaaagaaaagaaaatagtgaaaatagtagggttggcagataccgttagtgttacctgcacctcattcctgttttggtaaatgaggaattggaagccctgagaagttaagtcaacatcagtttagcttggaattgctatagaatggttagaatttatgattcctgattcctaatgcatcaggctttccattacattgagcagcctttccttcatatatactgttatatacatatactagatggttattaaatgtgggagggctccagggtttctgttttaggtctcttcttggcctgcacggttcccttggtgctcttattctttgccacgatattaaaggtcatctatatgttagtgacttccaaattgaggtctcttgcctagaactctccctgaaatctcagattcttatgtccctagttgtctacttgacatctccatttggatatctgatagattaacttaagctacttaattaatagctacttaatacatagctacttaattctaatcagataggttgaaattcttgaatatactggaagagcacctgccaccctgtgaagtcctgttggacttaatcgtatcatggaacagcttaatcatatcattgaaaagcagaaatcttgaggtcttccttcctgccccagacttcttttactttcagtttttccccttcttggtaaatggcatccctactgtccttgggcattttcttttatttttgtcctatgatattcaatctatctcagcaagtctcatccatttctcttataaacccatcctgcatctgtccactctctcttccatctctatcattttagatcaaaccatacttatcacttctttggacaactatatagcatgtagtatatgattatgaaaaatccaaattcattttgtgtcttctttagaatattaaagttaaattattaaaatttctatattctcaacacagtctatcttaaatagctttagtttcagtggcttttggtccagaaaactgtaggaaatgaagctatgatgcttctttggaattaacttcagcattaacatagagattccataaacaggtatttagctcttttctgtgtcaggctttgtgagctgatgaggatatacatttatattaagagaagacacactttctgtcctccacgagctcacagcacagcagaggggatagagacataatctgcaaactctaatgcaatctaccagtgtcaatgattcaggaaataatcacaggaaagaaaaagataacaattagaaagcaagatatgacgcacattttataccattttataattagttctggattcactgaggtcttgctcagactatctcactggtgtgggaataagagaaacctgggcttccaaggtcaaatataataatggtggttgctttcactggtctcagtgctattgaggaggggaatctgcgttatggctgtgccctcatccctcgtaggtttccagatcctttatttaaatgtctgacctggagatggatcctctgacctttcttttctgcaagaataaaatgaggcagttgggtttcacgctctctcaggcccttttcaactctaaaactctgattctcaaatgtcatcagcttggcaatgctttctcttatcccaaggagagagagaaaggtgaatgaagggcagcaatgtgagtccttgttccttacaatccgcagaactgtctggattaggactcggtttagttatatcagcactgcaatcaaattttcatctccctgattcattcatccaagaaaatgaataccttggtgtactgagtacacttcaggtccatcagacctgagttttaattgatggattaacgaatcgaaccttagatttctaaagagcattaaaaggctgtttcctctttggtccattgtttactctttttgatagataatgacatgtatctgagaaaggggcttcccaagaaatgtgcaattcatttacataaatcaaactgtctccttttttttttgtttgtttttttgcttttctgttgttgcttaagtcatacaaatgtatccctggtgacagccaccagcagagcacagattcagcctctttttttttttaacttccggttctgcaagtttccctttccacaagcacagggttttatgattgcagaaagcttttccatagtacatgaaccctagctgagagttattccaccaggtgagagtctgagctacctctgatcacagctggtcctgttactctaaaaaagagtatcaggattgtagattccggttattctagagtcttgaaggtttcgaggtctaagaaggacaggctggggactttggagatcttttaagaatcgacacctgcattcaacctgagaatgtgagggtcagcactttggtgcagtgtgtgacagctgcttatgaaccaacggcacacctgctgctggctgcagtgctgtcaaatgcagggactcggtggccatttacattgccactgtgtatctttattactgtgtgtgctcaaagcagcttaactgccagcagacatctgcccataataatgcaataattgaaatgctgctaaattatgagaaacaagtgctttgaaacacaacacaaggggattgttgcaggcttttctagcatctctggcttcatgtttcttttcacagagagatgaatccttcttcactacagtttggattaagaagaaaggaaagttaaaagacctactatttattgaaaaaaatgatgtgccttctctatgtttggttcttaatatatactgagtcatttaaccctcacatccactctgcagactgcatattattatcctcactttctacgtgaagaaattaagggccacccaattcattctgaatacctactgagtgctacgtgccagggactgtgttgagcacttgggacacaaaggcattgactgtggttctcataaatgtgctattatattctggtatctgagcaattgggacatgagtgtggggagaaatatcatggaaggcatcacagactggtgccactagagctgaggcttggtggagaatcaaagatctccccggcagaccaggcaggggaaaaaaaattccaggcagaaggaacagatgtataaaggtgacttcaataaacagtaagttttccatgtgggtggcatgtagggcttaaagagtgaggaggagggatttgaggggaagttttcgaagatgcagctgtaggggtgacagggccagccagccatgaaacactttgctctcccaacaagtttaggcattatcttataggaagcataccacgtttaacaatgggataaccaggtcagatcactgaggcagaagataaattgaatacagaagacaggagaccaacaggtcagcatataatagtccagtttgcattggtattaattcaggaatgagagataagagccctccctgaagaaacaagagtggaggtcgagttttcgaacatatctgataaataaaaaaggggcaatgtcaataggacttagttagtaatcaattacacacagctaaagaatagctgaaattgaattagagcaagggtttggccatggaagccttttgcttcttcctttcttctgagccatcttgaatcagtgggagattcttaggaggagtggggaggactgtggtgaccattaagcagatgtagctgagagtcaaacctacacctgctttggtcccactcggaacatatgtatttaccttctcaccttctctctgtgcctccgtttcaatatttgccatgacaatattggcagtgggtgtttaactggcttattgtgaggctccattgtagaatcaaagtgtataatgtgctcacatagataacaaagttaatattcccctttcagaatctggagtttagcaatgcaagaattgaaaaaatgatctggctggtgtttttactccatttttttttttcttgtgtggtggaaatgacccaggtcttatttctgtgtttaaggcatatgatacaggttagagtttaaaattgagaaggttggaccataagagaacataccaaagcatgcctttcttcatactttaaatggtgtatttggaattaaaatgtgactcttttgtaatcccgggttttaaagaattgcattaaaatgatctgttatgactgtagtgatctcaaccaagctttggcatatgtttggtagaaacaatgagttgtagtttgtctctctttgtcttgtaaaactggccatatttgaaattaagctaaaagattttttttccttggagatagaaaaatcatattttgaacttctccctattctggtctctcatttgggatttatagtgatgacacccgatactgagtattacgtatgtgtctgtgcctagagcacatgtgtatagttttcctctagcttctgagaagttttctgttttatcatgggttctgttttaatcccaccaaggactgttaagaggaaaaagcagcaaacatgtagtaatcaagaatagaagtcccaaacttaaaacctaaaacttgactgacccaacaaaaaccaggcagagtataaagagttgtgtaattacttatcttgccagtagaatagatgctcagatactatctagcaaaaccacccacccccaattttagatgaagaaactgaggcctccaggtgggaaatgagtggtcaatagaatagaatagaatgttcttagtccctcgttttggttcctatttattggctttttcaaagaaatatacatgcatctgtgcatctgtgcatatttgtgaagatatacttttatgtctcatgatcttctaggcagtagtcatgccgttatagcaaagccatttggtaaatctccagtaatttgttctaactgataaattttatttgaaatgttggcaactgatttagagggaggaaatgtggagggaagagatgtatatatttctcttctctttctgtttcatcacttatcccatcttaccccaacaaataacccagcccaacagagaggatactggggtgacaagtacatctggaacttgaggctggacccttcaatatgagtggctcttgaaagacccccttctgtgggctactggacagctatttttctgccaggtagatgcagtctttcttggagaagatcatttcatgcttcttagcatgtttaacctttatagcaagacactcttatcaaaatgacaaaccccaacagagccttctaagaggccagtaaatcagaagcctcatgaaatctgtgcgattagcatgttccccctctttgtttctgcagggtaagaaagccctgtgcatttcagatttcaatcttctctgcaggccccttgtttgaaacctcctgctgtggctcactggtatttaaatactgttttcattcagtcacctggggccacatactgacatcagctaaggctggcacattgtttatctccatcagcaatgttgtaaagaaaagataactgctctgatgtttgtttagttgaattctccccatcctggaaagcatcctttctgggtctgaagatagcagctgattcctaatgtcatcattcctgtagtagctcactgttgctcagcaggatctcatctccagccagttagttgtctctgatctctttgtcccatggctcagtctgtaatgaaactttcacaagcaacctagcatcttcagccactataaggtggagcctccttctgtggaaatccacaaagtcaaggctatattgagagtagaggtagaaggagaaaaaaatgatgaataacagttctgttgtctgtatagatgataaaatatttattagggattgtggggggtgactcttttatcggagtttacacatccatattttcaagttggaaaggacctctgaggtttttgagtctaactcaatatctgatgcatatatacccctggacaaaattcctaaattgctgtgtagagtctataggaatatgtactcttatctacatatgatgtactaaatgcttagcagtggttagcttatttaatctttgcaataactacataagatatgtgctattttcattcttaatttatatctgaggaattggggttaaggataggttaagtaacttgctcaaggtcacccaagaatacgttgaggtgatctctgggtcttccactcctgagtcctctcttctgtgatcgatatactttactactctcagtaacaaggattctcacctcttcatgaagcagccattccatttttggatattactaagtagtctaaaaatcttcctttcactacaactgaagtcccttttttgaaacactctttttattttattttgttcctttttttattatactttaagttctgggatacatgtgcagaacgtgcagtttttttacataggtatacatgtgccatggtggtttgctgcacccatcaacccatcacttacattaggtatttctcctaatgctgtcccttccctagacccccaccccctaacaggcccagtgtgtgatgttcccctccctgtgtccatgtgttctcatttttcaactcccacttatgagtgagaacatgtggtatttggttttctgttcttgtaaacactcttttttaattgtgataaaatacacataacataacatttaccattttagcttttttttttttttttttttgagagaaggcctggctcttttgcccaagctgaagtgcagtgatgcaatctcagctcactgcaactcctgctccctgggctcaagccatcctgccaacctcagcctcttaagtagctgggaccacaggcatgtaccatcacacccggctaatttttgtattttttgtagacatggattttcaccatgttgtccaggctggtctcgaacttgtgagctcaaacagtctgcccacctcggcctcccaacgtgctgggattacaggcgtgagtcatcacacctggcctcattttagccatttttatgtgtataatacggtggcataaagcacattcacattgctgtgcaaccatagccatcatccatcttcagaatctttcttttggccttggttcaggctttgggagctatacaggatttattcactaaaaaaaaaaaaaaaaaaaccttcactaggtgcttatcatgccatggatcctagagatgtccagaacaggtcaagctaaaacccttctctacaatagaccttcagttattcaaagacaactatcaggttttccactgaaatgttgtcagtcattctcaggataaacatcactagtttcattaaccagttctcacctattgtggttttaagttccttgctgagttaatccagcagtcattgagagaagtgggggaaggtgggagagggttctgtgttctgaaaggaatgatggcttccagtacttcacaggggtctttgtgaagcaggccatgcccttccaaggagaaagcatgtattgttaatgcagtaactcacatgaatatcagagatagtgacacatatggactatgggtttgtgtagttggcaggattcactggtacatttatggtggtggtggggtgagtgcttttgttagtttcttatcctgtaaaaatgctttgggccaggcacggtggctcacgcctgtaattccagcactgtgggaggccagggcaggtggatcacctgaggtcgggagttcaagaccagcctgaccaacatggggaaaccccatctctcctgaaaattagccaggcatggtggtgcttgcctgtaatcccagctacttgggaggctgagataggagaatcacctaaacccaggaggcagaggttgtggtgagccaagatcgcgccattgtactgcagcctgggcaacaagagcgaaaactccgtctcaaaaaaaaatgctgtgggcccacttcaggtaacatcacatttaccacctcgtcttattcctcaaaatagtcctagattgagtgtgttaagtcacatatctcaaaagcaaagctaaatttatttttgaccataggaacatcttagggtaccactagacaaggaaatcatgattttgacgagtgtcagctgacacaaaatcattgaatgctacagctgggcagggccttaaaaaatcaactattccagtgcttataatttgcaaagaaataactgagattcaaagtgattatataacttgcccaaagttacagaggtagtaagtagccacgctgggacttatcactcagtattttgaatccttgatgagatctgtctattctaaagcaatttcagaggtgctcttgctttgtacctttgggctggtcctttgtagctgagagtaagatgctcctgctgtgtgggtcagaagatttcttcacaagctcagtgggtccttgtgattttttttaacatgtaatcgtccctttatttattgcaaataagcttggcaatttatttagttagcaacttatggtctggaaaatctcattatccaaaccttacattatcaacacatctgtttaaaaagagatgcttaaagaagtggtctaaatatgcagattcctgatcatcttgaagaagggaactactaaaagggcaacctgggagggagtagacaattgtagtgaggccatgaaagccactgacattcacacataagggagtataaaaagggaattcacatttattgagtacctgcatgtgccaggtataatttggtccttaaataagatgaaccaggtttggagtcagacaaaactggatttgtgggggcggtggggaggtgcacagtggctcatgcctgtaatcccagtgctttgggagatagaggtgggcggatcacgaggtcatgagttcgagaccagcctggccaacatagtgaaaaccccgtctctactaaaaataccaaaaaaattagccaggcatggtggcaggtgcctgtaatcccacttctcaggaggctgaggcaggagaatcgcatgaacccaggaggcggaggttgcagtgagctgagactgcaccactgcactccagcctgggcaacagagggagactccatctcaaaaacaaacaaacaaacaacaacaaaaagctggatttgaatcccagttccattgctcactattatgtgatcttggatgtgtttttaacccctttttagcctcagttttctgatccatcaaaaagccattctggggttgttatgatgcttcaataacataattgtgtaaaaatcttggcaaaatgcctataattttgtaagtgttcagtacatggaggagtattattattcttctctcttttaatttttagagcagatcttataaagtttgtggtatcattcagatttttagatacttaaaccaaggatcagaaaactaaaataaatttccatagtcgcaatgttagcaaatactaaaggtaggaatttttcacccagtctatcagattttctattattctttgccattcatttaaacaggaggccttagaggtgggattaggtactgtgggagggagagagagctgtaagaaatgagatggctttttttgttcctcttccaaccttgtcagttctctgctttaggactttccaaggggcaaacatgagaaatacattgggatggaagctgtccatttggagtaaattcaggattgagaaaagcagtcaggatcttccacatcttttcattcacactgtttgttcctaggtggtggagaagaactgtaaagtttcatggggctggtccagaagagcatgaaatgagtacagctcaaaacttttggctcatcataatttatccagggctgcaaaataccctaactcatacctgcatatttacccacatgtacaaacacacacacatgcacatgcacacacatgcacatgaatgcacagacacaaattcttcggccataaacctggacctctctaatttttgctttgctcatctctccttctctagacggggagccatcggctatgtatccccagtgccaaggaaaaggagctcaatctgtgtttgtggaggaacaaatgaaagaatgaatgcaaagcaaaatgaatgggattatttctaaagttaactatagttagaattctggtttattatctgacaaatttgaaggaacttagtacctgctagacatctaaactgcccaccctcacccccaataacaagttaggattttcgtagttggagatgtgcctagagaaaaataatgagaagctcccctaggctggggcctagcctcttgggcctgtagcaactattcctgtaactcagtattagctatagagcggcaagattcagtgttgcttaaagtggacaggtgggcaggcatggaatgaatgaatctggaatagagcgagaagcaggcttatgcatctgaggcaggcatttctaccatctaaaacaatggggtgactttgcagctctccttggtgaaaagagcacttcgtggatgatacccttttgttccccctcactccctttttattcacccctctcctgtcctgcttaccttttctttttcctgtttcctcttctttatcccccctattcttcattatttttttccctgataaaccccacacagtcctttcttcatttctatttatcgtttaagcttgatgcagcaataatgtctattgtttaaagggcttttccctcccagagggatgagattgacccttatttattcagaatgacttgactcagggctgttataaaatgtgggctgcacaaaactgcaaggtggctggtgcctaccagctacctagataagtggtatctggttgaaggggaggacaggcccctaaggcctctttgagcacattgtctaacctggaagtcatctccttttgaaccacaataaatgagaaatggtcttagcaagacaaaacaatgactataaaaccaggtggctaaaatatggctgaggaatgcagaagagtgcactggtatatcaatctctaattggggaaatgatttggctgcagcacaaaggagcccctctctgtctaacattgggtttgccccttgagctttctgcaggcggagattgatggtggtggcgtgatggtcaaggaatgtgtcctcagatgaggctgagcagaattatttctttgtaaattttctttttcccctttcttcctccctcccttcagatatctcactttctcacctttctttcaccttccttcttttcttgcctgtgatcctttcaaaccactttagtttttttcttatgtggagaacatggttgacccattcaatttcttttcactacagagtagcgttcctgggggctttgatgggacaattgatataatgaatcttgactttggtaggactgttattctgtcttcataaaatgctactcaataaaccagtctctagattatagctctgttaggagtgtttatcactgttgaaaagaagccttataaaaattgtcatctgtgggttattgctaacattatagattatgaatctccatttaaaaaaataaacactgatttttataattctaaaattaatatatatttactgtagaaaatttggcacatggaagtttattaattcaacttattctttggccgacattaactgagtacctgaatacaaaacctgtggtggttctacaaaacgcatttcatgataaacaaaaataaatataattgagcataactgtaccaagcagaaatggttattattaacatatctgtatgctttattctattattttgggaatgtgtatatatatatgtgtgtgtgtgtgtgtgtgtctctgtgtgtgtgtgtgtgtattctattcttgaatatatactatttgtgaatacatatattctattctatatatatattatttgggagatatatgtgtatatatataacatgttaatgtaattttataagtaattattctaatttttccagttcctgttttttttcaaaaattatctcgtagttgcataat[450 bp omitted]cactatacccactctagtggaagggactgcaaagtcacaagcaaaggctgtgggtatataattcagaaacaggggaggtgcaactaattatgaacaataaaacagtctactatagtagactacctgatattttgttatcactaatgtccataggttgatccaagaagactagttttttatcctttctgttaacctctaatgtgccccaatattgataaatgccatgagacctttttccaaacacataggcttcagaagacatcagagtcttctccactgcccattttctgtttggtggttctaatgtatcttcccattgatacttcaactcatcatatctctaggagttttatttcttgcttcacagaagtctcttagaccaggtaagaaactagctctgattttaatgcagagaatgcttatgaccattattttagatgggcttaaaacaatgaagcctgagacctaaaagggccagttccagaaaatcattagcttcaaaatctagacatgagagaaaggttagatggtttgaggatggttctacaaaatataatggagggaggccagaaaaggttagtgggataaggttctcagacacttggattctctaggagcagtaaggaatgaatttagttttttgctttttggaaaatttagaattactgaaatttgctcaagtctgggattctttttctacttgaggttttctcagggctttgaagaatatgcactgcatagggttttggtattcaggcttcattatttttggttccattctttgtaacacctggggtcctggttctctgctgatgggcctcttaattttgtttattttgtgtctgaacctcagattttagtttgtatttattttttgaaataataatctggttactgaattagacaccaagctcatggaaagcttggaccatgcctgctgcactattttctgcctcatgcctgggatatagaacgtgctcaacacattgttgttgacggtgataggttcagggcacaggtatcctgtatcctcagtctttgcatccaaaacttgacaaatccttttctcacccatatattctccctctcatgcaaaccttcttactttagacttatattttgtgtttaacagtcaaacatttcctctaggatgcctagtctatgtagccatttcaaagataattttctaaggaagaaatgcgaccatccaagcaaagtgtactaatgtcaaggaatcagtgagtgctagaaaagccaattcagagtggtcagaggtaacaaggagactaactaaattgattagctttaataacttgtattgtctcccagagagaaaatattcctggccagaattttgtcaggagcttgttgctctaagtcaactatattgcatgaggactcagagagtaagtgtgcaggaaaggagaaatttatttgggaagattttgtagtggaagggatactatgtaaggctaatattacagaatgttagcagaaagccatctgttaccactgtggtttactaccattcagagagtatttattgagaccgtattatatgacatgcactatgataagaagaaggggtacaaaggctagccttcaaggagctcaaggtcaccctaagaataacaggtggctgcctccaggaagatggattgaacatgaagtctattgaacaaagaccctgctcttactgttgcatgaatgaccttgtttaagatgcaagattgactgtagatggcagaggagggggaaagagaataggcctaaatctcagtcagaatagaacttcaatttctccactctcgaatgcagtgagcatagtaagacttttctctactgaggcaaagaaactttggctacagttgaatcagggatttagtgtgaaaaacatgtaggtttaaaagagccaaacacacgtatctgcatctgaaacacacacacacacacacacacacacacacacacacacacacacacacccttttcatcttactaattcctatatttcccattacttgagagataacataatgaattttggatgcaagatgaaaagaaagtcattttatccaaagggatgttatttcaaagacatacatagatgagcactcctgcatatcatgctattcttcacaatgtcattttaaatgatatttactcaaatattagttagtgatgactaactgccagataccatgctagtccttgagaggtacaatggtgggcaaaatgtgatgcatctttggcctcatggagtttatagtctagtgacaggagaaagacatttaccaagtaatcaacaactaaacatgcaatttcaaacttttgaacttgagaagtatggagagccagccctagttgaggggtgatcagggaaacagctccagagggaatgatgcttgacttgacatttgaagaataagaaggtgttaccagacaaagatggatgcagtcttctaggcagaaggttgttacaaagcccaataggtaaaaagaagtatggcaagttagagttcaaggaacagagggtaagtcaggttggagcacagaaggtggaagtggggaggagagggaagaggagacagggcttggtcatgtcatcacctactggtagagtatgatactgatttagaatttatcctaaaagtaatggcagacccttgaacagctataagcaggagaataacatgaccagatttgcttttttaaaggtcatcttggctgtaggacagtgagtggattggagaagcataagaatagatgttaaaatactagttctccaggaaagagttgacagtggactaaatttggactagggcattgaccagggatgtgaagggaagtcggtgaatttgagatatttatagaagatcctatatttgtagcacttgagatgtcaaagaaaaacaaatcaggacttagtaagaagagatttttattcaaaacaattcttgtaagagaaagaaaaggacaattgcaaaacggagaatgctataacaataaagtttgcaaacatctcaatatcaaacagaaacaaaaatgtttttctttcatagggtaaaggaggaggctagcagagataagcagaatctttggggtgggaggaagctggacaaacaaggggaaataacccctggagtctgacaggacagagggtcttgctgtcaccagctgattcccaggagaagctggtaagcaggtacatgttccccttttatgtgtgtgctcagactttgggacaagcagtgttcaggaacctgtagaaatgactgaagtttggttaaggcaaaacagaaggatgagcaattgtgaacactaggttagagaatgtaattcaccatgacctaaaagatgacttcaaagggatcaagcaggagaggtagaatcttctcagtggatcagtcaattcttatcctcttctctctaggggacagttgatatctttaattcatattaggggtttgttttaggggtttcaaagtcttctcacatccttgagttcatttaccttcacaaattcagagaagtctgttagaattgaaagacctaagttagaagtcagttttctagtcttgttattttacatatgaggaaaacacagtctagagagggaaatgtatctaagacatccccattagatggaaaactgtgaccagcacccaggacttccaacatccagtctgggaatgattcctcctttatatggccgtttcctatctgagaattctcatgacattctcatgacacttcagtgtagcactgtagattcctcccatggagcaaactaaggtgctttccacccaccctatcccctatacagctacacacatagatatttactacacacatacacatagatccatgtatcttattctgaaagctgccagatgtcaatttgaaatttaatttaattggttccttgagttttcggttccccatcatcctgctccacctttcgcttagcgtggccatcctggagttcaagatgtagttaaaaggcaagatggtgtgatggatagactgtaggttttggtggcaggcagaattggtttgaaagcctaatagctacatcatcgaagtgaaattatttaagttttctgagccttatatttttttcactcatagggctggataattgtaattgtctcacttgattcttgcaactattaggtgagggtataataatattagccaccattttattgggcatgtactatgtgccagacattgcacaacatgcttaaaggacattgccccatttaatccttatgccataacctgatgaggtgggtaatattaaccctactttaaaatgcttaagagttcccaactctaatagtaataaggactattattcccacaatcatttatttacacttttattcattcacttattattatgaagtgcctattctgtttcaggcattcttctgggtactagggatacagagaataaaaaactgacaaagcttcttgcccccatgcaactaacaatctagtgaggagaaataaaaaataagcagaatacagtaaaatatatgtagcttattagataaatgttcaggacaaaaataaaatagagcaaggggatggagaagagccaggatattgctgtgtgtagtgtagggaggtcatggatgtgaccatcgattgaaaatatattttatcatttcagaaaagacttcctggtagattacatgaactgttaagttaatttgctttttgggaaaatttagcacttggtatatcctctcattcttccctttccccttcctccttcccttcctctcttaatgcctcacacatttgtgatattggctgtgttagttgctgagaatgtaaagaggaatgtttcttttatctgcttgtctacctaccgttcttcctacttaatcccctatttgttccacaaaggattaagacacatacaaacaaataggaatggtccagccttctaattcctctgctcgggctgtgcccatctgctgggggtgatttgggatttggaagctgaactgtcctattggtacccaaaggtaccagtaggggtccaaacacagttcccaagtgcactataggaaatccggatagagttggccctaaggcaccttaccctgcaccccaagatgaacactaaaaatctgttcagctcattaaggggcctcccagcagggtggctccagtctgtgatctttgcagagcaaagtgatgggtgccctcattactgatgtagtaggctcttgacccgtgagctgcagctgcacacagacagctctgctgcccaacacactctcatcccagtcctcaggtggaggagggatagagtttactgggaaatggcaaaaaagggggggaggggtagaaatgggaacattttcaaattaatttcagaaatccagtcttagctctaaacgacagctgtgagtttaatcactgaaactctctttctattcaagagcagcatgtgtctcctgaggagggggagcattatcaagcagttaagtcgttggaagctgcttaggggctggtaggcagtctgcagggaaggggaggatggcttcgcttttggcagtgacctgggtatagtaggtactgcttacctgctatcatctcatgctatctccagcagtccctgaggattgctctgctctgtctatcactgcgcggggtgggaggtaacatcttgtacaacggaagccaatggggccaagaaaacccatgcctcagcatcgggctaaaaaagttaatggatttcttgattttaagggttggggattcaggagggaattttcctttccatctgttaccaccacagcagtaacagcaactgcaactacaacacactccaccaactacaagagctaatgcttatggagcacttcctaactccctaaacattcacgtcttcgttcatttatgatttactgagcatcgactatgtgccatacattgtgctaagcactgggaatagagcaggagctaaggcaggtatcatccttccccttaaggagccagcagtttagtggaaaagactaaatgggcatctgatgaactcaaacctggtccccaaagatgtcagctcacccgttcgaggaatgagtctcagccttggtccgtcacttccagcctaggtgggggaatgtcagctgatatgaaagctttaccctcccctcccatttacctctcagaccccaccctcaggacagtggtatctgtccgtggctcccatctgtgtgttgctgcccatcacttcagaggaaccagaagcacctgccagagagctttatgtcatcagccatgggaacttcttccatgctgtttgttgcactggcctattttagggaaaactctacgcatgaagagggaagctgaaaagacacagggcaaaaagaaatattccccaccccattctttttccccactatgattttcttcttctttgtcttttgttttatctattttatgattttgcttttcattttaacactgtggtgaggggtgggggggtgctttaaaaccagagccacaagcaaacaggaattagatcagggaaataagaaggcagatggaagaatgatttttgagtaaagcccaggcccagtggaatctgccttgaccatgtggtgctcgtgtgggcccacagaaaaaaacccagaacattgcagtagcaaagtgaaagctctgtggactgtgaatgcagattagaattaaaagatgtgcttaccacactgtctctgtctctgtcccagagcctgcctgtgaacgccaagcctccactctcttccccagatcctattctccgtcataagttctccatcacacattctcacctcttccatttgagtctggattaacacagtagatgctgctcttttttgtcatttttcctctaccatgaccaagaatagtagtttaggcaaataaagatactttcttcctacatatcaagaagttccaagcgaggcagcccagagctggtaacagcccaacaatgccgctatggaatatagtccatattttgctccaccacacatagcatgttggctgcgatcctcaggtttgttaccttatggttacaatatggttcccacacatccaggcatcataacctctttacaggctggaggaagaagaaagcacaaagaactttggttgccctccacagagccttgggtactctttcacagacaactctttatatcttgttttattttttgagacggagtttcattgttgatgcggctggagtaaaatggcgcgatcttggctcactgaaacctccgcctcccgggttcaagcgattctcctgcttcagcctcctgagtagctgggattacaggtgcctgccaccatgcctgggtatttttgtattttttagtagagatggggtttcgctatgttggccaggctgctctcgaacccctgacctcaggtgatccaaagtgttgggattgcaggtgtgagccaccacatccagccatctccttgtatcttatgttcccatcccaaaaccaatcactggaggaagggatacaattaccaggcctggtgtggaccaatcatgcttcatcttctgatcttctgtgggtgtggtaggggcctactttctctcagaacaagggctttctaaccctaccttaacaaaccaggcttctgtggtcagagcagaaggggaagcaatgtagttgataagcaatgagcaatgggtgccacttgcctttgaggtcctccttttgcctaggttgggtgccctggcatctcttaagttgggggtggatgtgagagagttatctctttatgccaatattaataattttgatgttcaaaagaagcccacatgcagtttctgacattatgttccacttttaaactctcagagccctagtctctgaattagaattctagttttagaagtttttctgggcttgcttttctattagaaaccatttggttttgtggccttgtttgaaggcaccattgctcactggttaaactgactccatttgcctgaatgattatcgcctgatgtcttgaggcttacagacccagagaaacctttattcttttctcgtaacagttaataataaagcacttgttcccttgtctccttttttttttctgccacagtatttctcaacctactatctttccatcttttgtcagctagtagtaaaattcttctaaaagacacccaagttcaccactgtcctcactttcaacatatagtagagcactttaatttgcaatttttttcttctcttttcttttcttttttttttttttacacattagccattaaccctgcaccactgccctccacatctttgtcttctacatgaaacttctgtaaaaaatgtctgttaacacctagtgttcttctcctggataatgaggaccaaagaataacccaagttctctttgcatgttggcttgcaggaaacttagagttgaaatacacagctcaatcttataaaatcttatgccctaattatcagtgataattttcttctctgagacagtatcttatatctgaatttatattttttctggttatgacttttttttcttttggttagctctgatattttaatttaatatgttttcagtaaacatataaaatcttttgtcaaataaaacaatgtatttaaaagaaaatagctctgtgcagtgggctttgctgttcttattttacatgttaggatattggggaaactaaaagtcagaggtggccaagatgttttcctattaggtacctactctggctgattggcaaatttcaccctggcatgttaggtagagaaaccttgagaatctgcatccctcactgggatagagatgtagttatcaattagcagtgactgttgtaggtttcatggaaagaggagaagtgtgatatctttcaaggacacaattttcctccagaaaatccaggaatcctcattttatatccatgctgaaggctcctagagtagcattcctcctcttccctccctctccctctttttttgctgtaacaacacgtggggagatatgatggaagcgaagaacgaagtggactcttcagctcaatggaaaggcatcaacacttcatttgatttggaagccaaagaagcaaactatgaaaacctcaccagcattgcaagggagtgatagaaatatataactcacaaatcattatagcttctcaacgtctcagtttttaaatttttactgtgtatttttttgttttgaatcactttattgaggtatgactggcatacaaaaagcagaacctatttaatgcatacaacttgatgagtttgagaaaagtacgtactcatgaaaagcatatgttcatgaaagcatcaccacatatctatcacgtcccacccttttatttattattatttttgcaataagaacacttaagatatactctcttagcatatttctaagtatactgtacggtattgttaaccaaaggccactatcgtgtacagtggatctctaggacttattcatcttgtataaccaaaacttggtacccttggactcagctttttttctgaatgataggttagatgctaatttgcctgcggtgcctacagaagttatcagtgacataggggaagataatcttccccagcctttctcccctgtctagtgttcaaattgtaaaattttcttgaactggactaaatgccttaaaaccctggaatgttggtgtctttgaacccttactttgagctctatggagacctagattgtccctggaggtagtgcagcctcatttcaacaaatcaggttgtcaaaatggctaattgtttcctcgcattactctccctgagaattacctttcttagctggcttcccacggaaactaatggtatttggcaactgtctacttccaaatcttcctctagaatattgcaagaatgtctgaaagcacaacatttttggacaggccaagatgccatgggagaaaacacacacacaagcctacgtgctttctccaaaacttggctctgaagacagtcatatggcagtcacaccacaatccaatgaattgttttacctcaggttttggaagtttcactgctcccaatagcttgcattaagccctaaataataataatgaggaaattctattaagaactatttcagaagctagagaatgtaatgattataaataagaaagggaataagccatatcaattgctgcatgtatattgtataaatagcttgttttgcttaagcattagttaagcaacattaaatttaaagagtgtttctattagccaaaggtatgtagtgtgtgatatagaatgattcttggaactttgaccagattttctgtctgggatgggagaaaatctggccagagtgtgtcttgtaggttgatcacaaattcctaatgttcatcaagagtggaattttgacggtataatgaaagcctattttaactatgtaatactattcttattccattatgtaggtaatgaaagtttgtatgtaaataaaagtttaagcttctctttataataatttatcacaggaactgcctgcaaatagattctaacgataagaatgttcttcttttagctataaatccttagttttctacttcttgcaaataaacagcttagttaaataaactcaagacaccatcattaaacaattcaataattaaggtctaatactccttttattattaatcataatcacttttttatttgaattgagctttacttagtttattgcctctattattgtctgagaggagcactcttatattgtctgctttatgcaggcaagtgtggttttaagatgagcttgggtcaaacatcaaagcaaaaaagatttgactataaatcctagcttcctcattaaccagcttggtcacctatcacaaatgattatagcctctcaaagcctcagtttttatttttttgaaaaatatgtaagatactactttatctactttgttcatagtagttattgctgacatgggacaagatgatctttatgctctatttggtgtttgaattatagaatgcttcatgaattggattaattaatgtaaagtttttgaatgttggtgtttgtttaatcagtattctataatactgccaatctcttactccttgctatccacatatcttcctgggtgatctctttcgcttgcacagagtcaacttttgtctgcctggataactccaaattctattccttttgtgcagaatttcccatgagcattaggcacacatagctcattgcttgcctgacatttctaactggatatttcataatcaactctaaatctacatgcccaaaagataactcttatcacatatcagggtatcaaaactagatatctgggagccatccttagctgaacatagtttcttaagaccaaggcacaaaatatttgtgtagaggagacatggggcaaaggagagaagaaaagcaagaacgaggttgtaaagaaccttgtatgccgagtaggaaatgttcatctttattccgaaggcaatggagggatccttcattgaaagccttctgagcaagggtgtaacatggtcagatttaagtcttattaagattgttctaggatcatctaggggatacagtgaagagaactttactgaattcaggcaaggcaaagagaaagctattgcagtcaacctagcattcaaagagaacactccattgtggacaataaaatcctggttgtttaggtctaaactttggccttggaagggctttttatataatctagtaaattttcctttaccaacaaagtaacagatactccagaagtttttaagcttgcccaaagtgactcagctggcagatggcaagtaccaggctgatatcctgcaggttttttgtttgtttgtttgaaatggaggagtctcactctgccacctaggctggagtgcagtgacgcgatctcagttcactgcagcctccgcctcccgggttcaaggaattctcctgcctgtctcctgagtagctgggattacagcatacctggctattttttgtgtttctagtagaggcggggtttcgccatgttggccaggctggtcttgaattcctgacctaaggcgatccacccgcctcggccttccaaagtgctgggattacaggtgtgagccatgtctcccggcctgatatcctgcagttttgagatacagttttgtgtgtttgccttggagaaaaagagaatttcagttgcccacgattcatacatttttatgtggcagcttccttgaaagggaacaaacgttgaagggattcatttggcaacattattcccattttatagatgtgggtttttaggcttgaggaggttgtgacttttctaaagtcatgtaattaattagtggcgaaggtgttatttaatgacagcatctctcaatatccacttccacacctttttttaatgacgctgcactaaggcaagtgcctcctctgggatagtttctgctctgttcactgctataactgcacagaggcctgcagtttgaatgaagatacacacagagataactgaagtttcaactaggaaagggcaactggggcatgtaggggcaagtgtcaactaggaaagggcaactgggtcaccttaccatgatgacttcttcatggtttcagcctggacagcaaccttgcagagtcagaatcctgatcagcagttttgaccagcacatcaagagtggctttacctcccaggcattgatccagcattagtcaagctacaagacactgatgtagaaaaccataatgtcagtttactaatgtagaataagaaataaaatctcagaagacctgagctctcctgtcagcatgacttgcacttgtacttttcctttttgtagagaagctaaattataatcagaaagttgttttggtgagcttggaatcagaaaataggagtttaagtcatctgttcaacatgcagctttcctcagctgtgatagctttttcctgctgtccagtcttcatgtggagcctggtcaatagcaccagaattctaagtctgctggccaaggtgctgcctcctgcagagagagaaagcccatcaaagttgacttcagtgactcccccttcactcacccctcatcttccacggccaaccaactccctttttgattgacacatcatttctttacatacattaatgccttccatattaccacagagagtttgttagactggaaatcattttatttctttgatctacttcatctttctctgcattgagcctttgcgtactaatttatagctattttctcacaggatagtctatttccattatatctatattttctagtggtcctttgcgtttgcctcttttccagactgtatagggcatggtgccaggcacagtttatttgttttattctatatgctgatagtatcatcttttccatctttagatgttttatctcattcagagtgagaggggcacttggtcagtcctttttgcatctcaatagttgatcctcttttgattaaaaaatatttaatttctaataatgtgtgttagagtgaaaataacaggaattattaggcccagtcaagactaacagttcttgactcatagttccaaatcacagttccaagatttccttaacctttctgatcctcacttccctcccaaaaaagtaagaatggctataattacctacctcatggaaattataaggcttcagcaagattaaatgtactcatttatttaacatgcatagtaagaactataaatgttaatttattcttacttacattaggatactgacttatgaaacagagattaaacacattctgcaaaaggactggtattgacaggctttgattctaatagctcaaaagataggccatggcttgctagagaaaatgaaaggatactcaaggctcattagattaaaaggctgctaatgttctctaagctgtaagtagatttttgcccacatttatgaaggttgatttctaatcagattagaaatggcataggctggtggcgtcatctcagagctgccacagcattctcaggagactcagccatatcatgttgggttgctctaagaacacacagagacctttatgctttttcacaaaagcatactctttccctggagtgtgtaactctatgtgttgacctttagtgggataagttcttacaatggagctattctgggtacaaaacatcactactctgtgagatttaggaagataacactgtttgctgattttacaagcccactcgagtgtcttgatgtgtcaaaatgggagtccctgaacacggaggaaattcacaacatcctaagcaattgtaacagatgaccttatctaatgagaactggggaagtcctctccttttagggaaagtgaaaaatgtgaactaaataggactttctgtaggagagatgcctaaccacccatgggcatgctcacttctacttgtgcagagagtttgcacaaccccatctcatttggtcctcacatcttctttgtattcattcactcagctaggaaggggaatggaagaacacattctccaagagtagtgcctttgcaacatatttttcaagtaaagtgttgacacaatttttgttaagactatgatgaaaagacaattgagaaagaattgtgaaagccagatcttgacatatgcataaaagtacatggatgcctggctctgggctgattaatgatctgtggttgttaaaatctagttatgcctccacttgggaggagtaggtaagctcccagggcaggtatgaacctcaccattttagagaggaagaaatctcagtgtcaggatgttaagttagttgccaagacctcaaaactcataaatagcagagccaggaccagggttgaaagtctggtgtttcacattctgccacacctctctggccagtgttgttcgtgaacttcgggactaagactccagctcaaatcctatgcggatgtaggtcaatttcttaacctctctaagcctcagttttctcatccttgatgtggggatcataaatttacttcttacgaagatgaaatgaaataatatatgtaagcagtgtgttcaataattgttagttcctttgcccttcctattttctcaccaaggaaatcaggtgcaataagctttagtgatctgctaaggctagataactggtaaatagtgaaagaagagtgaggagtcaacagatgattctgcttcttatttcacgtgctttagtggtatttacagagccctggtgcaagagtttctctttgtacttagagaagttgattttctttttcctaatttcttcttatttgaactaagaaccctctacttctctccatcccatctgtattttttctgatgagttctgtagaatatgatattgcattcaagcttcatcatacttttggtagcgcctttgcttgctacatgataactgtcattttagctgcaatttttcaaaaatctcctaaaacactcttctcacacaatcggcctctcttaactaacttgtagacaattttgcccttctgctcaagatcttttctgcctcctttagatttcctccctatccatttctgtctcttctccctatgccttgatctaaagcttttgtgcattatgggactttctccgaatccattttgtagtcattcactcatgtaggataaatgcattttttaaagcactttcattttcattttacatgaaagagaacacttgggtactggtgaaatgcttaggtcagcaatccttttgggaagatacacatgaggggtattatgtatctcgtctttccctctttcaacattttctaattcaattctatataataaatatttactgagtatctactctctgctgggtattgtgctaggttcaggggatatataactgaatcagacagaacccctttctttacagagcatatatgatgatgtcatctcaaggggagcccaggatttcaggtcacctatgtataaagtgagaaataaaggctggctaggagtcagccatgggaaggggatagaataagttgaacattcatggtaaagagaatactgtattcaagatcctaaagcataatatgttggaaaacagaaaatacagtatggccagaaggcagaactcaaaggagaatgagagccagcggatgcggtaggaaatgtggggaagggtagataaagaagttagggggtttattctcaagacaatgagaaattattgaaagagctaaatgaggaattggtataatatgaaatttaaaaaaattatcctaattgcagtggtcagatgggacaggaggcaggcagcaagtggagaaacagaagacacacagtaaaggagccaacctagactcagtggtaacagagatagcgataagtgaacagatgagaaagatctgggtttagaaatggcaggacatgctgatgattgagctatagaggaagaggaaaagaggggagtcaaatacctgtctatgcactgttcataggagatttaatctagtcaactgttttgagctaaaatgtgaaaatacaaatgccatggccagagcaaccataactattaattagcagcaacccttggcaccttcacccaaagcaatcactatgctgggaatatcagactctgcagtagaaccaaatccaggacatccgtgtacagcctactcacatcacagcatctaactgtgttcacataaaaggcagtgtgaggcataacgacccaactcagaaatgccttttttttctggatgttcttttcctcacaaaacatcaaataagagagtctggccacattctgatgatttctcttagaaacttagagaaggggagaacaataatttcctaaggaagtgaaccaattgaattgtcagatgggctgagcagtgacttcttcctggctctactgtgggcctcctgatggatggacatgggccctgtggtaaagagatggttctagaaatgcacagaaactatcgattccaagttgacaaatgagaaacaaatccaatctcaccagccaatcgggactcatcattttgccaaaacaatgcccatagattgcctaccactattattaagaaaagcttttatgctcatttcaccttcagtgcccttgatccaaggtctcagatttatcctagtttcattttcagtgaagtattgatttgataaaagaaacgagtcctgctgctgattgcttagacacttgttagtttcacctgcatatgtaaggtggagttggctgtagttcaagcaatagaaagaagaggtactattttaacaacagttttcaaatctgaagctgatgttctggaaaaattagagccatcggtttattttattgtttcatttataatctcagtgtgcatgtatcttaattctttgggaatagagaaatggcttcagagaggctggctgaatggggaggcagaaacatccaactctgtccctctgggcttctatctccctggggttcctttcacttttcctccaactttgtttctttaggccctggagctaatgcaggaattgccaaaaacatacctatgtggcacacaggtcctgcatgttcttgttctagtaagtggtgtgaatgtgctgtctctagaattatcttgtcctgtctcatcaagaaaatcccctgcagatgtgaaaccctcaagcaattttctctatctgaagatcaggctgcattatttatttatagttccttcagcctccaaaagccctggctgaccctcagtctttgagaacagcacctctgtaaacagatgaaagggattccctgtctggaatgtcatggaaggttccatgaatctagcttccgctaataccaaccattctagaggataaagcccaccactgcaaaagtgtgatccagcctcacacactgccttgcaaatattcttcaggccaactgatgggtgaaggccaggtttgagaacagcacctttgtagcccatgaagtttcttgacacatttagcctcaaacacttgcagagcagatatagtcgatatatcctgggttcatgaatgacaaaacttttcttcatgctgaaaggccaatcataggaacctcaagtttggaggaagtcgcaaacgtaggagagtaggtgatcttgttatgcttaatatctagtgtgatgctggaggaaagacagccaaattggaaagttggggtgagataggatgtgtcttttccatatgtttaaaggatagtatgctgacaagatattattaaggctacaataaggcaattgaggaagctgtatgtcaataaggtcttgagatactcagagagattagacaaagcagagtaatattttcacctgcttaccctcctcttcccccaaaccataccaatgaacaacatgggccccagccctaaattcacaatctctgatgtaagagcctgactaagcatactggcattaaacataaggatgtttgtgtaggcaaaaacccccaaacaattattttagttatctcaccatgttttcatgtctgtttatgaagactcaggcttcctaggctctctgagggccagaggtctcagagctcaggaggtaactagcattggcccttcctttagtttctctttgatagcttattacttaaggaccccaggggaacagtttcccagaattctaccatgacaatttcacaatattgaaaatatattaaactgacattaacactgacatgcataattcctaccaaagcggggaggccgttttgtcatgcggcttaggtggaggagagatagtaagagctgttaggctctctgaagcctcttagataaaagaagtccttagctttgactataataccagctatgctcaagcctttttccccccactatattctttacaatttcacagttaatctctgcattatggttctctgtagccagaagacattgcagacagggaattgagaggatgcttgagttaatctgcagggtctaaggtggtaaaggcaattcagctaccctcatagcatccccgatgttccgaagaaaggaagcagagcatatgttttacatggggataaattctctttatagctaattaattacaaattgccccccagtgtggtgatgtgcacttggggatagattaactcaggggaggagtccagctgctaattcttttttttctccctccctgtccctccttgtgctcccctcctccttgctccctatttcttggaggctgtgtctcctatcgctctgtttgtacagctagcgctaatctaaaatcacagttattagatcacattaagctcctcaaagtgggtgaagcatctgtgagtgtctcattaagtcctggacacacatagtcttgccacccctctctaattaagagattcccactcttccagcactgctgactgcttcctaaagaaagtgtgcctgccctggaggggacggaagggggaaggagtgaggtaaagtaagggtgagtcttctccatagaccgtgaccttgcccagcagtgtggcctgctggaggagcagcagtagcacctgggagcttgttagaaatgcaaaatctgagccccatctcagacctattcaattgcattttgtagtttaataagacctccaggtgattcatgtacacggcaaagcatgagaagcactgaaccaggaaatggatagaggagtggatcccaggatgcaaactggcagaatcccagttgttaggagatcacgccacaggcagaattcatctcagcagaaaccgaagtcaccaatggcaagtgttcgtgtatttgtgacattccttgggaattgtgtttgtccttgcacttgcgattttgccttttaaaagagcattttggggccaggcgcggtggctcatgcctgtaatcccagcactttgggaggccccgaggcaggcagatggcttgaggccaggagtttgaaaccagcctgggcaacagggtgaaaccctgtttggtttcatctctactaaaaatacaaagattagctgggtatggtggcacatgcccatagtccagccactcgggaggctgaggcaccagaatcacttgaacccaggaggcggaggttgcagtgagctgagatggcaccactgcccaccagcctgagcacagagtgagattctgtcttttaaaaaagtattttgaaagagtaaaaggagaataataatgtcattggacacatttagaacctatgtatgccaagcattgggagtagaatgcaaggcaaacatggctcttaagaaattcacagggaaggaagattctgaaataatctctctgttcagggctctatggggattcttaaatattgggcttatatgtcttggaagaagagacattaaagtgagattttaagtaagaaaaagtataggcgtgggaagggtgtagcaggcagaagaagcagtgtggatagaggcccagggataggaagagccttgccctcagggctagttcagattggctgcaatgtggggcctgaccagagagagatggtgcttggctgcaagggtgggccagggtcatttcacgcagggggttgtaagcctggtcattaggagctttattctaaggacatcaggaagctgatgaatttttaacagagaattctgagcaggagatgtcaatgaatgtcctgattgtcatccaggtgccagctgcattgactcagcattggcccacgcacactgcaggctgagggtgtggtgtacacactctgctgcttccctggtgacagcattccaccgactctgcccttagatacagtgaccccagatgtcaattcagaaaccacacacccacgttacacagtctgtaagtgaccagccactcaggtgaaacaggagacttgagtgatggcagcaaaatgaattgcctccaaattcaactgaatatgaaaacatggatgggttctcatttcccttcaacaaggaagttccatgtctcaagcactcttttagttactagggatagatacaacagtgagcaaaacagaaaaaaaaaattctgtatttctggagcttacatttggggttagcggctgggtgacttgtatcgatttccatcattatgtccttaatttcacagacgctgaaactgctctggtttttggctatttagagattgcactctcttcctttgtggcttaagctggtgtcacctttacagtaagatatgttacctgaaagagcttttaagaaaattaaatctattttctcctgcccctgtggattagaggaaaacttcctattgcccagtagcattttttttatgctctcagtgaataatgatgataatggcagctgagatttgaatggtaacttgggtctaagtactgcatgtgatacatttagtcagtccccacaaacctgattagaaaggaattacctccagcattttacagaagaggaaatggaagcttagagcagtgggtaacttacccaggttgaaattggcagagctgaggtccaaatcagagaaattcagcatcgatggtgcaatagactctaggaagtggcctcatatatggtctagtcaatagaagaagccagaaaacgcttttcagagaatgagatctagtcttgtcaccttcttcacttaccaccttttcttggcttcccaaggctcaaagaataatatgtaggaactgctaaaagataaactggggcacattcaaattttaaggagtttatttgagcattcagcaattcatgaatcaggcaacatgagacttgggctgttcagagctccatgacaagggtgtgaggggaaaccttataaggtgtttacagaagcacaggaaagaaaatgtttgattggttaaaatggaagtttgtagttcgaggttaggcgttagtttcggattgttaagctcgagttttgcttttctaggctatgactctactctgagttgggttttggtttgcttaggtaggaacccaccacactggagctgactcagcctaatggtctcccagttaattattttaacactatggtggggttacaaggctctgtaccagttggcctccgtttctttgttcagccccagtcctgggtactccccaccccacaccgttctcctcactcccagccacacaggccttctttcagtccttaatatttcccctgtttctttctaccacacaggctttgcacattctcttctcaatgcctaggatatgtcttcttcacatattttctcaaacacaaatgcagatctcagtttcaaggtaatttgctcttggaagcagtccctaacttctctaactacatcaaatcccactcttcagttagttccacctttcaattgcaattaacaaaattgtaattttatatttagtagtgcagtggttttcaaagtgcgactgccacaccagtggcatcagtatcacctggcaacctgttagaagtagaaattttcccactccactctagacctactgaaccagaaactctggaggtgggtggggcccagcaatctgagttttaccaagttgtcctactgattttaatgcactgtgaactcgataaccaccatttcagtatacactttttttttttttttgagacagagtctcactgtgttgccctgtatccacacctttttataatatgcttttggaggttttcccatcaagaggtggaatatatttctctacttatttaaaatacctgactttggacttatgttgtctagtaaaaggcagcaaagttacattgtgccagttccaagcctagatgtcaagaggctctatgctcttccatttactctcatggaatgcccaggctaaagtgaagtggcacgatcatagctcactgtcacccccgggctaaattctcccacctcagacttccaagtagctgggactatgggtgtgcaccaccatgcctggctagtttttgtatttttttttttttttttttagaaatggggtcttgctatgtcgcccagactgttttcaaactcctagcctcaagcaattctcccaccttggcctcccaaagtggtgggattacaggtgtgagccactgagcccagtctagcgcatgcctttaatggatgccattcttccctcataggctgttggttctatcaggacagagactgagttgttgttgattctctcttgatacccttacttgctattcagtacatgttaggtatccaattaatagttgtttagtcaataaatgagtgagcacacttgacttttgtaatgtctttttaaagaggtattattttacagataaaaaacacctgaggctttgggagttctattgactgctaggtgtgagttatgttgggtcttgtgaatttacaagtttcttctttggagaaaatagcaaccgtagcagctctaggtgcaaaacatctttgatgaagagattccattggtatttcatggataggctgaggaaaggtacttagtagcagtcccctaccaacctgaaataaacctgttttgcttccttccttactcaagcatttctcaagtatactatagctgatcttggcattaccaaaatgaatactatcctcagaaagcttaaattatctgtatgtttacctatctgctgtgtgtatgtagatttcctatagatacacatttttctaaaaaatgctaggcaggcagtgacatatgcaagagaataataatcaaattagtaccaaatacttccagttgaaaaacatagattatgtatttacatgatggttttggacatggaaagtatgagagatatttctcacaaggctgcttatagcaagtaaaataccattagggtagtctctttttcattgaattattcatccagagtcattgagggcttccctagacaatgtttatgtattttgtgtggaaagtataatatccaagaaaaaccattttcatattttttaacacttttaaatggttcactagccgggtgcggtggctcatgtctgtaatcctagcactttaggaggctgaggtgggcagatcacctgaggtcaagagtttgagactagcctggtaaacgtggcaaaaccctatctctactaaagatacaaaaattagtcgggcatggtggcatgcacctgtaatcccaactactcaggaggctgaggcaggagaatcacttaaaccagggaggtggaggctgcagtgagccaagatcgtgccactgtacttggctctgtacaagatcagcctgggtgacagagcctgggtggctctgatcgcccaagctcagcctgggtgacagactgggattctgtctcaaaaaaaaaaaaaaaaaaaaggttcactgtaaaatgaaagttttgttgtacttgctttttaaaatcacatattccattctccctcacccttgctccaacttttaaaaattgactttgtttaaaaaacaaaaaacagctgtacttggcagctggtttggaaacagcattgaagaactgaggaatttgcacaattaacagctatacatagatactggttctaggatgaaaatgtttaacggtgtgccaccaactctgttccgtgtaatagactgattaaaatcttatttacatttcttccaagttcttacaaatcctatatttctccttaattttcatttggtgggttattagatttggttgaagggaaagcgaatgctgtttaagtgtttaacaggctgttttctctactcagctgatgactgttatatttcacatttactctgaatttgaaaactagctttgcaatctcagcagaacttgttactctcatctgaatgtgccttgcctccaccttaaaacaaacctgaatcttaagactgatggttcagattttcataacaatgattaaaataggattctgggtggagcacagtgcctcacgcctttaatcctggcactttgggaggccgaggggggcagactgcctgagctcaggaactagagaccagcctaggtaacatggttaaaccccatctctactaaaatacaaaagaaattagccgaatgtggcaatgtgcacctgtagtcccagctactcaggaggctgaggcaggagaattgcttgaacttgggaggcagaggttgcagtgagttgagatcgccactgcactccagcctgggcgacagagagagattccatctcttaaaaaaaaaaaaaggattctgcatgacaaattaattagcaatcatgtacctcccatgtgctaggcagagcccagtgttaggaaaggctaggcctcaggaaaggcatagtgtctgtcttcaaggtatggagtctgtctatgctagtcctcaggaaaggcatggtgtatctgtcttcaaaacactgaaactctgcatttcccaaaggaggatggctaaaggatgagattcacataatgacattgtgaatgcagtgtggtatcctgggtcggctcctgaaacagaaacaagacatgagtggaaaaactgtgaataaaaaatgtgaataaattctggggtttggttaatggtaatatgccattgttaatttcttagttttgacaaatgtaccattgttgtgtaagaggttaatatttggcaaaattgggtgaagggcatatgggagcttacattagattcataacttttagatttgtaacttttctataaacctaaacttccaaaataaaatgtttatttttaaataaaagcactaggattctagtaaagacttactggaaagctcctgggttatttatgggaaataattattttcaggaaagcaccccattcttgccctccctccctgcagccttagaggatgtgtgaagaattaactggtcactgggagaatgaagttatcttttgtggataagggctgtgcaaaatgaacatagccttgtgaagtgggaattagggccacatctggagaattggtacctgctcaccactttataattgtgtggcttcgggtcagttaatgtatctgagcctcaggttttttaatctgtacaatgaacgtattgttttgcttatgcagacaatgggactactctaatagcgaatttaaaataatgttgtaaaagtgctgtaatcactgtgctctaaaaatgtaagaaaggtacttaaaccttccagccatggccaacatgactaatgacagctgagtggtacttctaggtacttcccagacttgagccttcaacaacctgaactccattgctttattgaagatggagagacaaagctttcctatgaaaaaaatggccaaatgtgtgttttatcctcctctggtggatagtccaagcattgcagcctcttattggacttgagcattatctgcaagagcagttccagacagctcttatgtattgcagtcgctctgctccctgcattccaccttcagggcagctccatccgtttttctttcttatggtgcctcaaatggccttacaacaacagcgtactattaaatgtatcattttttgagaatgcgctaatgcttttccccttatacctctagggtttactttgtcattctgtccttttatggtttatttcaacatacttagcataaagcctagagtggtgggatgcaatatcttaccttagctgaattgtggcctggatcatcagtgtccttcgcaaagaagtatagctgtagattctccctggaggaaaaacccatttaatatttagtttcatctcctttcattttgttcttggtgtaccagaaaagcagcaatgctggctcaggaaagagggacttttcagcaattcatttacctccctagttttgaccttcctcagctggatgtaggaaaaaaagatgttctcatcctgacttcacccacaccacaaatgtacatttagtacctcatcctccggaccagatgttaggcactttaggttcaaagggttgctgcccacaagagttactaactgggaagactgaggcaatgcattaaaaaagctcacactctgcctcatgtaatcaatgccatctggtggtatttccgcttgttggtaataggtagtgataacaacaagaatgataacaacgacaaacattaagtcagctctgtgaaccagcctctaaccaggtgcattatatacgatatctcttttgatatgtccaacaatactagaaggtaatactctttaagatatttttgcaaatgaggacactggggcttgatgaagttaaataacttacccagatataaccattgtaagcagaggagtaaatattttgattacataaatatatcgctgagttctgtcattcagtcttttctcatgacttttcctcatttgtgtcacacatcactcatcagtcttggcatatcatttttcctctggagattctgaaattggcctcgcattgcttcttagccctgactctaagcagccatgatttcttgattagggttggcatagaagataaatcctattttccattcagcgaataaatgtttgttgaaagaaaaaaggcaaaaaattcctggctgaggtgtttaaggaaaagcttaacagaaggagtagaaatttgtctcagccttggaagaaaggtgtagggcctggtaagcaaagtttattatgatagtagcttgattattgagtgcttactttctgtcagcttttgactatagccactgtcaatccatttaaagccacagcatttctagatgatatgtcctattagtatgcccactttacagaagagaaacagaagcacagagagttaagtagcttgtgcaaaatcacatagtctgttcaaggcaaagccaggacccagagcctgcagtcttttttttttttttttttttttttgagacggagtttcgctcttgttgccctggctggagtgcaacggaacaatcttggctcactgcaacaacctctttctcccaggttctagtgattcttctgcctcagcctcctgagtagctgggactaggcgcccaccaccacacctggctaattttgtatttttagtagagatggggtttctccatgttagtcaggctggttttgaactcccgacctcaggtgatccgcccgcctcggcctcccaaagtgctgggattacaggtgtaagccactgcgccccacctgagcctgtagtcttaatacaccatactattttaagagagcagagatgtctgtttactgatgtattctaagggtctggaacatagtaggtgctttatatatagcgaatgaataaaaataccctctttctttggtaaaataaaagaggaaaggcattctagatggggaaaatagcaaaagcaatgatgaagagataccaatgatttgttagtgataaatggatttttatacagcaagaattgaacatacatttggcaaggcggattggagccagcctaaagagtttagactttttgtttagctctcattatcagaaatcgtcacttcctacctgtccaggtttgcataaaccatggatgctctgttttatggtcccatataatgaagattatgtgtaattacttcatagtggattgcactctagcaaaattaactgtccatatttcttctcatgagccctttgcgttaataaatgatgcatttgaggaggcaaaaatggttgggattttctgtgggggaattcctcatgaggagataggaggaatcatggaaaatacctggttctaacaagatcttgattattgacatctgtttctttggcttttcaaggtagtaattaccaaacagagtagtatagatcaccgtaatgacatatttggaattttctgagcaactcatgtttcatgtaaattgaggtatttcgatgtgtttcatcatattagcaccatagaatgccatatctagaactggggaaaggaaattattcataaaaaacaatcttcatggagaattcagctagagaaaaagacggaaatgaatcaaaattccccgcaatcgctcttttccacccaccattcacaatatgtgtttcttcttgagacctcaatatcctgaaagaaaatcctctgtctcagaaagtggaattaatccaggtaatattttgactggattttgactggtaatatcagctgttgctgataaagtcaagattaatgattccttggctaccagtgggctgagagtgtgaaagtcaaaacctgttagaaaccaggggaattgcccatgaaataagatggctttgtgaatgcgtaggtgactctgatttccagaggggattttgcagtaaatcaatccttctaagatatttagcttgtttaactcaatgacattttcattcataatgcttttatttctcatctcaagcaggagagacagtatcagttctgcacaaaactgagcttgaacttttacttgattgtattttcccatctataaactcttatcagggtgctaaaactgggaataaaacctagcagtttgaaaaaatataatcattttattaatgaaagagtctgtggcttgtggtagagtacacattggggcctcatttgaagaattaacaaggattaaggaagagctgcttttcatgagtgcttctctcaggaatatctgtacgtaaacatattagaaatgagtgctggtgagcactttttggacagcatttgatgtaagccctgggagaaagatgaaaaataacaacctgatggtatttagagtttattcatacatttttgtgtatattgtctcattgtaattctcataatagtttgtatcaagcagggtgttattatcatcattttacagatagggaaattgaggctcagatggattcatttactcaccttgggtcctgcagaggaaaagtgaaagcaagtgtttaaacgttgacactcagatctcttactccaaagaccattctctttattattaaactattgattagcagtgattcacaaaggtctgttttgtctcctacaaatgtgtcattgtgtatgcatgactgaacctgtcttcttaggaaatcacgatgtatcggtggttcctgatttcttttttagcacataacatacctttctgaccctgccacctaatgcaaagtgtactactattcactcattctgttcttgcattttgtagattccaaaagcattcattttcacacctactatgggagacggagttaggtaagggaacggacgagcgtagacttgaatagcagctctttttcttaccagcggggactttgcctctcagaaagctacgcaatctctttgagtctcagtttcctcactcataatatgaaactgagagtagtactgactgtatatttttgtaagaataatgtctgtcatcccctagcccattggaggtgtcaacacatgggggtgagttaaaaagagaagggtaagacagtctccatcatgaatacatacttagtccaaagggcgggggaagaagcaaaagtattgcaatcagtgctgtttcctcagttgaataattaatgtaataatactgtttacccaaaaaggataaaatgggataatgcatggagaacacttagaatcatgcctggcacatagtaagtgctcaataatttttagctctaatcatagtaattagtaagtgctccatcagaggcttgcactggtactatggttgctctgaggcaaaagcttcaatcattgggctaagtcagagaaggcatcacaaaaacagtgccatttgaatttagtcttgaggcatgtggaggagccttccatgctgtccagagttcttcaccctgatggctgatttcataaataagcttaagtgcaatgtgtaggaaaattggagtgaaagttggcaatggcgggagtgctggtatgtgttggagtaagggtggcagggactacaatgtcactgccaacaaatggcaaattttatggaaattaaaatatcctgcaaagtgcggattcaaggcaatgctgtcccctttgctacaggtccactgcattaatcacatcctttattacaagtgtcaacacatgattgggagcaaaattctttgaggcttaactgtaaaggaagaaagggataatggcacaaatgctgacctccattcaaatcttgccttaccactaactagctgcgtgatcttggagtaattgcattgcctttctgaggtttcattccccagatcttcaaaggaagtgacaattatataccttgaaatgttgttgtaagcatttgagataataggcatacagtgtgtggtgttttggtagattctcagaaaaataaaaatactatatataattataaatatgattctaatttattttataaattataatatatttacaattatagctaaataccaagcactgtgttaagagctttataggaactatctcctgtaatgatgacatgattaataatgacacatgatggtgatatgattgacagaaagatatcagcaggcccagatggaggatatagagttcttttaatgacaaggatgcagaaacatacggagattgtatagtacctagttttaaagcagcatgcacctagagagaggtgcagctttctgggtctcccagtgtttccctgggacacacagctggggataataccacctacctggagtaaggattctattgggtgcaagaagctccctttgctgtcacaagggtgatttaatcccttggcatttcttccttcacatctgactgttctgggaatctgttgcaacttagagttgcaaggaatgaatgcgaagacaccctaggacatttctgatagttgactgtgacactaggtgatgagcatgtcagttcctcaggatcattccttgggagaactggctttaggtctgtctaatgttccccactacagagcactcagtaacttacccaagatcacacagccagtacatggaaacattaggatctaaacatgatctaagtgttcctaatgaccatgccatatccagttaagaattgaattgtgcatacaatttacaaactagttaagagtagagggaggaaagccaaacatcaacttccaaagcaacagaagttagatattctataataaagttatcggttgcatgttgccggcagaagtaatgaccaaaggagttagagaagacagatgaccaagggctggaatagctgttgaggaggaagtacattcctggcatgcaaatgattcattgcaggagggcttaccacatctgatataccacgaggcttccttgctttccagctgaaatacaaccacaacttcaccctcactttcctttcccgttaagctgcccacctatcacactccaaaacaacatgtgggaaacataccttaaacagcttttaaacttttcttaattctccccccaccacctcttctggctccatagagaataacaattgctaagcttaaaacatgttacaaaaatgttaagaattcttttctcacgttgccaaagtgactactggcttagaagaaagttggaaataagtggtgaaaagcagcttagcagaggggaaatgcgtggtcatttcctgaatgtaaaaaacacctagggttgggataatgtgaaaaagagacagtgattagatcaggcttccaagagttttcgagaggagtgcaccattagaccttgctcagcgagccaccgtccaaggctccctgatcagtctatttggctaagagacaaatgtgccaacctccccagcctcactcaaggactgaggaatcaatatctgggggcatacttgcaaacaattcataaatcttatgtaaagggatttagacaagatttgctttgctagtgaagggagtgggtagaagaattatttaacctgcagctgggcaggttaactagagagaggaagctaaatgtatgctatggtcacctctgtagaggaagagagcacagaaaattttaccttttcctggattaccttcccttcttgtttgcctggtgtcctttttttgttttgtttgtttgaaatggagtttcactcttgttgcccaggctggagtgcaatggcgcaatcttggctcactgcaacctccacctcctgggttcaagaaattctcctgtgtcagcctcctgagtagctaggattataggtatgcaccactacacccggctaatgttctatttttagtagacatggggtttctccatgttggtcaggctggtctcgaactcttgagctcaggtgatccgcctgcctcggcctcccaaagtgctgggattacaggcatgagccaccgagcccagctgcctggtgtacttttaattattcttgaagatccaaataattgcttctcttggaagctacctttcacaggcagacttcatagcttccatatttgttcttgaatgaactccataggttacaaggatttcctcacaagtctgtttctcctgctagagtcactgagattgtgatactaaacagtgacttactcatctttgtattgctactctctagtagagtgagtttactggttaaagcattttcattaaatgtttgttaagtgaataaatgttgatatatatatatatacacacacacacacatacatatatacatatatatctttatatattctcaccttcccccatccattatttctttggctaaggccacctggattttctctgttttcatctccatatctatagactgcatagacctctcacacaaatttgcattgctagttgaggtgttctttgagcttctcagtggttatgacaaaaaggactttagcagtttgtgactgtgccctggaatccttcagcagactgaaataccttcagctgaaggagatggtgtttatgcagaagcccagcacctagcccatcaagcagtctgaggtttcagttggtgccagagataactccagtgagagaactcggtctaggtttttagaagttcttccccagctaaagatgacatcttaatatataaaggtttaataatcatggatggtcctttgtagacatctattgctgtggaaactctagttctctttaccttgagtagcttcttaaaaagaaaaataaagagaagaactagcagtgggaagggagaaggggtatcaggttgtataagcaaagtgatttctctggcttatgcttctataaatttgtttataaccacaaacctctggtaacagggcatttgcagaaggaaaatatttatagaagtctaccttgccaattacattgcaaaaaataaattgcctttagagtccttaaaaaaattcaaatatgttttccctctccactgccacccccacatcaataatttgcagctcgaggtctatgtctaaaggataagagtttccacaagttgattgtggatatctgaaatcaaatttaattacatgtgatggatcaacttcttgaactcccatatttctttcattgtcttcttcggattccatgcctcacctttgtggaaactgaactatagagaaatgataacatgactcagagccagccctgcaatcaagggggagtcatctaacccaaattggtgagttcaggtcagcagcatatagtgtcttggaaagagcatgggctttgcggtcagatagacctccttgaatttgaaacccagactgttattaattatattgggcagaattcttaaactctcactctcctcatcttttaaaatgaggtttgaaattcatcatggagctagcatgatgatttactagggaacatttctctgggtatcaaggtcctcaacactcagattgcacttgctctccaacagaatttcccagtaattccctatgctagttttcttttgctgcataacaaattactagggacttagctgcttaaaacaacacacattgattacctcaccatttctgtaggtcctaggtccaggcatgaattagttgggttctttgctttaaaactgcacaaagatgcaatcaagcacagggttgtgatctcatctgaggcttgggatcttgttccaagctcacacggttagcaggatttaattccctgaagttgtaagactgaggccctcagcttgtagaagctgctcagttccctgacatgtggcctttccataggtgtttcataatatagcagcttcttcaaagttagtggtaaaggcagtaaagaaatacatttacatttatatttactaatgtaatcacaggaataacatcctatcacctttgccccattgtattggttaaaagcaagtcacaggattcccacccatcctcaagggaggggaatcacatgaaagtgtgaatatcaagaggtgaagaggaccgtgtcaccctagggtctatctaccacactgtcaacgtgcaatacccctggcatgtgtcgcagagcgccctcttgtctgtgtgggttactaattgttacagtgaaattagattcctctttccaaagaagtcagagttgtgaaatgcttgggaaactatgagctgtttccccatcccttactggtgtagacaaaaataactgatacagggcttttatttcctgtgggttcacacttagtctcggaatgctttaaaagacaacacactagacagaagctaacatttggtcagtgtcagaaagtgttataacacctattcaccattcttgaactatattatatcccagtgggctagaagtatgggtttgtctagcaccattttaagcttagtagagagaactcatctcagccttgtccctgggtcccttgaagtacaagtgtccttagtaaggacaatgacaattcatgtggaattaattagtagaaattcccacatataaaatttgtccttcactctatttcttaacaggaaaaatcaaatcaaatacattaacaccaattagatgacaacataatcgaaaacaaatgtgtttaccaaaaaaaaaaaaaaaaaagtacagataggtaactagggaaattgttaacccaacaaagagagactacatgagtctgagtcccttgggaaggataaacatgtttgtaaataaatttatttctctgtcaatatttacttttctttgtgttcctctccatgtgctgagaatttccttctcaggccttcatgattctatgagtgaattactagaaatgctgttagtctcattatttttgtaaaagaacaccttgtgcctgttcttgggctcaatttaagttagagaaaaacaaaattcatgcacatgagagagttcttataagatggaagagacatactattgatctaagacttatttgttttaataggggtccttagtcatgaattatcagtaaaaagcattttatagtaagtgcaattttggcaagaccttgtttctctagttgcataaggaatcactacatgataagaaacaagaaaagtttactggcagaaatagagaaaagatatgtacatctattttatctacctaaacataagtagataaaaatatgtgtaaatagttccttatgtcaggaaactgtgtctgaatatctttctatccttaaaggcccggcacagtgctaagtacatagtacacagtaagcatatagtaaatgtttccatatttcagggacagagtttggacgctaaaatgccaatatttgtttggctatagtgatttaatccaggaaaatagaaattagtttccatgctgtctctggaacttccacaccattctcccagcattttcatctattcaccaaactagaagctctccaaaccccatgttttaaggtttttaaggaggatccattacaaaggcatgattaattaaatcattgtccactggtaattgactcaatctcctccatcttcatctccatctctggaagtctgggggtagggtttaaagttccaaccctctaatcacatggttggtttctttggcagtcagtccccatcctgaagctatctagggtccattaagagttaccttattaggataaactcagattatggttcaaaagggctacttatgaataacaaaagacactctcctccctgtcactcaggaaatttcaaaggattttgaagctcttgtgatagaaaccagggacaaagaccaaatatgtatttcttattatatcacaatatcacaggctgtcgctgtatccaaatttcccccttcctgtaaggaaattaaaataaggccaaccctcatccagtatgaccttgtcgtaacttgattatacctgcaaacatcctatttccaagtaaggtcacatttataggtactgggggctaggacttacacatgtctttttgaaagacacaattcaacccacaacagtaactaattgacttcctttctcctgagctaccctgtgattgaggcagagcaattttctctaaggacatagcactgcaaagatagagcctataatcaaacatcctagttgctctttaggagctcaacctaggtctagcctgctcaatttagtatagttcacttctacgaataatactgaacccaaagcaagactctgacgaggatcgagaaagcagtgacacacctaaccatgctgtaaggcagaatagaagagatataacagagatcaagtgtgtaatctagaaaagggacatattgattatgctgaggaggtaggcatgggaggcagtagccatttgagaggcagaagcagcaggagcaaatgcatagagacaagaaacttccatctattgagtgactggttccacttggctgaagtataaggtaagtttggagggacagggatgccagggtgtggaaacacaggtttttgcttatgagtcttcaatgtctgagaaaaaaaaaaaaggccgcatgggatgttcttgtctatttttgctgttaggtgataaataggcagatatatctaggtatgtgtgtgcgtgttgccaagggatctgtatttatacagatttagtgacaacatttattaacacaacggggtgataggctttggcatcaggatgttgtaatagttgtaatttggcttgtatcaacatccctatttttgcagatgagtaaactgtggctttgaacaataaggacctcacccagggtcgcccagcgctggtaaatgttgggtttaggaactgaacccaggtctagctggttccagagcacacattggtgctttccgtggcgtggcctgtaggtgacttctgagggaattcagctccttggtgctgagggcttagccatgattcctttcagagtgagttctccatgtcttctttggccaggttcctgtgctcagggggattttcaaagataatggtgtccactggagggaaatatatcttggagcaaagatgtgcaaggatggttccagattctccattcctatttatgaaaactggcagatttgctgactgtgaacatagtggccaaagggctgaatagatatgagcatttgagagtaaaatgtgttttgggaagctttaaattcttatttttgaaataagataataaatgtccaaatcaaatgggaaattagtgaccaggttaaaaaataaactgaggttttccaactccaagttcagtgtattttctattttgttaaaaaagtaaaagtaaattgcaaagaagatacttggagaggaggaacaaagtaagtaaggcaaggacatgatggatacagggggattaactggggagggaatgtctgtaaagtgtataaattttggggttggggggggtacagctaaaaggagctgtcctaaatcctggcaaaggccctccactttaataagcgttgtaactttctctttcattgttggaggtaacacgtatgaaaggaaagcagcaatcagaacaatgcagtttcccagagggctctttagcagaagtctcctgtggttccatgctgttgttaatgctccccttattttagtctcctggactccctaaatgctttggaccacttgagcaaggccacgttgctaattgtgcagaaccccttcagaggtggcaccgctgagcaagaccaggcaactcaggctctaatgggccttgattgtggtctctggagcaaaaaccacctcttgaaagctgctgtgagacagctattgggaggtttggtaggaagatttagtgctgctctttgaaggatcgatgtctaagctcttcaaaacctcctgacacctcagatggattctaggtggttccccagtgggcacaatctcattatcatccacatacatttatttatctcctaataggggcccatcactgtattatgagggccgcaaagcctagctatggggctaaaacaagcacacatgaagcaatgaatgagtattaactgctgagatgtatatttctgatggcctcttcaaggtgcagagaaagaagatctcctccaagagaattaaatggtcagaattggggaggtaaaaattagaatctgaagaaactaaacatgctttagagagacaggtggttggcatcagaatgaattcctggcaatagggagcaacctgcagacagggaataagaatgtacacagaatggcctgagtagaatagaaaatgtgtgtctcttttgattataacaaggaagaagtcaagtttgtttttagtttgtctgtaacacccactcattcttaccaatttgccttatttgcaaagagacagctgtgcccaggcctttagaaaggaacagtatctaccgtaatttattggtattttattttcattctacagattgagtattccttatctaaaatgcctgggaccagaagtgtttcagattttggatttttttgggtctggggatatttacatgtacataataaaatatcttggagatgggacccaagtctaaacatgaaattcattatgtgtcatatataccttatatacatagctggaaggtaattttatacaatattttaattaattctgaatacctgtcacatgaggtcaggtatgaaattttccacttgtggcatcatgtcagtgctcaaaaagttttgaattttgtagcactttggacttcagagtttcaaattaaggatgctcaacctgtatttatttttacggttaacttctataggcaagtgacactggtttcaatgaaaatgtatgtaaatgaaaagaagtgaagcaatttaaggaaaaagacgaaataataattcaggtagtatatagatggggcaaaaatatgtgatattgacgcaccattgaccaaagtttgggaaaaagaggagtcatagtaaaatgttgatccttgtgttgaagtttctgatcctccttgcactactcaccatagatactccagaaaagtggaagaatgagtcaataaataaatcattcatgacttttccaaaggaaataatccaactatctgctaataagtgtcaaaactagggtaatgacaatgataaaaaggaatcaatccaggtgacacttgagagtaagaaataacaaataacagatcagagttaggtcaatgtttcttaaactttaatatgcacacaaatcatctggggattttattaaaatgcagattctgattcactaggtctggggtggggcctgggattctgcatttctagcaagctcccagggaattccagtgctgctagtcagtgaaccacatgttgagttgtaaaagttctgggtggtatcagagaggggcagaatcacagtgaactgtaaagttttgtgctactttaaaattttgttgaaaatgcaattttaaataagaaattaaaaacaaacttctacccctaaacattctaactcggaggaagttcttttccctgtaaactttagtaatgtccttcaattctataatctcttgttttatttctgtaattcatttttagttacgttttgttcttgattctcataagcataaagtcccgattggctcataataaactctgagtagacgaggcctgtgaaatactctaaaatcatgatttcattaacacgggttgtttgcacttgaggatgaagttgcccaatgttacactgtaatgggcaaaactgctttgcaaactcaagttctctaattctggatgcttttgtgtgatgacttattgctattcccatgtctctataccaatgacaaaacctttcaaccctctgagtttttcccctagctcctgggactatgggtgggagagtctgagggtcatctattgatattgaatgtggcaggagtgagattcctactcctccccttcccttgcccttcttttccaagggcataagaaggaaagcatggagtgtcagccaggctgcatggagctgcctaccagccagaacctgctaattcttattttatggaagtacctgtcatgtttggccaaatctcctacagaaggataaaggaaccaacacagaattcagctcccacactcccctgcagttataaaacttacttagctttatttaatttttaattttttttttaagtttagaagcttcagttgagaactgcaaattaagttgcgttcaatagtcttttccagctcatatgctgctgctaggttgcaattattgctcgacacccttcctcagtgttttgacatcttcgccagcctgagaaactaaaacacaattatttattaattttaggtgagttttcttcaattttaataattcctatactttatttacttatttgtttgtttgtttgtttctttattttgagatggagtctcactctgtcaccaggttggagtgcagtggcgcgatcttggctcactgcaacctccgcctcccgggttcaagcgattctcctgcctcagcctcccgagtagctgggattacaggcgcccgccaccacacccaactaatttttgtatttttagtagagacggagtttcaccacgttggccaagatggtctccatctctggacctcgtgatcaaccctcctcggcctcccaaagtgctgggattacaggcatgagccaccgcgcccggccacttattttcttatttgcatgctttatacctgctattacttagttcctgtgatgtttcccagaaatatggaattagctgtgccagacactatggccagaagactcaacagtcacatagcgttatgatggttaaatgctaggattgaatgttaaataaattttaaagtaaattttaagtggctgcataataatttattgtgtattcactaataataaatcctaagaatctaatatcccaagataaatgagcccaagaatttattcagactatattctgtaatattctgtgtgaacaaagggaataattggatagtttgaggggtaccatgatttcttacatgttgtacaacttaaatattctaagtgtatcttagatcacatgctacaaatttctattatcactattaatagctatcagatattgaactctattaagcatcatgtactttagtcaatatttgaaaccactcattgaggtggatactattatctccactttttaggtgaggaacctaagagtcaaaaacagaggttaagagcaggtgtggtgccttgcccctataatcccagcacttttagaggctgaggcaggcagatcgcttgaggccaggagttcaagaccagcttgggcaacatagtgagacccttgtctctacaaaaaataaaaatacaaaattagctgagtgtggtagtgcacacctgtagtcccacctacttgggaggctgagacagaaggattgcttgagccaagggtttgaggctacagggagctatgatcatgccactacacgctagcctgggtgacagagtgaaaccctgtctctaaaaaaaaagaataaaaaatagaggttaaataactcatgggtaatgagtggccaagcttagattttaactttttaattctaccatccatgttctcaaccattacactacacccatttaatattatcagtagatttatctgtatctatcctgaaggtatttattttcaacctatatacttcctgcataatgtgatttataatcaatatttttattccacccctaatgggtataatgcactatgctcagttctgttgagaaatgcacagaagtaaaagccatggtgcttgtttaagagctttttacaatcttgttaggggtgtggtgtgtacatatatacaaagtttagtttagtagaaggcctcagcatctatacaagttagtaggataaaagctatcccatactcagaaaaaaatttcaaattagtatcatggttaagagcaacttgtctaacctgtggcccatagggcacatgtggcccaggatggctttgaatgtggcccaacacaaattcataaactccttaaaacatcgaggtttttgtattgttttgttttttgcccatcaactatcattactgttagtatattttatgtgtggcctaagataattcttcttccgatgtgacccagggaagccaaaagattggacacccctggaattttacaggaatgaggtgccattgtgagatagggtggcctgacatattctgctaggtcaataagtatctctgatgtggaaaataactaattgtgggttatatcataaactattctctttttaatttgaagacatgttcctttctttaggtatttctcaatttgttaaacaaggccatgtttgatatctgtattttaaaatactctactccccttttatccaagatttcactttcctcagtttcagttatctgaggtaattcctgtatgaaactattaaatggaacattccagaaataaacaacttataagttttaaattgcatctccttctgagtagcaggatgaaatcttgtgccatcctactctgtcctacccagggtatgaattactttttgtccagctggccagttattagattgtgttaacctttggggattcaccaagaaccaatgttatatatgatccaagagtccacttcagtcacacactcacacccagaatgccagaacttgcaagccactgtgtaaaatatagtctggaaattattttatggaacatagttatatggcattatatgaacagttcttcaagcatgtatacatataatgatagctatattattaaactgtgccaattgcctgccctaccctttccacattttaactctgattcctaaactgttagtaaattcagaattctgagtagtgttgtgcaatttcaaaggacctgccctttcatcatactgttctgtctctgattaaataccttctttgtgtagatccttatataacatagagacagatataatccttctaaatggtctcgtaattttgtataaacccgagcagataatagtattgggggatataggatttagagaaatttattctgataactatgagaagaaatttataggtcagtgtggcattatattaatcctttttcatcttatcacacatttggctcagaatataaaatgtgtacagacatgagatctgtacattaggtagttatttatttttctttgaataattcctttctaaaacaaaatgttggtcagcagaggtggtaaaaatgctagattgttggtcttgtttgctaggattcatgacctgtttcataaaggactttgctaggatttgtgacatgctccatgaaggacttaacttgatcagacacattaaacttcggaactgaaagaaatatctgagcttgttcaacccagaggttctcaaacttcagtgtacatcagagaccaactggagagtgtattataatatagtttgctgggtcccatcctaagagtttctgattcagtaggttggggtagggaataagaatgcatttttagcatgttgtcagatgatgctgatgttgctggtctcagagccctactttgaaaaccactggtctattgtaaggctttctttttacctatgagaaaactgaggacatgagggaggccattcatgtacatatattattcaaatcctgttcctttccatccaaaagccctcatgtggtatcctgttgaagtttgaataaaatcccaaatccttattatctagaagatcttgcatgcctgttctctgcccatccttccatatcagagtctccatagagccttacttactttcactgcagttattcaatggacacattcttatttcagcatgaaaaacaactaatatgggcacatggcacagaacaaaagtgaaggtttgacttacagagaatttcaattccatttttcaattcctgccattttcttgggggctccaaatacagctaatataagtcgcatgctgagtgacttgtcagtctatattcccatgtggtgggtccatcttgattcctctgttttatctatcagagagtttgatcctcattataataatagctattcataacatgtattcatcagccatgtactagctactgtgtcaaacagtactgagatttagatgctgacttctgaggctagactctttattcttagaaaataaacaacactgcccctctattatatactgaaataatagtgatgtttgtctaaacaaccctagctggtcaaacaatggcaaccccttcccctggctgctgttttactcaccatttaacaaaaaattaggtggtgcctttggaggaagagaagggagatttaggcggaaggatttttttttaaaaatttatttttgagacagagtctcgttctgtcacccaggctggagtgcagtggcaccatctcagctcactgcaacctttgcttcctgggttcaagtgatcctctcaccttagcatcccaagtaactggaactataggtgcatgccaccactccggactaatttttgtagttttagtagagacagggttttgccatgttgtacaggctgatctcaaacccctagcctcaagtgatccgcccacctcagcctcccaaagtgctgggattacaggcatgagccaccacacccagctgaggttgaagggattcttacaaagacatgtgaagagaataaattgaaaataaatatgattacattaaaactaagctcagtactttaagatgtcatgttctctgacttgataactgaagaatttgtgtgagtcatgagaagaaggtaatttgttgtactttatattttcagctatccttgagaatggtttctgcttcttacattctcaatgatagacaagtctgacacatggagtttactttaaacggttaggcaatcccatgggttgtggcccatagggtgataacaatagaatttccttttgtctgaccttaaaaaaggatatcagataaatactgcttccttggtgcagttaattttaggccaaaatacaattattggtcagatgcacaaattatctctttatttcttaaggattagaaaaaattttgaggaatcctactttcttcctaaagcagatctgaaatagaaataattttatacaagctaatttttccagggtttttgtttgtttcttcttaaaaaactattttaccagaaaatatgaatacgttctgaaactttaccataaaaaattctcatttcttcccttcttttccttttcttttctcttttcttttctttctttctttctttctttctttctttctttctttctttctttctttctctctctctttctttctttccttctttctctttctttctttctttctttctttctttctttctttctttctttctttctttctttctttcttttccttctttcttttttctacctcttcttattttctctcattcaagcattaatgacctatcaattctacagatagttaattcacacttacaatgtgcctgtcatatttattttaaatattgaaactcactagaaccaaagtccaaatatggatgctctgtcgtggtgagtccacttgttacaaggaccctggaaaatgaaatcaacttggatagaaaccaacatagacccaattttatatcattaaaccatcttctattctaaagaacaactgtatgtgtattacatataggcttctaatagaatttctgatggacatatcagcaaatttaattcggtattttaaaaaatacatcctaaacaaaaacagatttttctcaggagtgtgagaatgatacagcatcagataataaatttaatataaataatgatattaaagataaaggaacagaagcaaaatcatttcaaaaatgtagaaacatttaatatagtcagcatatttattaaaagtaatctgaacaagcttagattggagtaggacatttttacctcaaaaacaagaagctaccaagaaactacagcaaacatatatttacattagtaacaaagcaagaatgaatactatcattgtttctattgattattgaagtgaaaaaactagccaatggagtaagacaaaacaaaaaacaaaaaaacagaagcaaaaagattggagaggaatctacagtacttttatttgcagaaagtccataagggtttattggcagactattagaattaaaaataatttccacaagtttgttgggtacaaggtaaacatataaatctaattatcctctccctacaattataattaccaattaaaatgtagaactgaaaaaaaattcatatacaatagtgacaaaaatgtaaggaagctaagaataatcgaataaaagattcaagaccattaggggaaaaatgacaaaatattattgaagattataaagtcctgaataagtcatcaacattgaccatatttatgtatgggtagactcaataacatgaagatgccaattttttctaaattcttctataaatccacacatttccactcaaaactccaacagaactgttcatggaatttgacaagctaactctaaaactcatgtatgatcacggggccaaaaatagccaagacaactcttgggggtggggaaaaacccaagagaaaagacttgcccaactagacatcaaggcatgttttatccccaaattaattaagacagtgggacatcgacacaaaataggcacaccagcctgtgggacacaatagagctcagtaactgttccttacagtatggaaaattgatccttgaccaggtagacattgaaaatcattagttaataaacaaactagtcaacctatgatgctggaataatttcttatctatatgggaaaaaatgaaattagacttcattttatatcacccatgaaaataaattaaggatatataaaaatttaaatgtaaaatgcgaaactttaaaatttttataagaaaataatggtgattagctttacgacctatgtatgggaaagatttcttaaaagaagggaaaaaagcatagatcattaaaaaaatattgatatatttgattacaattatttttaaaacttatgttccagaaagatatgataaattaaaagacgagctacagacttggagaaaacattggcaatgcacccagcacacaaaggattggtattctaaattgtataatgaccccctacatgtgatcaagagaaagaaaaataacccaatgaaaaatgagcaaaggatatgaataagcaaatgacagatgccaaaaccaaaatggatagttaacatataacacataaaagcatgtatagccacactagaaccttgagaatacaaattcaaaaagcattgagatattacttcaaaccaccagagtagcaaaaatgtaccattctgacagtattaagtgttggcagggaggagaactaagagctctcatatcttaaagagtgggaatgtgaattgaggcagccactttgaaatacaatttagcattgaagctacacatgacatttggcctcacaattgcatatttatgtaaacacttaagggaaactctcaggcaatttacattgagctagttattagaatgtacactgcttgttatgtgaaaaaaaatctaaatcagaagagtgcatcaataaattgtggtatctctatataatataataacatccaatactggagcagaacaaatgagagctacatgcaacattagtgaacctcacagtcatactcttgagtgaaaaaagcaaattactgaatatgcaaactgatactatttagataaagcttgtaaacatttaaaataatccaaaatatttcatgtgtagtttcatatatattaataatataaaaacatgcatggacatgacgaatgtcccttttagaaagaagaaagtgggactgttacaagaatattgacctatgcctgtaatattttatttcttcaaaaagaatctgaaacaaatataccagaatgttaggaattaataaaaaccaggttacaggtatgtagatatttattatattattatttctacttgttcgaatgtttgaagtacttcaaaattaaataaagaaccagcctcactgagatgtgtgtgctgagtgctctactaggtttattcacaaagttcttacactccctgctctcaatgggactgatgaaaatgtatgactcaaccaaattatatatgaccgcatagcatgacattcagcctcattgagaaaatgtcaaaattgtgaatgttaaattctaaaatatcaaggctcaactgtagacatacaaaaccaactagggacataaagaataaaaatgaaaacaaaataaaagctgtttaataatagaattcagaacaatatataatctcttcttccctgctaaaatcaggccagagattggcatttgccttcctgaaggcaatagttagcaggaaaaaccacacaggttcatataatacaaaccaaaacaaaacaaccttctcacacgaagagaaaagaatactttgcaaaatggctgctgcatcttcccaaatacatatttcacctccccaaacagattttccatccttgaccttctcgttggaaacctctccttaagcagttacacacagctctgcaaatgttagagtgacatttggactgggcttgcgtactcagcttgcccgctcttctgggcttccccgggggtctgccaagctccagcacattggtattagccttgcaggcctcacctcccagagctagcaataacatttaccagctacagttttctccattttcaaatatttcctctggcccacatgccagtgatccagctcctccatagagtagaacctgaaaggagtggtttaaagaaaggagagccctcctgtaagaacttttaacatttacctttcattaaagattttacttgtggtttaatcgagctctcccactagaattctggtatgtttgggaaaaattaattactaaaatcttacatctctgggaggcggggtacatctttgatcattcttttgtcagtgaaaactctgaaaaacaacgcctctggttggaaaggaatcaaatctgagcttttgccgaaagctttttgcaatcccaagaaatctggattgaccaggaaattctaaatcataactgtagaaacagtttcacagccttgctatgcctaatatgtgacagggactgggtctaaggaccttcataaagtcaggtgcgttgtctctctcatttgttgtatccccagtgcctgaatgaatggatgaggaatgagttgaatagtctcccaaaagctaatgagtcatgagctaatattatccttatttcaccaatgagaaacctgagactcaactgagagatcaagtgacttgtccagtcacagagctaataagtggcaggcctcatatagaggctgagaacttcattgtgctggtgtaatctgtactagtagagatacatatgtgttcaaatgtcatgataagcactggcaaggagaggtaaacatgaataagaacacagttgagtttcaactcataaatgtaggaggaaacaggaaaagagaggatcaccagtagacaaacaccacattaataaatattgcaagcaagatcactgatggatgctaaaattagtggataaaagtttgaggagaataatatttgcataggctcaaagtattttctctaatacatgtatcaactacaaaggaaaatacaatcatttagaagtagagagacctggaacttggaagatcctgactttatcaaataagcaggaaattatcaccaggaacaaggcatgggaatatcatgaaccccttgatagaatgcactgaaaaggacacaatatcatttttatggtgttcttgccaaaaacatgtaacttctctccaatcctgaaaaaacactggacaaaaccaaaatgaggatctttgatacaatatctgactagttctctttaaaaagacatgaaagacaacaaaagactgaggaactattgtagactggaagggagcatggcaaaataatagctattgtgatgtaggatcctagaacagaaaggaagagaaaaacatattaatgggaaaatagtaaaatttgaataaggcctgaagtttaaaatattgaatcaatgtatatttgctatgattgataatcataccatggtaatgtaagaggttattagcattagggggagtaaggtgaggggtataagaaactcagtataatttttataacttttctataagtatgtaagtttgaaataaaaaagtttaaaacaattaaaaaatgagcagaaaatacatttgtccttccagtttgcttacagaattgagagagtcaaatatgtaaactaaactaaagtacacacaaaaaacagtcctgtaggcaccgccgataataaatgtatgtaccagatagaaggccatggaaaagggtggtcatcttacctgggaagagagcacaggtagcactcaggataggcttcatagagaagacgatgctcaaagatttcttatttatccaccatctgttttatagagcatctactatggaccaggcactcttctagaacatagctacatcatggtaaacaaaaaagaaaaggtatctgcattcttggagcttacagcctagaagaagtcagataacacatgagaaaaaaaaaaaaaaaaacaacaccaaacaaaattaattagatattttcggtgttgtcatgaaaaataaatgagctgatgtgatagaatatgctcagggagataggggaattggggaatacctttctgagaagatgatagttaagctatttgggctagggcctgaatgggaaagagccagccgtgcaaaatgaacaaggagcaggtaattccataccaaggaaacagggtggctgaatgcccaaatgcaagaacaaattagtatgtttgtgtttaaggaaacaaaagtaagccagcatgctgggctgtaatggacaaggaggcaatagtagatgatgagctgtaaagtaaggtcaccaggtggctctaagtccaaactggcacacttttgagtaaaaggtggtgctattaataattacaccaggacaacagaagtgaaatgagactgtctggccaaacctggacataagatcatcctttagcaaggaaagaaatcacgtaggacttggtgagccagccaaggagtatgaagttattcccagtgcattaggaagcatgggaagttataacaagggtaggaggtgattgttctggctgccatgtggagaacccactattgagagcaaagaatgaatgtaggggggatcattaggagatgatttcggaagtctagttagtagacagaggatgggggctttgactacaggagtagacttgggagaggagagaactggatgacagtagagtcaatgagccttgcgtgttctcagaagatagactgagaacattttagacaaaaggagcagcctgagcaaagtcacaggggcagggcacgttccaggagccaagagtgtattctatggccaaagtgaaaggaacagcaggggcaggccattggcctggagataagaccaggggctcagatcatatgcgatttagaattcaaggctaagtagtaagaactatggtgccattgaaagtgatatgattagattggttttagaaatatgagtctagtccaactataagagaaaaagataaaatgaacagaaaaatacagtgaaaacagagatagcttttgctagttagagaaataaacaagaagacattttgaggatggtacaataatgtgggagatatttttatttttactggaaattgtccacccattcatcagacacacacttgatcatctagtgttttgcaatataattagttgttgactcaaggactgctgaacagtgtcactgagtcataaagacggctccaagaggaaaactttgggcacaaattaatgctatgtaccctctactttctatcttctgctgcagcgctattcttggcccactcatttctaagttttagcaatatttctcaggctggtgtgcctcacatgcaattctggcaagctaaacatggtgacggagccagataacttgttccctgtagactcataaactcatcagctgtgggctggtaatataatttacaatatactttgccagccctataaaacagcttttttcttgcagagaaatggagccctgacaagaagtgtttatgacttaattttagctgtgttcttcgttgttgctgcagtagtagcctgcgtatgatgcatcctagtcatccgccaggcagttacaactttgttgttgttgtttttggcaagctaaggacaacattagactttgcttaatacctaccccacaatcctatttcaatggtggccatagcatgtacctccatgtttatgaataaatgaatcgagacacagttgttggatacctcacagccgtggcttataccttgatgaaactatatgataccatatccttctagataaagttcctgtaaaatgatattgttagaaggcttgagtggaaaaatctgaaatatgctgtttacagtcaaaatgattatcctcctgctgactagttgttctttattcttctccacagtgtactacaataactatttaccattcatatttcaggctaataaggttacttctattcagccattacataatgtgactgtagctaaaattaaagctccacaaggtaggaaatttgttttattcattgctagatcctcaaggtctggaacaatgcctggaacaatagtatgtactcagaaactacatgttgaataaataagctcaactattgacatattaaatctaccctaatgatttgggaactaatactacaaatagtgtagtcatcttccaagaagagcatattctcctgaggttggccagagggttgatgaattgatgtatcagccctgatacattatatagcatccaacagtcattccaataacatgctaagatctgcaaaactgtaactgcatatttgaattcaaatccagggacagttttttaacctaggtaactctagattctactgtacacaaagttagagttgtgagatttctctttattaattctcttttttctcttagccacatccactaaaaaaggtacttttatttcatgtcctgtatgagttgtatgtaacgtctggctctgtcaccattcctttgtgttctcattccatagctaactttccttaagaagtgttgtaatagcatatatttcagtgttcacaaaaaaacacaaaagcaatgttctgactaggtgactcaatagattttatgtgttttatatatacttatgtatatgtacacatatgtatttaatcatctgtttcacaacattgttgattttgtttttcctgattttggaagcaggattccaaataaggacagtaaaaagcaaactttttcatatctctgtaagaagggaaatcaaggctttaaaatattacctcagtttcctcaggtatgaaataaaaggtatgaatgcaggtaaatttcaactttctttctaactctaaatttctatgcaattcagagacagtaatatgacaacttctatggttctttttcgataaagtgacaagaaactgattttactttaatcagtttatcagacttcttaaattttctttgttggcttgacttttctaggaaattcatcctatatcttagacaacataattttggttcacgttgtatttgtgacccagtttgtccttgtaagttgtatgtatagaattgaggtttgttgaactggcacattgtgaaacaactgccaggaagaaagtatattttcttctgccaccctaaaggatttatctctctgatctggcctcagataatatggaagcacccacattctagtgagtacaactgtgtgtggagcagttcagttatctagcccttcaacatagtcatttggaaatcaaaagcgttaaccactagattagataagacaacaaaatcaagagttcagttgaccattaatcatttttccaaaatcagctcaatgacgttgtgtaataatatttagaataaagcaaaggtaataggtataaaaatccattcatttacagatctatacccacagtcaaacatccttcttgatggttcagagctaaagcctttattcaaattttactaaccagttattgtcaatgataatgagagagtaaatgtattctctggaatactgagaaaaagaatatggcagagtgaggcagcaagctttgagcaaaacaagcaagaatatctacagaacagtgctgttcaagatgaaaagcataactggaccatgatatcaggctcaatcactaaacatagcctgcccatgactgttatgagccattcttaccctcaaagaaatataaaagatttaactttggatttttgaatgcaatctctaccatgattgtgaaagtagatccattgtgtagggagtttgagaacagaagaaagcagaacgtcgcccttatttctctatttaatcaaagtagacttcataatgataaggaagactaacaaagaattgtaattaaccctttacaattatgttccactttacagtttgaattgcagagccctttcaaacatattttcttatgcagtttttaaatatggttcaagatttacgtaagggaaaagtaaggtcccacggttgcatgcccgtgagtagtggagctgggacctcctaacaccaaggctctttctactgaccagtgctacctgcaacatggaagtatcctctcatggaagcaatgggccacctctagacctcaaggaaattcaaacacatatgtacatgcatatatatacaacatgtactgagcatggtattatcaggcatggcttggatattttcacattcatacttcagtgttttcctttgtgctggatacattttccttgcaactctggatccatttccaatctttctccacccttcttcattcagttttgcaccttggaatgtgattctatgtggattgccctgacagctcccttgtcttctgtatttcagttgagtttgtcctgtgaaaaatactcatggaagatgaaaggaaaggatgagaatgagatctgggtatttaatttcctggctcttggaaaggcttgtctgttgacctcaaggtctccactcactttatctctttcccttcctctgcactctagcaattggccctcccctagacccattagggaaagtaaaagggtctgctcttaatagacctgaatactgcattacccctagagggcccactatctcttacctataccttttaaatcttacctttattaaactttcatcaaatggcacaattcaaatgggccatctgttttttaatggtttcctgactgattcggtattattattacacttgggaaactgagtcccaacaaggttttaccatgaaataacttgcagacctggaattccacccagatcttctaactccaagcttatatgcttacagagacagcacaccaagcaatgattctgaatgggaggctgacccatatgtgtaatcacagctctgcacaatagagctttcttgaattgactcagagcaattctcagaaacataccactgtcatttataatggtttattttgaaattttataacatgtttgcacaataaagcaatggcaaaagtatctggaagaaaattgaataagattacatctagtctttcactacaccacttggtcttccctgaatcaccggagttagtctaaaaagcaagtctgatcatgtcactttctatctaaaaatgctttctattgactaatatctaaacttcctaactgtgctttttagagtcatctatgtgttcccccatctcaaattttaccatttctttccatatgctctagttaaggggttctcaactgggggtgacttttccccctaaagggcatttggaaatgtctggagatgctttcggttgtcacgaccaaagggagtgccacagatatctagtgggtggaggccagggataccgctagatatcccacaatacacaggatagcctttgcaaccaagagttatctggtcagaatatcagcagtgtcgctcttgacaaactctaatatactccagccacaccaaattcctcctgaaccttgaattttctgcatggtattagattggtgcaaaagtaattgtggtttttgcaattaaaagcaatggcaaaaactgcaattacctttgcacccgcctaataactatcattcaccagattctgtgcttaataaatgatttcatttcatgcacttgtgaaagctgtgcttctacatatgctgtttcctcagccagagtgccttcccactcttctctttgctctttactcttatattcttgaaacatggtttacaggtctccttcttcttaattctcatctatacctttgtatagatgcctaagctgaattctcacattttctttattattcaagtataacagtttacctgtttgagtctacaacacccacttgctatattctgtactaatgacagagaacatgctatttgtgctttcccccaatttcagcacagtgtctgtcacatattagatattagtcattgaatgagagaacaaatattattgcaagcagttgatagagttctgaagaattgtgttatgtttaatttgtataaattaagtcatattttaaaattcagtggtaaaaattgctatttaagaaaagtctctataaactttttggtaaattgaaattctattagaaggtatacatttataaaccagagtttctctattccatttttttctcttttgaatattaaaaatatgaaagagtacatgcctgcttttcttaaagtgataaatatcaatccaaattgttgtcatccctttagagtgctctagattttggggaatgagaagccaatatgaccatatgtaatggcaggactccgttgagaatgtgaagttagttttcaaccttgtccacaagagggaggacatcaccccacatccattttgttgattccctggaaccgttgggtctgtttggagctggagatttatgttgctcctgctgttgcaaaatacagatttagaacctggcaggcattcttgcatagatttgcatgcagtttaagatcagcccagtttgggtggagggaaagcaatctgggcattttagaagctttgtcagaataaaacacacttaagcagtgtgtgatgccagttgctgcatgaatgagcaggagagtgtcttgaaggtacagaaagagaaaagggtgagggatgtgataatttggtggtaatttgcttacaaggttgaccaggagagtgtcttcttttcacaggagatggcttaagggctggtgggagtatagtgctaggaatgaacgtcagcttgatatgctaagagcaaaatgagagcagcaaagtccactttgtgaagttatggagctaattgctcataatactgtatcagtgccagtgggcctccagcattcactagcaatatcacatgaattgcatactctagtacttttgtttacttctttccttttactacctgccagtctggctttgtctttctagactctagaagatgtaaatggtatcacttccttgcaggtgtagccaagaagatcctggttatcattctcttcctacagtccattttccttatagtttttacttttctttttgattaggaccttatcacacctaaaacaacatatgcactggtaagattgaagactttgagctctaagttttagttattttctatctctttggatgttcagatatactaatttgattaaagaaaggaaagtgggaaaatggtagaaaggaagaacagctgcctgctaggggttttctctttcaagttaaacaaaaatgaacatgcaaaccaaataatcattatcccaaagtaagaaaaggggtacaacccaatgtcataagtctcaaaaattaggagcaagacagaattctgaagccaacccaggaggaatggtcaagcatgatgagcctgctagccccacctatgttcctaaagtacagtactatccacttggtaaaaatgctgagaattattactaatatccttatatatgaaaagaaacttagtacatattcttacctgttcccactgaaaactgaagagtagtggaaatggctataggagaaaaaaatatatgtaatagaaacagacaacgggactgagaatcaaaagaaaagtcaccaggagcacatggattcccctccattgccttgggatgttctctttaaccaggcagggtgacttctggaataggacacttaacaaagcttcaggaataagacacagtccagatagctaaatgaagcttacccatagccttgacacagctcttgatgtcttccctccatttcctgaacatattctgccatctctgaagctacagaaaaaaagtgtatagaactcaaaatattacacaattaaaccgtagctaattctaggtggcaagaagtcaacgaaactgtgtctgaacaattaggaactctggacagagatgcctgagtgtaagcaaggtaaaagggaatgacatggcaatacaaatgcaaagcaacagaacaataaagttaaaaaaaggaaaaaaagcttagaaaagtcaaataattcgatctagagaaaaagcaaaagaacagaaaatttcccgtgagctacattctatggctcaatttgcattattgaatgactcaagaaaaattgaattcatgtcacaagaactcaaagaaaaaaaaaaaacaaattatctgaaaggaaaagggagattgtagactaaaggcaaaaaaaaaaaaaaaaaaaaaaaaaaggaaagccaaaacaatgtgatcacataactaatttgaaataattagtaacaacagggggtggaaaagatatggctaaaaattgaaatattgccagagggaaagtgctgaagatatcgcagttaatgctgatgaaaaaaaccagagattaaattaatcacagagaaactgagatataaagagggcagatggtataattagatccctgaaagagaaaacctaagtacttcaacaaagaaattactcaaaggtatcaaactggaaagttttcttaatataaagaactgactctgaagtttgaaagagcatgttaagttgtaagaaaactacacagtatgttcaatgctaagatgtgcattgatcaagtcattggacttcaaggattaaaataatatccttaaggcatataagcaaaatttacagcacttatcacctatgaggtagattgctggcattatacaatctcattacacaaaacaatgtctataaaattgagcataaaatcaagtgggacaagaattatctgcaaccataatgtaactcaaatgtaaacagcaccagcagacattcacaaatacgaacaaactttggtaatataacactaaagagttcttttttaaaaagttgttaccatataataacaatataacacagatgagctctttttaaaaatgttgttaccatacaataacttaacagtacattttaaaataatttaaagagtgtaattggattgtttgtaattcaaaggataaatgcttgaggggatggataccccattctccatgatgtgcttatttcacattgcatgcctgtatcaaaatatctcatgtactccataaatatatacacctatattatttacataatcattaattatgtactcacaaaaataaaaaacaacctgggtaaactaacttatttttaacttgaatctatactccccccaaaaaataaaagacattacaataaaattcaagcatttaaaagaaaataaagttactcagaaatggaaacacttggtgagaacagtgacggcatttaaatatgcaagaaatacatggtacacattataaatatagaacaaagtatacatgtgtcagaggtcccccaaaccaccctcaatctgcatcactctctagaaggactcataggacccagaaatgagaatgtttatgagtatggtttattacagcaaaagttacagagtaaaatcagcaatggaaaaaggcgcatgggggcaaagtctggaggaaaccaggcacaggtttccaagagtcctctcccagttaaatcacaaaggatgttcctaatttctccagcagtgatgtgtggcaacacacatgaagtgttgtcaaccagggaagcaaccctggagtccagggtttttaccggaggtcagtcacataggcatacgatgcttacatgactgacttagttaccgaggctccagaccccagagggaaagcaagtgttcatcataaattatattcttagcatgaactatctagaccaactggtacagtctgactcaaggccctaggcttgcaaaaacactcttaccactcagaaattccatgagctcaatacacaggagctggtgaagggccagtcgtgcaaataggcctttcttgggagtgcacagtttgaacaactcagatcttttgagttaaccctttcttacacaatatgtgataaaaatagcaaaaaatcatagatgaaggagaaaatgtcaaagaataatgttctcatttttcataggaataaggcagttttactgggtaaatttgcaggagggagttcaaataataacaccagactgggcatggtggctcaaacccgtaatcacaacactttgggaggccgaggcgggtagatcacccgagaggtcaggagtttgagaccagcctgaccaacatgggaaaccccgtctctactaaaaatacaaaaattagccgggtgtggtggcatgtgcctgtagttccagctactcaggaggctgaggctcaagaattgcttgaacctgggagacgaaggttgcagtgagccaagattgcgccactgtactcccacctgggtgacagagcgacagagcaagactctgtttcaaaaaacaaaaaacagaaacaaataataacaccagttgtcttatgtgtttaataatatcttttgtaaattttagtgagttatcttggaaggtagtacctcataaaaagtagttgaaattcggagttttttcttttgctaactttgtgtaatattaaagtttagtttaattaaagtagtacatatagattttcctctaaagagtttgtctattctatttgtgtgtgtgtgtgtgtgtgtgtgtgtgtatataatatatatatgcttagaaaagtacctagaaatatgcctctctactgttaatgatggcatgatttgaaaagcttaatttttttctttatgtatgtctacatctcttatattttaaaatgatgaacatgtactatttaacaaaattaaatctctggctagatgcagtggctcacatctgtaatcccagcactttgggaggccaaggcaggagaatcacttgagtccaggtgttagagaccagccttggcaacatggcaaaaccctgtctttacaaaaacaaacaaacaaacaaacaaacaaaaaaaaaagtagccaggtgtggtggtgctcctgtagtcctagctacttgggaggctgaggtgagagaattatttgagcccaggaattcaaggttaagtgagctatgattgtgccactgcactccagcctgtgtaacagagcaagactctgtctcaaaaaaagaaaaaagttcttaatttgatatttgatttttctttgaaaagggaggaggataatgaaagaccgaggaaatcataactctctgagacaagtttaacacagactgggaagggtggcttttatttttaagggaatttaagcatcgtacagataaaagaaacatacataaaaaagtaaatactatgattttctttctccctggattgctcctttaacacaataattttacagaaacctttttccattgtaagtattattatattgctcaattttccagtgccaatcccttcctttatttggaggagcctctgaatgccagtggggagatagttttcctcttactggtcagaggatggaaatttagagagaagtcattgattattgagattgaaaagcaatcagacaataagtaaacaatcagacagtaaaagcaaaaattggtactaaaatgtgttttaaaatgacacaatgattaaataaaattaattatatcctctagaaatagaaatgggcttactatgacaaatacagatatataccatttgggactaagaaaaattttatgaagaaaggtatgtgaaatatttttaatagccaaaaatagaggaactctggaatgggtgggaaaggagtgagcttagcagaccttctctgtgaaacaatcgtttagctggtgaaaattattaaaacatacacacacaaaagaagctaagacacacacatttaaaaaattgtcataaggacacacagcaaatggaaaaacatttattcaagacatctattaaataccagttagaaaaatgagaggtgtgatatttaaactgtaaccagctgccatccgctagctcacccctgctccttgttttggaagccaaaaggacaagagctttcttacctgccagttatcagtctagggctacagttcaaccccagaagaggcaggctactggtgcctctcattttccccagattcatgttgcagaagcggtattatgggtaggcatagccaagaacattgggctcacttcttttatccagcccccgtttatagggtataagctctataccaattgtggcagaccaataataatgcgtgtccaattgtctcttcctcagcttgcttataaggcagaggttccatgctgggaagggcaagctgaaaaggccagagtccaccatctttcccaaattcccacttatacaatggtagtgtcactcgggtggaagtgggccgctatttgtgcaaccaactgggctgtaatggcacagaaattctgcccagggatagatgcagagtgtcacaataagagtttccactctgcctggagtcactgactatctggaacagaagttagagaagttcatggctaagggttttcttaaacaatggagatcttgatggcaagcagcttatagggagcaggcagctctatgataccagcagcaatgagcaaactggtaaagcagccagaagtcgagtagagagaatcagggaatgagaaagccctgaagagccctctggggatcacacttatccctgagggtatggaaagttgtacatatttgcaaggctacacaactcagaggtaattagagtaagacacagggcagatttgaaagcattctcaagccatacacagatgcctcatccaggaggaagagtcttattggttcagaaggcttaaacgtgatctctcaaccaacactggctgaacaataaggtactcttactcaggtgctattcctaggaaaacaaacttaaaaacaaaatcgttcattcttggtggtctggaagactgtatttattctgaaggctgaaacatctcaagggtgacaggaggataatttctaagctaacagtcctttgctgaacatgaggcaagatcataaacttcctcaaagcagtctccaagtcacacatatacaacagacaaagggcaaaaatctaactgaccaagggggcttaagtacagtatttgatcaataagttacttatattgatacactcacaggaaggcaagccaaaagataaaaacaggggaacctttctgaggggggagacgagagccgtctgccgaaaatatacaagtctcagaattatctctatcaaatcactaaataaatgaacatatgaacaaacaattagaaataaacctagaggaacagggttagtgtccagacttgttacaatgtattatctaaagtccagctttcaataaaaaattaggagaatgcaaataaacaggaaatgtgacccatacacagaaataaatgcaggcaatagaaactgcctttgagtgggctcatatgttggacttaatagacaaagaatacaagtaactattataaatatgttcaaataactaaaggaaattatgcttaaaaattaaaggagaatgagaacaatgattcatcaagtagataataaaataatgaaattttaatacatattgtatatgtctattcatctatcttccaatagaaattttagagttgaaaagtccaaaaacctaaatgaaaaattcactagacgagctcaatggtagattagagttggcagaagataaaataattgtattagtctgttctcatactaccgataaaggcatacccgagactgggtgattggtatgaaaaaagaggtttaatggactcacaattccatgtgactgggatgcctcacaatcatattggaaggtaaaaggcacctcttacatggtggcagacaagagagaaaatgagagccaggcaaaaggggtttcctcctataaaaccatcagattttgtgagacttattcactatgatgagtagagtatgggggaaactgcccccaggattcaattatctcccaccaggtccctcccacagatgcgggaattatgagagctacaactcaagatgagatttgggtagaaacacagctaacccatatcattccatccctgacccctcccaaatcttatgtcctcacatttcaaaaccagtcatgctttcccaacagtcccccaaagtcttaactcatttcagcattaactcaaaagtccacagtccaaagtctcatctgagacaaggcaagtctcttctgcctatgagcctgtaaaatcaaaagcaagttagttacttcctaaatatattcagggtacaggcattgcataaatatagccattccaaaggggagaaattggccaaaacaaaggggctacaggctccattcaagtcccaaatccagtaagtcggtcattaaaccttaaagttccaaaatgatctcctttgactccatatctcacatctgggtaatgctgatgcaagaggtgggttcccatggctttgggcagctccacccctgtgggtttgcagagtacaattcctctcctggcagctttcatgggctggttttgagtttgtatggcttttctaggtgcacagtgcaagctgtcagtggatttaccattctggggtctggaggacagtggccttcttctcacggctccactaggcagtgccccagtggggactctgtgtgggggctcacaccccacatttcccttcggcactgccctagcagaggctctccatgagggctctgcccctggagcccatctctgcctagacatccaggcatttccatacatcctctgaaatctaggtggaggctcccaaacctcagttcttgacttccgtgtacccacatgctcaatatcacatggaagctgccaaggcttggggcttgaaccatctgaagccacggcctgagctctaccttggccccttttagccatagcgtgagtggttgggacacagggcaccaagtccctaggctgcacacagcgaggggtttgggggtgtggctcagccacaaacaaaaccattgtttcctcctagcttctggggcacctgcagttggagaggctgccataaaggtctctgacataccctggaaatatttgcctcattgtcttggcgattaacatttggccccttattacttatgtaaatttatgcagctggcttgaatttctcctcagaaagtgggtttttcttttctatcacattgtcaggctgcaacttttttggacctttgtgttctattttccttttaaaactgaatgcttttaatgacaccgaagttacctcttgaatcctttgctgcttagaaatttcttccaccagttaccctaaatcatctccctcaagttcaaagttcaacaaatctctagggcatggaacaaaatgctgccagtctatttgctaaaacatagctagagtcatctttactccagttcccaaaaagttcttcattccatctgagaccatctcagcctgaatttcattgtcagcattttggtgaaagccattcaacaggtctctaggaagttccaaactttcccatgtttttctgtcttttcctgagccctccaaactgttccaacttctgcctgttacccagttccaaagttgcttccacattttcaggtatctttacagcagtgcctcactcccagtactaatttactgtattagtccattttcatgctgctgataaagatgtaccagagactggataatttataaagaaaaatatgtttcatggattcacagttccatgtggctggggacacctcacaatcacaatcatggcggaagtcaaaaggcctgtcttatatcatggtagacaagagagaaaatgagagctaagcgaaaggggtttttcgttataaaaccatcagatcttatgagacttattcactaccatgagagcagtatgggggaaactgcccccatgattcaattatttcccacagggtccctcccccaatatgtgggaattattggaactacaattcaagatgaggttggggcggggacacagccaaatcatatcaataatcaaacttgaaaatagaacaatagagattatgcaatctgaatagaagaaataaaaattttgtatatttataatatataactttaatgaatggcgtgtttgtatatgcgtgcacatacaaacacaagaacttccatcatgaagcattatggatgtgctttggtgcttggaagcatgggtgtgctccaggcatagctctatgacaatttggcaggactgttaagtatacagctgggagaatcagaccgcctgcatgcaactcccagttctgccatttattagccatgttacttgatatctagaaaatgagataataaagtcttcatggtgttcttgaagattaaatgacttcttaatgcatataaagtcctagaaagcaccaggcgaatagtaaatgctcaattttaggtatcattattgatcttctttagattctgcccttccaggagataaaagatttgttttgttttgcttcacatctggatcatgtgttaaatttagattgtttccaatctaagaagagatcttcataatatgtcttattgtaacggtgtttgcaactgtcacacttttatctgtaatcgctttatagtttgcaaattgtaatgtgcagctgttagcatgtcatgagttttacctgggagatggctgattttcaggactatcataagtgcatttatattacttttcatcttttgtgtggtatctgaacagagtagggatatgataacaacacagactattttgggacccttcaatgtggtctgcctgactcttgtttctccctgtttcacttctttctagatatgagggtacgggtgtttttctcttttgttcactgttacgtctatcacctagaatagtgcctggcaatcagtaagcacagaagaatatatcatggtatctcataatctaaaaccatttactttccagtagatgcccaagtcctttgattttattccggtctcaaactaccttacatgataaccattttaaaaattatatgtctgatgctgtattagcctgttttcacaccgctctaaagaaatacatgaggccgggcgcagtggctcacgcctgtaatcccagcactttgggaggccaaggagggcggatcaagaggtcatgagattgaggccatcctggctaacacgatgaaaccctatctctactaaaaatacaaaaaattagccgcacatggtggcaggtgcctgtagtcccagctacttgcaaggctgaagcaagagaatggcatgaacctgggaggcggagcttgcagtgagccgagatcgcgctacagcactccagcctggatgacagagtgagactccgtctcaaaaaaaagaaaagaaatacatgagactggtaatttataaaggaaagaagtttaattgactcacagttctgcatggcttgggaggcctcaggaaacttacaatctgatggaaagggaagctggcatctttttcacaaggcggcaggagagaaaagagcatgtgaagggaggaactgtcaaacacttacaaaaccatcagatagtgtgagaactcatgagaacagcatgggggaaaccacccccatgatccaattatctcccactaggcccctccttcgacacatagggattatgaaaattacaatttgagatgagatttgggtggggacacagagccaaaccacatcagatgtttctgttaaattgaatagtttgttataatctgagcatcctccttctttctttcctttatgtctatagagatactacctgatctacctgttcaatatgatgccattgcttctttcattacaaaccctacccatctaccaagaccaacacagactctatcccatctgccttaattgccttcatccttcagcttccctcctctgaatgttacttgctttgtatttatttcctgtgtcatttaaccacttgtatgttccagtacagttacttgtgcattctgtgtctccctttagaacagggaccttgtctgtttcacctttgtattctccatagtgcatgtaggtagcaaatatttgacaacagccaatatttaataaagacctactcagtgacagatactgaacccaatgactggtttgattcctaggaatgtgagtgatattctcttcctgtgttttctaaaattatttgcctagtgaatatttaaacaaattcacatgttgaacatcatagtgtttcaaaacagcccctggacttggtatcagatatattgagtcaaatccagagatgctgtgtgactttgggatgataacatacccctttaagagtcttggttttcccaaacaccacatgttctcactcataggtgggaactgaacaatgagaacacatggacacaggaaggggaacatcacacactggggcctgttgtggggtggcgggaggtgggagggatagcattaggagatatacctaatgttaaatgacgagtcaatgggtgcagcacaccaacatggcacatgtatacatatgtaactaacctgcacgttgtgcacatgtaccctaaaacttaaagtataataataataaaaaaagtcttggttttcttgtctgcaagtaggaataatagaatcacactatagtgttaatcgaggtaacaaattgtcggtaacctcagactgaggaaggtatcaaataaaagtgagttttcagccaggcgcagtgggctcacgtttgtaatcccagcactttgggaggccaaggtgggtggattgtttgaggtcaggagttcaagaccagcctgggcaacatggcaaaaacccatctctacaaaatatctaaaaatcagctgggcatggtggcatgcgcctgtaatcccagctgctcggtaggctgaggcaggagaattgcttgaaccagggaggcagaggctgcagtgagcgaagatcacactgctgcactccagcctaggcaacagagtgagactgtctcaaaaaaataaaaaataaaaataagtcagttttcctctttccctatttgaataaaagtaaaatgagtttttcaagggtgtcattagctttatgttattgttctaactctgcctctatcagatattctttgaatgggccaaactctcacaatggctggacactggggatgttatgatgccagaccatgctgctactttttccttcctttaaaagctctctggtaaatatcgatttgtctgctctggtggttataaactgctgctctcctcctattcttcatgaaatacagggattctaagttttgttttatgtacttgtgttttatctatcgcatacagaattgcaaacaatactatttgtgaggggcgttttgactttttcaaaatatcttcatatccattatttaatttggtacccttcacaagtctatgagcctggtagggcaggtacctgtgtcatcataatccccttacaaatgaggaaatagagcctcagaggttaagtggtctgcccagcgtcacacagattaaaaggtggtaacaacaagggttcatcaaacacaagtcactaggctacaaatctggcaccctctctactcgcttagcctgaaagcaaaggggtatttggcaactgtgacatccgtcatcctaacgatcttctccattcttctttggcagaggcatccatcctgagctatgatggtagcatgtacatgaagatcatcatgcccatggtcatgcatactgaggcagaggatgtgtccttccgcttcatgtcccagcgagcttatgggctgctggtggctacgacctccagggactctgccgacaccctgcgtctggagctggatggggggcgtgtcaagctcatggttaacttaggtatcgtatgaagtaccctctgccacttcgtttgggcttgtcttccctttcttttctgattttcattggtttgattgaattctttgtttgtttcttgaaagttagctgctcacctcttgtttaacagacccaggataaaacccaacagcagcgatcaccttctccttgtttctgcatgaggttttgatgtcaatttctggtttctgacagtggtgatttctttactagattatttgttttctaagtttcctttcttggttttttggaatcgtttagctttgtgtaaaacacgctactttggtccatcttttgatcaatcatattcccataagtccaactcctcagtcaccactcaaaacagtcacagctgaggtcagggacagggcaggaagtggaggcaaaatgttgatggtggggttgtaggaaattaaactttgtgggtagggtgagaagtacattgtttctagctccacagctactattcaaatggagaattctggtggccttgatgacactgatatctcctttgactttctcctagagggaggacaagtagattgttgttcccttggaaaataattccctaagttgagtctgtgacacgtggaaggaaaatgtgtctcctgatacgtatacccatttttcttcttgacattcttaaccatcactcagcatccccttgtgcaaagattgttaccttgtactatcactcactaataactctcttcttcttatataatacatatctattttacctcagagttgaaaaattatgacttcaaatttgtggctttattggaataggattttctctttcattgtaattacctataacagaatctttagaaattttcctttatatggcctcatattctcttctgctattgacctttactgaattctaattgatattctatagagattgggatcctcttggtttttggcaaggaaaaaacaaacaaacactccatttctgctgtttctaatcagcagaaagtcaatacccagcattgataagattagtgagacagctgggtccaaactttctaagctagtgaatgtatttgggtacgtagaatatgtttggatacagtgataccttataaagatttcagtgaaatggtttgtcagagccatggagaaaaaatgatgaacaaatgtaccagatgcaagatcatatgtaggcccacatgtcctggtgggaaggtggggtttttgaatccataccaatcttatctgctgtcaggtcaactggacacacttggaaaatgcctacatcataaacctaaaatctctgggacacaaaggactgttttgagcagtgacttctttagttatgtcttttttttttcttctagttttcagtgtttacagtaccgtgctctttttcttgtccaacttcatttgatttctgttgtcagtgtgtctcttggtttttcttttgtttgtgtattgtgtgtttggtcattttaggttatatttttttcttttgctggatctttttgtgtgcgtgtgttcctgagtttccaatcctccccgccatcaaccatggtaaatcaaaagatggtattcaacccttcaaaggcccaaagcctgcggcccgcatagcaaacagccttgagaacacagcgtattgagcagcctacagagactggcatacccctgaccctactaccttccatccctgcaccatcctacccaccttaaatcaatataagagtgtgttacctaaaaccaacagccagcagctgattatctcctcagaaaaaaacaacagaaaaaaaaaaaaaacagaaccaaatacaaccccataactagctcactgaaaaagatgatgaagacaatttttatctctggatctatttcaaagtcagagagagacaaacatatgagaatgattcagccccacgcgatcctgagggagtgtacacagtgtcattaaacagacatttttttccccattaggtgttgtttagtaaagattagagtgtcaactttgacaggtctcacatcttagaaggaaaaactggggtcagtgggggtacaaataaaagcgtataagaaataaggaaataagtgtacagattctcattctctctctcacacacacacacatacaccttgagttggtcatacatcccacatgcatttctagaagcattatttttgtattttaaactctagtcaaagtctgagagatgtgcttttccaatagactttgctttttttttttttttttcccctttggcttcttttgttgcaatttcaatctagctcctgctgcgttgaaccatctcaggcaaaggagaggtagcctctctgtagagagcactgtgcttgtccagaagccatagttaattttttttacaccaaaggataggttcatcataattactggtttgaatttatttaactttctttccaacctgacatggaaaactgaacttaaactctcatgcttgtgtaaatgcagctcttcatatccacgccttgtttaaaggttttccttccgttccctccccaaaatatacccctttgcaaatattttctttctctttgccgtgaatttgtgtttcatttttctcaattacagaagaaaatgtatccaagtagaatttgtcttcacatgcattccaccaaaattaatttcaaatgatcactttgctccctcactctattcaagttgtgtcttttttctagcccatgcactaacaatattttagtttatttcaaattgatcacacatatgcattcatgatataaaagcctagtatatatttctctgatgtaacatatcttccaaatgtcaaggagactagggttttccaatggctttatcttctgcaggcagccatatgtggtgctaacaggtatgagaaatatcctataactcagcacaacttttaaaaagttgagaggttgactattgatcaaccatattttgattctttagaattataagctataacattttattattacagcatatttaaagatttaaaagaccttatcttattttaatctcatgatctcatggatctcatgcgattaatgataatctcatgataattttgtgagataaatcaagcaagtgtttttatgcttacttttacagatgtgtagcacagagagaaatatattacttttcaaagcttacataaaaagttggagacagagctggaactagaacccatgtctctaaactgctagatcagcctgcgttatttgtttccttcacagatcagcactatgggtcaatgatgtgttagtcttaatggcttccaattgtttttatgatggtcacctttgaaacacacacagagagaatctccattttcctcagtgcccagtttgaattgagctgcactagggaaaagacagttgatatggacaaaacctttaaaagatccttagcagagtgccaggagcccttcttcaatggcagactctgagggagtggcatgtagtttggtaaattgcatttgaattctccagatgttctctctctggaaatgtggacttgctattactgtttaccaaacacattattgaagacacacagctcttagaaacatttacctcttccatgctcgacccaaagctcaacaacgagaaaaactttcttggccaggcaccttaatctaattacagacacttaggcctgtaatcccagctctttgggaggccgaggcagcccatcacgaggtcaggagaccagcctggccaacatggtgaaacctcatctctactaaaatacaaaaattacctgggcttggtggtgcgtgcctgtgatcccagctactcgagaggctgaggcaggagaatcgcttgaacacaggaggtggaggttgcagtgagccgagatctcaccattgcactcaaacctgggcaataaagtgagattctgtctcaaaaaaaaaaaaaaaaaaaaagaaagaaaagaaaaagaaagagaaagaaagaaaaaaactttctatcatttaccataatttaaaacaaaacaaaattaaaacaggcaacacacagatatgaacacatacacatcaaaagatatgccaagacttaggcagacttttttcaagcaaaaagtctggctgctaccaaacgtagatttaaaggaaattgccttcccaactcagttctttgactcatattttttatttaaaaaaccacatatataaatgtgtatgtgtgcgtgtgtctatatacacacgcacacacacacatatttatacatatatacatacacattcagtaacaagaacaccccctcagagcctatcaagaaggctctgggatagattttccttctcaaaccacttgttcttcaggtaaaataacaaagtaattcttcacatattgaggtaaagtaaacaaactgtctgccatcttgaaagcgccaagctcttacattggtttaaagaccgcatccactttacatgaaatcatttgagtgatccagaaagatgagcccaagccaccacctctcactaggccagcttcttgtctaataataaaatcctcagctatgcagaagccgaagacaaaacccacttgttgtttgcagtccttgggtttgttgctttaggctcactcttcctctcataagcgtgcccatacaccagtttcctctctctctttaatatgtcaggaagggacatttctccagctttgggtgatggtaggtgcagtcagtagctgaagccatcacctcttcctccctccctgccctccctccttccagtcctcaccaggggcatggcctcctctgtctggtaatcataccggttgctccagggctgtttgctcccacttttctgttgcggttgacgacacatgacaaacctaaccgcacgaaaccaaacccagatttttctcaagagatgttcttctcgggaacaaataagcattctgcctccttactcagaataactgggtgctataaatcgctcctctccagatttcacgtagcttcattctcccctttattcttgctcctttaaaatgattcactttggggaattcaaatggtggcatcatccttgacaagtcctctaaaaactactgggtcaaccttaagcagaagaagagtactttgtgactatattttcccctctatctttcttcctttaaaaaaaaaatcatttcgcttctaccttttagtatctaacggtaaacaaatccttattggaatttccaccatgataaaccaaccttaggctgaaccgggcagcttggtaacaactaacctgagacctttctctgaccttttctgcccagtcccctactatgcccactgattctactcaaggacttctatgttgtgtgtccatgactcccaagcagagattaatacaatgatagatatgctgatctctggcacagaataccttgtctgattactagctctggccagttggtcactcttttcttccctccctttcccatttaaaaaagtgaaacaaaaaccaaaaaattttctctcctcaagatgtggaatcacagagtgaaaaatactcaagatgtcaaaggtgccgagacctcctccacacgtgcctggcttgccttctccctgaatgctgtgggcacttgattcagtctgcgtattcaggcaggaagacagagatgggctgcgcgagggggttgatctgggagcctttgaatcactagcaatcagagaacccaattcattgtgataacatcatacaactcctttgaccctacacccgaccccacctctctaaaatctgggatgggtgtttgtgcggttagctgtttgcaagtggccattttatgacaggaaatgaccaggtggtgttaaccctttccttaccactaaggaagatggcaagtgtgcctatgcaaatttctatagcatttggggcccaacctaaggagagggtggagggagtttgattttagaaaaagagaaagggttaagtacgtcactgagcaacttcatgggcagattttttaaatgatacaatcagtcagactggtgatatgtctttggaatactaatacaaaaattgtgttaatgctactttaaaaacgaattttaagaaaataaattatagaggaaaatagaatataacctgcatttggtggggggaattattgcctatttttccaagtttgacaaaattaatatttcaaagtccaggtttgaaatactttatataaaagaatagctttttttgaaaaaaaaaaaatgtttggtgtctactgtggatatatatgtataccagtatatatctctatacatatgtgtatatatatgtgtgtgtgtgtatatatatatgtatccaactttactaaataatatactgtacatatacacccacccttaaacttgtacatactttatatatataaaatggccacatttcttacgtgtgtctgtccccggaagggtggactgattgtttttggatgtctgcagctgttaccttgaaggatgcaatttcatctttcatttatttttccccatctagactgtatcaggataaactgtaactccagtaagttttccctcaagtttcattttgttctttaaaaaaaaaaaacaaaactgactttattttgtttactgttttatgagctgttttttatttgaattattttttcttttaacaatggagtgggggggacctggggctaagaagatggggggctgggtgagggtgaagggctgagtgtggttttgggtgtggtttctgaagtgagggcaggtcctctcttctttccttgcatttgctctatatgaagaaaagaaggcaagggcacatgaataatgaaataatgaaaaatcaagttgaaatgatgatttattgtttttgggaggtaactctgagagtgaacaaaaagctttagggcaaccagcatgcacttctccactaccaaacagtttagaaaataaaagcactgttcttgacccacaggtggctgccaactctgacatttctttcccagtatttatctctgttgggaacttctagcaggtgggcagatcactgctattggtgataaggcaacactttaaccaaagacttgagacacactctgtctctgcaaaaggaagaactgcagtattattttcaccttatcccattcagataccctagttcttgaagaagggtcctaacaaggcacaggatgaaaactactcatgtatttcttcctcttccttagaagtaaacattagcttgagtcaacatgtagaaggggaatatgaagataaataggaagaataggcacaagagaaagaataggcctagatgatgaaaggaacaaaggaagaaatatgctttgagtactatagcatattatattaggcttattaatactaactactgtaacaagcaatcccaacattataatggctcaacaaaagaaggttttatttcttgttcagtcaaagtccaatgctaattggtcagttttcccagacagctctcttcaaagaggtaattcagggatctaggatccttccatgaggtgggtccaccacctcggagttctttacttctggctgtatccgtagggaagagagagagagagagagcttgggtggttgtgcagtaggttttattgccttgcctggaagtaacaaacatcgcttctatccatatttggtttgctagacatgactccatcctacatgcaaaggaagctgggaaatgtagtcggctagtgcacccaggagaagaaaaactggattagttgatatctagcacatgtaattctccatagtatctcatcatctttaaaattctttcctcactaggaaaaatccaacttttacatttggtttacttgttgattccatcctagtaagtcttttataggtgctagtttaaacttctttcttggtagaagatatattataggcatgacaaactaataaagcccaattctactttttggggggcaaatgttccatctaagttaacacaaaaagaagaaatttaaaatatcgatataagcaactgcttactaaatagagtgctttatccttgtcttggcatcacttacagttattttaagcaatggcctattttctgtgtttaaatatttctaattagccagaaatttgtcatgatatttagatcattaaaagcctaattgaaacatcctttctctccaaagcctggagttttctgttcctgtttttttggtttgtttgtttttttaagcagctttattgagatacaattttcataccactacatttacccatcataaacctacagtttaaggatgataattaaacttataaagttgtccaaatatcaccacaatcacattttagaacatttccatcatccccaagatttcttttctggtcatttgtagctaatccctgctcctacccatcgtcctaggtaactattggtgtgctttgttccaataaatatgccttttttggacattttatgtacatggaattagacaaattgttatatagtcattgtatcttgcttcttcaaaaaattttaatggcatttctatggaaatattttctctttccttttgcattggttttcagaaggaaataaggtggaaacccagcatgaaggtggaaagcctcgtatccgaagctacatctagcatcttctagcttcagagacttatttggagaacagggaactgaggcagttatttaatcaggatatcagaatttgcttttgctgttctatccacactttctcatgaagtcaatcccatatattccacatgatcagccacggaaagtcatcataagacaactcccaggattacctctgttgggaagatggtgacacagatgacagcaggttttcttaatctgataaaatattttctatttacaccccaccaaaaacagcattgagaggaaaatatgtcagcaaagttatattcccagctttgatcacaaagtatagaaagaatataactgatttcaattcaatacttacataaagaatcaagattagattttggaaattgtttttgagattttcacaataaacctttaatgtactaagaacatttattttgttggaaatttaatatcagagaaataatacagtgctcaatggttgaccagtgtttgactggaaaaaacaaatatacatgggtcttttaaactaatctaacacctttagagctaaacaatgtaaccacgtatctagggttatgtagagtcacaaagtaaatataatacattttttttctgaagctaattttaattgttaatatggagtaaaagtttaaattgaaaccaagttgatatattatgcagaagaatgcaaataagcataaatctttaagaaaaaaacataagaattcaaagacatttcatttttattgtgaatcttctctatttcatccctggtattattggcatttgagtggaaaagtttgagaagactatgcaattaaatttggagagaaaaagggcctacatgatccgaacttctaagcccctcttcttattgactccatgtcagatttcatagcttgacctgttacaggatctcacattgtctctgtaataggtgtgccggtccttactcttatctgattttcaactgtgagagtatttgcaccctgggtttgagggagaggaggttttccctgagccttacctcttgctgctatttcaatagaagtcatagggtaccttgcttaattttcaaaacagagcttcttttttttttcccccttgaagggaaatactgaattaaatttgaatcaaggtggattataagtttgtgaactttttcagtcattcttttttagaatgcctgtcctctgaaaagtcacttgggtaaaatactgaatgacatcagctatttttttttcctgttcatctgctataaaatgttgtttgttctgggaaatggctatttccaaggcattctgtgacactctttaatggagacaagagcatgaaaaagaaggatgatcttccagcatcgagagaaatcaatgggccatgagagagaagggtgatcttgaggggaaaaaaagcagttttcttctagccttcttccttttggcttcacttcctggcccttttgtcagagactatggcccagttccatgccaagtatttcctcccaagaagaaaagcaattttctaatcagctcttctttctgcctttcttaacttctcttttttaatactttgtctttcctcatggtatctatgatatattcattattattcattacaaatcctactactcctgctttccaaatcctccaagaataccacaccataaattgctctctagttactatcaataaacatatattacagagtgtgtaaatcaaggtctttggttgaatcaagtttgttgctgaatttgattcatctggcgggaatgtatttcttaatacacttaatacatatagttctagcttagaatttatttttaaattgcaaaagaacaacagagttggcagccatcatggcgaattgaactacagggtgacctggaacactactaaaggaaaacagaactggccggatgtggtagctcacacctgtaatgccagcactttgggaggccgaggtaggcagattacgaggtcaagggatcgagaccatcctggccaacatggtgaaaccccatttctactaaaaatacaaaaattagccgggtgtggtggtgtgcacctgtagtcccagctactcgggaggctgaggcaggagaatcgcttgaatccaggaggcggaggttgcagtgtgctgagattgtgccactgcactccagcctggcgactgagcgagactccatctcaaaaacaaaaacaaaaacaaaagcaaaaagaaccagggctgttttctggagaatttctggaggaaatgtcctgttcctatggctgtagttccataaggctggcagtaacctaagaggcacgcggttctgaaaacaggtatgaacttctcgttggtgtcatgagtgcgcaagtgaaagtatggaaaatgactttttgtctttgaccttgtctgattgtgcctttccctgtgatttcctagccactaatttattctatccctttcaagccatgtgcagtatgaatgaatatagagaactaataataattaaatatatggatagcttgaatgaatacagtaaacacatattaatgaatttcaactttttctttctttttctatttctctttcctctcaaacgctaattcttctgtgttgtggccatcttcattatctttctaaaatggagtgtatatgtggcatggaaattgtgagtttgtgtataagcctgattatttaggtatatgtaacagtgtctctctcactaattactttgaacctgaagacccactaatttctctgtgacaaggtttattttttcttcttagacacagaggagaaaggaagtagtgtgctgtacaaaaatatattgaccttaagacacttaagtgccacaatagagttatttgtgtcagagaatagctttgatgatcttgtgtattccctatataagctgatacctttgattcatcatagaggtgcacagtaatctcagagatgtatgaaaataacatcacaaggatatgatatctgcaaattttatctcccaagactactagtgtttgagtctttctcctcttggacttgcttggataatttgtttctttcttttttttttttttttttttttgccttttcccttagcttctctgccttaagtttctaagcagactccatttccagtgctttggaaaaattaacagcatgtgggtggttattgcttaatttaggcatagtttagtgagctgcagtttattatactggacttatggttttcttctctttcttttactctgtctttcctctccatggtacaagaatatgttatttcatctttacgaatcgtttatctgagaatctcagagccaaattgtttagctctttcctttaactcagaaactcttgcctcagaccaataaggagggctgacttcttcatcactaaaagtcattctcaaaggaaattgtagaaccctctttggtatccattttaaaagtcaagtaatcattactgtcagccatttacctggtgatgccacttattagaatcttagcagagatggaaaagcaagagcctatgtatcataatgtattctctgtcaaactataagcaagctataagcattgcacttcagagtttctatcttcataacgcatatttttgcttcttttggtatgttttatatttcttgtaacatatagaacacttcaagtgtaacaatatttatcgtatcaataacagccagattttagtatgatagtgggatgcttcctaaatatataatattaaacacttcttaataaatattaattcagattggtttattttaaaatagttaataagattatacatggaacaaaaggcaaaatagtaaaaattcttcccactcatcgtattcctcaaactccttttcccaaaggcaaccaaatttattagggatttttgtatcttctttcaggggtagcctatgagtatacaacatataattatatccacgttcttctccttttcttctttctgctcctccttctttttgacacaaataccaacaagcttttccacatcttatttttccactaaaaatgtcttagagactattccatgtaagaatatataggtttattttattccgtctaatagccacataacatttcattttaggggggtgctatattttattaaatcagcaccgtacatttaaatttttctcagctttttactactaaaaatgtaagaagtatatacttttgttcattagttaatgcatacatgtataagaagatctattggataaattcctaaaagtagaactgctgagtcaaaagataagtgcattataaatattgatatatattaccaaattgcactccaaagaggttttacaaagttatatttctaccagcaatatatgtgtttgcttctcctcactcttgtaacacacatcatattatcaaactgtattttcattctcttaagatagcttttcaaaatgttgctgtcacatatttatttcccatagatcttttcctcccatcctttaacatcttcaaatatacatagggatcattgtcattcatgactttggtgacaacttatatcagaaatcttttaatagcaatctgctgtagcaacatttcatatgttaatcttgttttgataaacagggatattgtagaaaagtagcaatatgttatagtaattttgtgtaatttatctcctacattattattgatctgtgttgggatctcagcacagacaggcatttagtgcaattacaaagagcaaggaggacactggagccaaatagcctgggttcaacacttgtctatgccacaaatgagctacatgtctttgacaagttgcttcaactcttagtttcctcaattgtaagtttcatatgaaatttagaaagaataaagggaatgggatctagcaccaaattaaaaagtaaacgtgatgtgaacttgaggcattaaattacaaataagtggtttccaaaagagagtatgctttgtctcatcaaaggaagaagcagaggaaacagcaaaagaggaggagaaaaagaacttgttcaaagcacaagccttcataagttatgtcttagtccatttggtgttgctatgatagaatacttggggctaggtaatttataaagataagaggattatttggctcttgattctggtggctgaaagtttcaagagcgggcagttgcatttggcgagggcttcatgctgcttccactcatggaggaagacagaaggggaggtagtatgtgcaaaaagatcacttggtgagagaggaagcaagagagagaaaccaaagaatatagactctttttaacaacccactctaaagggtactgatctattcccatgtacaaagagaagtcactaacccctgcctgagggcattaatctatttatgagggattcaccccgtgactcaaacgcctcccactgagcactgccaccacaaaaaaaaaggaagcaaatttcaacatgagttttggggggaacataccatatccaaaccatagcaagatatatggatataaacaaagttaatagagctgctgaattctaggaaggattgctagacaaaggaataaatttttaatatctgaacatcttaaaataggcaaatacccagccaatgtagaaattttatattgttaaatatcaggttaatagaggcagtatatagactcatataactgtttatcaatcacaatttgaactgctgtattatgttaaattagtgtacatggtttagatatataaagttagtgtacctagtttggaggtatgtatacacacacctgcacacacaaagagtgagagagagaaatatctaatgccagtacagcctaaaatttttacattgatatctgccactgtatgatttttatgacttgaagctaccttggatatagtatatgcttggtaaataattgctaagtaagtgaatggggtaatgaattgtatccattgcgctaccttaatttattatttatacaaaattgttaagaatcaacatgcaaggtacaagcctaaaaattgtaaagtacagtgttttgtcttgttgtcactcagaaaggaagaaaattaaccaaggagtgaatttgtcgtcttaacctaataatctaaaggaatatatattactttctctgtaaaataagagatttctgacaaataaatattttcatgaagtctgattgggccatattttggttgaaagtaaggaaaatttcatgaaggaagatgaacgtgtatctgtaaatattgcatgttgtcattcttccttgttcttcctcattcacttattccatggacatttactgagagtaagcagagttccaagagctgagtgtcattttaggaatttatactgcaaatttccaaggaaaatgtaggaggaattctcatagactgagtaatttctttatcccaccctactcttccctttcacattgcccacctccatttcttgtttttcttgaagaaattggacctcagatgtatgtatctctaaaatccagatgagtctcttatggattttgttcagggctaattcaacattcaattcaacataatgatgtcttttttcacaatgtgtgtgcatttctcatgatggggccctaaatgctggtttacttagggattttcctgatttccttttttgttttgatttgccctccttcatctgaccacttgcttggagcctcgcaagctgtgtttctgctcccctttaaaaggctgatgtttcagggactgtaattttagtaaaaatactatttctgttttccttctacctttccaagatttctttatgtactccaatccattttatgtgtctaattgctatagtcagatatacaaggtgacaaattctgtaagtacagttggtcctccataactgctggttctgcatctgcagattcaactaacaaaaaaattgaaaataattttaaaaaacaataaaaaaccaatataacaatagaaaataatacaaataaaaatacatataacagctatttgcatagcatgtacattgtgttaaatattataagtaatttagagattagagtataggaggatgtacatagtttatatgcacataatataagacaccattttatataaggaacttaagcatctacaaattttggtattcacaagggtcctggaactaatttctcatggacaccaaattaggaccgtattagtttcaggcacagtttatattttgaaaattaggaggtattatggtaaatttaaatggaaactgggcctgagaaatccctgagcagaacaaagccagttaggccgcataaatgaccttaaccttgctggatttgcaaataagagcaaaagttaatttgagctacagctcataaatacctatattcagagaaaacagaatgtaagctcaaccaatcagaagcagccaacaaatttataattatataactagggactttccaataggataggccaaataaggcaacagtgtaactgtaatccatcaaatattttctttgctttactcgcctatttatcctataaaagcctgctatttgcattccctcagtggagctcctgagccacttttgatttagagcttccctgtccaattcatgaatcactgtttgttaataaagtccttaaaatttttattgtgcctcagtttatcttttaaccgtttgacctctatgcggtgtaggatgtacagtgaccatttggtaagctaatattattaacctaaattctttattcttgtttggtaacaagataaatgtattaatggatgtatttccctttcattatgcctaatatatataaattatatgtataaagtacatatatacatatatatatatataaattgcagttgtttttatgcatatcataaaagataatataatttgaattctggagtttccagaataattagccacaaaatgaaagtctgtttactgattcaaagcatctcaggaaacacagtttccaattttgggaagaaaactttacagaccaggagatgttatttctaaaaaaaaaaaaaaaaaaaaatggagtaattttctggctgttctgttgacttactagaatcacatagctttttaactctgagtttatttgaagttagggaaataaaactaagaagactttatacatttccttctcaaaattaagctgtttcagaggaaatctgactatataatatctgttcagaaaatcattgtcatccccaagcctgtgccagccctctgtcagcagcactgtcctcaaagattcctcaagggaccctgtggaaaaatgaaaacaagagaggctatcaaggggtgcaagtaagaggtgcagtgttgagttataataatctaagtgtccttcctaaatggctgaaagtatattgcagtagaaaagtattaaaatgtgtatgtgtcccaaaaaagaggcaaaatgtaatggagatcatgtcctctaaagcaaaatatttggatggttatgaactcaggatcctccaataggcctgctggggcacatttcttttttaatatcaacatattacaaatggggaaaccaaggctcatggacactgagtgcttgacataaaatctcaaggtgatgaatggtaggcatgaacctttataaatttagttttataattcttcatcatatgagtactcttttgtcccctaaatcaagctgtctcttaatgatgacacaggactttgtttttaaaggattaatggggaaaaaagagggggatcactgcaaaggtaacgaattagaatatttttacctaaaccgatgaataggagtggaatgaaatttatttctgaaatccaggagatgacagagaaatgaaattggtgttatccacaagtgcgggcaggataaaatctaaagcaataaacagagggctgctcctctgttccagtataataaaaagtaatatttgaaacacaaaagcgagagagaggaagacctgcttatttcctgtgaggggttttcctgtgataggaggcacttttcttcctttcctccccagaatccgaggagaaggaactgccccactgaccagagtgacaatgcccataggactgaaggggtaagagcaacagaaacggaatgcttgaaaggagcagaaacagtgtatggcagcagcaaatgtgtgtcagatagaaagacaaagggaaagggacacaaagaagtattcacaatggagcaacacacatgtagtgtgttttataatgctggaaaaattctgtacctttcccatctcacagagaaaagagaacacaaaggaagatggataaaaaaaaaaaatgatgcagccactgggccggttatctctggctagagaaggattaccatttccttacaaaaagaaattgataattgaaattaaactcagattgcccaggtatacctgccggcagttggaatgtttaacttaactgctcggtttacttattgacaagcaaactcccttttactaatagaaccaatttacaaaactttccggtcatcataaatagaaaagccagatatggtaacaccgcgatgactagttaagtactcaggtacttatccatgactttgtttatccatcctcctacatatctgatagaaaacacaaggagtaggaatctcatggttaacatttcaaaggcatgaaaattgaatactaagtgaagatacaacttcattctttcccctcttcatatcttcctggaccctttttctcctttgtcacagcaaaataatataggctactaagtctatgcacaaggatatttacaataaacatttgacagtctttgctattgctatatgaagtgcatgcacttgacaggtggctactaattattatagtaaaaacaatagcattgagtgatttctgccattatgggataagaagtttgctggcattatcttatttaatcttcaccacaatcttataaggtaggtgtcattaccctcattttagaaatgagacttgttcatatggaggctgggtgtggtgtctcaggtctgtaatcccagcactttgggaggccgaggtgggtagatcacttgaggtcaggagttcgagaccatcctggccaacatggtgaaaccctgtctctgctaaaaatacaaaaattacccgggcatggctttggacacctgcaatcccagctacttgggaggctgaggcaggagaatcacttgaacctgggaggtggaggttacagtgagccgagatcgtgccactggactccagcctgggtaacagagcaagattctatctcaaaaaacaaaacaaacaaccaacaacaaaaacaaacaaaaaaaaaaaaaagaaaagaaagaaatgagacttagtcatatggaatgttttgcctagcttcagattcagtctactccattccaaagcctctgctcctcaccattgtacatattgcctctgccacttgtatgctgaagtgttaatgcctaaatgaatgaaatctatcactctagaacaagtgctgatggtcccatgaaagaggccacttctaatcactaatacctcctatctctgtaggtagtctttctgaagtcttgaccttccagagtcaagctccctcagctcagctctataggcatattagtgccccatgcttgccataaccagtctcgaaggcattgtctatttcagtgactgaaaggtacttggcatttagagatgcatagaagatgaattaggaattattattcaggaacagagacaactaagaagaggataacattagaatgccataattcaacttatgtttattactgatgaatcactctccacatgactgatgctttgttgaccttctcttggtaatgctggtactctctgtctcttatttccttccattgtactctagtcctctagtcttagccaacaggttgtggctgctgcaatccccgaggctcttctacgctacctctgtgtccatgctttgctgtgtgccctatagactgttcctctgtatctgcctttgcaacagctgtctgctcatccttcataacagctcaaggggttaccacctagatgaaaccttccttctactccaggcaggtctagctttttccacctttaagttctcctggcacttcgcacatctttcagaactcttatcacagttatatgctgtaaacaaagaatcatgggttttataaaattggaaaggagaactttatttctcataaagggttgcagcctgcaggctggccatcccagaggctgggaagcatagcctctggcaaaagctgagagcaagcacattgaggtgatcaggggtaaagggaacaggaatttatgctgagcagggtagctgaatatacatatttaatacactatagaaagagtcatgaatatttacggaggagaaccatgcaaatgtgcaattgagcttcatgcctcttcatgggttacacgttaaaaaaaaaatagctgtgttagcatgatctgagggtggagtttttggccctctgacatcaaaaagtaaaccagaggatatgaaaattgccagtgtatatcccccacaggtcagccaaaactggtccagagatggtggttggtttttaggaagggatgccttgtgaaactgattaactgtcacatcaatactgtaaagagggagagagagtctggttgtggcctcaggtgattggctaaagacaataaagaaatgggtcacctgcttcttttttttttttttttttttttccagagctggtttctgttgctccttaggaaagaatcctggttaaaggtgaataaggaaggggtatactgaggcatgaatatactaaggcatatctaccctccctgcccatcatggctggaaacttagtttttaaggtttctctgggtactccttggccaataggggattctgttcattcagtcaagggacttgagattttatttttagttatctattctttatttgtttccatgagtatcttcagaaccaacctctggactcctcatgatttggggaaatgcactattcatcattgtatcttcaccatctagcacggtgctaatcatatagaaggcattagtgaacacttattgaattaacaattgtaagtttaatgacttgaaactttgagccacaggagaaatctgtagataaacacagatttcttagtaagaggaaaattattccatccttacaaagacagaaatctcagcagatcagatgaaaataccatagattatcataatgagggcacttgcccaactcttgaagggaaatatgtttttagaaacccttattaaatactacaatatcagaaggctaaatttaaattaaaaaaatgtgattccaaaacaatctgagcacaacggggtgaccacagtcaacaatatttcattgtacatttagaaataactaaaaaaaatactaggattgtttgtaacacaaagaaatggtaaatgcttgaggtgaaggatactccatttaccctgatgtgattattacacatcatatgcctgtatcaaaatatttcatatactcaataaatatatacacctactatgtacccataaaaattaaaaatataaaagtaaaaatcggatccatcttttccctaaatagtggttgttcaaagagacatttaaggcacaagtgttgtttgtgcagtattgttttgcacatatcaaattctaggttttatgtcttacccaccctggatagaaatttatatccattccaggaggcggaggttgcagtgagccgagattgcaacactgcactccagcctgcgtgacagagcgagactctgcctcaaaaaaaaaaaaaaaaaaaaagaaaaagaaaaagaaaaatttgcacccattcctgtattctttttataggcttctgtaagcttcaaaaatgatccttaaagagattgaagatgatgactcagagcagaaaaataaaacaaaaacaacatgggtggcagagttgcgtgatagaaagaatggaaccttcaggtccagttaaacctgctctgctattaattagtttttggttttgaggtgatttttccaagccgtcattattagtaataagagctacaatatcattggatgaagaagaaaaatttctgaacagaagcatagctcccaaccatatgttttccataccagcatctatacaggcaccaaaaatcatggatgttcttatagccttgtgcctcacggcgtgaattgctcattgatcatttgaactcgtaacaatggaaacatcagttttaccaggcctcctgggcacttgtctgacctttctgatttgtcaaatggaattgcttcgtttgtaaaatgtttcataggagacaggacaacaatctctgtttgatgaaggtgaatgtacccaagataatttctagggttttaatggaagagttttgtgacagctggtttagcatctcatgtaaaataaattcaaggccttttgtctcactgaaagtaaggtcacattattaagagagaagatcctcctctaccaaagtcacagggattgactattcagttgaaccccagaggggctaatctgtccctgataaagttgagttggatgagtatcatgcattgcatgtgtttgcccatgatgagatatatgcagaagaaacaagaacaataatataggccaatatttaatgaggacttaccttgtaccagataatgttttcaattgtcacatgtattagatcctttaattctcacaaggatgatatggaggatacaggaccatttacattatttgtgtgatctagtgccaaataaaaatgtaagctccttgttctaaaggcagaatgaaagctttttcctttctttctcaattttttagttaacctgtcaaacatagggatactcagggagcaactgtagacccccacaggcactcacgaccccaccccacgattctttgtgtggaggcagaaggttgcagcagttgctagagggaggcagaaaagtgaatgaggaagaatctgcctgggtaggcaagaacattcaagccaaggctccaagtccctggctcatgttccattgtgccattgaacttgaaaaaacatgcacacgcataaattcacagataaaattcttaagcatttcaggacagtgactagaaagcattaagccccaaactcattgggttctaagtgactgcactggttgcatacctttgaatatggttctaaaagtaggtaataatattatctgaattttacagataaagaaactacaattaccagaaacaaagtttttgtgtttgtttgttttggtgatgtgtttgtctaccatataatcacgaaaacatactatgcctattatacaaaatttagcttgttctatattttggtatacttttaatactactgttttaaaattcttaatttctcctgcatgtcttccctcatggctaaagataaatttggtatcctatgaactatgttttccgtcaaggtttgcacaacggcataaaacaatccatcacatttttctggccaatagatacatgctttatttctgaatgtcaacgtttaagagactgaagtctgtgactactgttaattttgctagtaaaaataagttctccctgattttggttattatccattgaagatgttatcttcaatagttatccatgcctatgtcatgatatcttcacttcttcccaaatattatcttcctcagatattcaattgtgaatgaaaagtcaagctccttgtccatttttactgtacctcagccttcaaaggcctaaattaccatttcatttctgttgctgatcatcagcaactagaagacagaatttggatattctcacaccaatgtactattgctgcagaaatcctttgggctaactgagaggaccgaaaaaaaaaaaaaatacaaaagaacattccagaaataattacctattcaccatctttagtacaatgctgtacaaataattaatttttggttcgttattctctattcactttttcctaacatatggacgcatatatatgggtccagtgaatcccattcaaagagaatagatggtgggaaaactattggatgccatcagaatattttaaagaaaaaactgtcctttgaaacaaattctgcagaatattttgaacggaataagagaaaattggtttcaagttaatcagtgaaagtgaaacacttgctgaggccataataactgccattcctaagggctgacaggtcatgccattttccaatgtcttgctgaaaaaaataatttgtgtaggctaccactgagtagccatactggcttgccttgttcctgccttccttctgatttggggcactgcagtgggagctgacatgctgagctactcagctgtctcagcctcatggccaggcctcactcaaaacagtgtccgaggaaaatgacaacatccctttggggaactgagctagacctcatatagtatttgcattcatggaacagcgttttcttgtacttacagaacactttgttctatttaacagcatacatagttgtatctgattttattgccattgcctttgaaggcacacattcattgtgctatggtttggtaatgttcttctattcaaattgatttgtaacaaagaatgggtttacttggactctctgcatctagtgttggttcatgtcgcaattacctgcaggcagcaactgtttattgatgaggattttaccatagttttatgtgattacatgttagtttagctttcccttctaaatcaccacttagtttatagttcaatattatcgatccaagtgctaccagagagcaattctattgatggcatgttacgtgtttggaaggcagtctaactttcaacccacactctcttttggagagaatgttgcttcaactaacaatattgaggctcttgcttaaatattcatctcacacattagagtaattggcattaaataaacttcatatctgaatattttcattaagaactggagagttggtggtccactctaaagtgtccatatagaagttggctaactttttctgtagatggccagatagtaaatatttagatttaaaagccatatagccctgtcacaactactccattgtgctcttgtagcacaaaacagccatagacaatgtctaaacttattggtaaggctgagttccaatacaactttatttactaaaacaagtggtaggacagattttgcccaatggccatagtttgctaatccctgttctaggaccctaagagaggtacatttgtagaaattatgtttggaaagcagactagctacccagaattccaaacaataggcacatggaagtttggaaaactcttcatttaaagcattttttagttctagatgctggtaatgcaatgctgaacaagaccaacatggtttctctccttataagatttgcattaacatttgtgaatgcataaagacttaagtgagttcaagtaatgccaaatgcaataaataaaattaaacagagtaaagtaaatgcctggatgtgggaggaagtataactttagataaaactgccctggaagcttttctgagaaaatgatatttgaattttggacatttgatacttgaatgatgagaaggatctagtcttggaagggtttgggaaagagcattctgtgcagagacattgacaaaggtgaagggcttatggaagatacatacttggtgtgtttgaggaataggaagacaccagtacggttgagaagggaaagggactgttatctctatcttgaactgtccccattaaactgatctataatcagaattttaagtgagttaaattctctttctgatttacaatcatcctttcttttgttcttagtcacttgtggaggcaaattcgcaggttatctgcagcctttcatgtcaaaatgtaaatgtttataaattccaactcaccattattaaactggaagcaagccagtgtttcagttgagggacagttaaatcacactgtttgaaccatatttgaagaaatgatgacaccagtgtattagtggtaagacttgtggggttaaggatccataggtctagtcatttgagctatagagaggatttcaccatagtcaatggtcttcaattgctaaatcgggtaaaatagctcaactattagtttcactatggatgtctagaagcccaaaactcatcagttaattgaatactgtagactgggggaaaaaattattttatccaatcccaaaagaatcaactcaagtttattttacagaaaaatattgcatctagtcctatattgtaattttctgaaggtttttaaaataaaattattttaaatcctttgttgctaatggttgtaaaaacactaatccaaagagaattgccagtatctaaataaaacaccctgagttaatttgactcaaaaaatcaagtcctttgcctcagttaagtagaatgtgagaaaatggttctaacagaatcaagttcagctcagggaagttaattagagtgtcttgccttaaaagacaaggtagttttctaggcaatggtatttgataacaatgtttcacatgaatgcaacaaaattctgtgctctgttaagaattgccgaaagagaggaaaactctgtgagagagtaacctgttacagtttcagatagccagagggggaaatcagtctgaattcataaaatagtatatcatggattttttaaaaaataaaattgcttcgaaatacatacaataactcgcccaagatgtgtatgggtgcgtgtgtgtgttatctccatcccaataaatgctattgggaatatataaggctgacattatcattttagttgattaaaataaaatatctaagttactcgtagcatgcttaaaatatttttataagtaaggtaaataggcttgacaaactggtgatatcttaatttgcttctcatatccatttttatggatatgataaaggtacttgtcagcctagattttgttacaaattctcaatttatgtttgattctgaataaaattttattaaagatgtctaaatgcagcatctctgctaacataggatttccaaaattttaatttgtcaggaaaatgaagagtaagagattacattgtgtaacatagggcatttttttcctgcctcgtcttagcacaagatattacaggggtttttactctttttttaaattttaaatcaggattagtatactcatttttttcttggtgtttcctatttgtaactgatataatgccacaggcctgggagctttaaagaaaattatttaataataaaatagtatttaggagctcttttttttttcattttctgagaagatataatgcattcctttaagcattttgaatctcttctctagttggcagcagcaaatattgtaagggaatatttttgaaatatgaatcttaatcacatcttctgccatatccacaagagtttccattttatatgccacattcaacttcattcatctgacaacaatggaaaaatgttactttagacatcaatggaagttttactgagtatcatcaaatgcttagcaaatatttaaaatatttcacatattcttacgatcagaaattacacattgaagaatacttcttgatttgggaactttaataaaaagaagtgagaaatagatcttggtctgacatggaaggtggagcaagctgatgactttactaagtgacttgctacattcttatagaacaaggtagtgggagtatttttcactaaactatttatgggaccaaggtcacgtaacttactcttgtagcctaagctggtgataaggcttggacttttaatttccaaattatagcatgcaggtattagaaaactgatgacgcaagccacgattctcactgaaaaagaatagaacaatatcacacctgtaaccccagcactttgggaggtggatcacgaggtcaggagttcaagaccagcctggccaagatggtgaaaccccgtctctactaaaaatacaaaaattagccgggcgtggttgtaggcgcctgtaatcccagctacttgggatactgaggcagagaattgcttgaacccaggaggcggacgttgcagtgagccaagattgtgccactacactccagcctgggtgacagagggagactccatgtcaaaaaaaaaaaaaaaaaaaaaaaaaaacaacaacagaacaatagcactttcactcatttgcaattttagcagagttttcatgggtgaatatcaacatctgttgctccatttcctgaaaagtcctgtgggttggaatgccagtgctgtcccaattcactttgtcttttgctttagtaatagcaaaaatcaatgtaattaccatcactattcacagttttttttaataaatagtgggaccctcatttaagtcgataaaattgttctgtctcattctttgcctttgttcaggatcacatatgaaattcttttctgcaagatggttttctacctccattgaccttgaaatgaaaaattctttcaaaataaatattttacaaaattatttctaagtcgaaaaagacttagtgtcttggtgtacaagagtggggtaataccagcatgtttctcagtggggagtggggtaaaagaggaggacaaaaaggttaattaatgcataaaagtgcctagatcaaaggcaggcaccactgtaagcaaaagacatctccttgaatatttcctactaactttcaaaaacgaatggaactcagctgtggtttaaataataataatgcaagagacaaattcaagagctttgtctcttgaatcaaaaatggttgtcaagttttctggttgcatatacttaaacctgccaaaggtaatgatggctacttcaagaagtctgcctaagatgttgatacaatcaacgactctgtttagttgttcttgccaagaaagaaagaaataattccagattccaggtgttactacttagctggatgttttactttataaggaggcagcaattcatgagaaacagctgtaattacacagcattcaggtatttcataattaaactaacagctgattttaaggtggcacatggcatgagattttgcaactaggctaagtaagcatgaaagtgtagcttagttctcttgctgtcggctttggacaaatcctctctgtgccttggtgtacaagagtaggccaataccagcatgtttctcagtggggagtggggtaaaggaggaggacaagagggttaattaatgcataaaagtgcctagatcaaaggcaggcaccattgtaagcaaaagacatctccttgaatatttcctgctaactgtcaaaaacaaatggaactcagctgtggtttaaataataataatgccaaatactggaatcatagaaaactgagtattcttatcggtatccctgtgactcagtgattttggttccttagagaactcatcttgttatgtaggactgaagaggagcttggatgtcagttggataacattgatcctgttgaagctgtaccaggcactgtgtaaaatacaaaagttgtagagtcatctgcaggtctggtatacatggaatttacaatctaagtttcacgcataaaacatctttccggggaagacataagctattgcccttgaagatttgtaacctaggggttggagatagactccatgaggctgaggctcctctattccccatgcttcaggagagttgctcaagttagtcatggctgtgcctttgcttgtctctcccaagttctatttctattgcttggtaagtaaaacagcttattttcagggttctttaacaaattctgtaattagtactctaaagtgttcagtgatcctgactgtgttacttttcactattgcttaagatctcatgtcttttgagtgacctcttccttcaggaacccttagagccttggttttgtgagcccataaatgccaggaagcctccaagatttctagctttgtgaagtttacagaccattcatttccgcagtctcctgttgtcatctctaggggaattgcagtgtgtccatccacccttgaggcatggcaaggtgaacatcccttggactgaagactgaatgcttggttttgttcccatacttaatctgagagattcaaataattctttactttgctgctttcctaagactattttaataagaaaagcatcaaaagaacttggtcaagatggggaatcttgggtcaggaaaatttggagacttacttgaagagaatatttgaaaaagattcaaagattttgaactatcagggtagagggaaattgtttctggtggttaaaatggtaggaagtggctttcaaatctgaaaaaatctaaatgtttttaaggtgttccaggcactgtggttaacaatttatattccttttcttatttagtcctcccaacaaccctgccaaagaggtattattattcccctttgaagtgaggaatcttagtgcattcaaaaacattcatctactatttattgagcacccatatttctaagtgctgataatgtagttgtgaacaagacagcttatattttagaggagacaggtcattagcaactcaacaaataagtagcataattttcctaggaaaatatgttgtgcagaaggtaaggctaggttacaggtcatgccaattgaaggtgggaacacagtaggtgggtttgcaggacagaaagaatgtatgtatggctggtgagtgaacaagggaggggtggtggtgggaaaagatgcaaggatcaggcagggtcttgctggccaaggtaaggagtttgcatcttattctaggagcgacaggaagcttgaggaaacatttataaataaatgagtgatgtgattccgttatgtattgcaaagtttcctccggcagctgagaggttgaataatttgttcaaggtgaggtgggcacaaagaagaaagatggagggggataaatgactcacttggcacctgggtccctctgccttgaaatccctttcctgaatactggtctattttacttgactactagtattaagagattggaaagaaagaatgcaagtaatggtcagagaggcaaaccgacttaaaaagctgaagcaaaaagttgcattattttaggaaaatgaagcaggttcattcgtgctaactcctgggaagctggcctttgagtggctggcttgcgtggcccttgcagtgttacctggcaactaaggtaaccaggtgaggaggctcctttttaaacataccactgagaacaaagcttcgtttttggatactcaggtacaaggaggactgatatgtttgggtctcctgaactgtgttcctgaatttcctctgccttcttgctaataacctgaattgtgcagatactgctgcggctaccagcacacaccagtgttgaaagcagcaagctttggaaggttaaggagcaagttgtgcatgaaacacttgaccctgccctgctaaataaagaaccgacatacagcctacagtgggaagaaaagagagagaggatgctccttgagaatttttttttgtgttgcagactcttcccctccccttcctcctcccaacccacccccagtccatctgtgatgcctgaattctttacaggctgtcttgctaaagacatcctagccttaatcaccttctctgtattgtgtatcactcctgtatctatctacttatgtcagttgtttaccagttcccttcagctgtctgctttttatcatattattgatcagtcagtcttgggcgtcttaggttggaggggagagagagagaaccggcaaagggaagcaggagtagagaatagcggtggcggacaatcagttaagatggttccaaaaatagctcagctctgctgatgacagctctgcttgcagccaccccgtatgggatttacgcacttcactaagattctctgctgaaacggattcgaccagctgctcctgcagttggtggtggctggtggcggcggtggcagcagtgggctggttacatcttcagagaaggaattggaagcgataggtttggggcaaggcaggctcccacacagggacatgagatttattatcagaggctattaggactcaggttgtggggcatctgtgttctttgtacactatgctctgggcacttggcatccagtttctttttgtccctatctcttttgaatgagatgagggagtaagtgatgagaaattgttatatttctcacccactgtgtctattttgttgctattgctctagtttattatatacataggctttttttccctactgcactttctgttgggagactcagctatgtacaggtcccaactttataattctttggtcttatccaagactttcatttgtcaaagaaactctgcaaagtggctgggtctaaaaatgtaatataagtaagtacaacattgatagagggcccctgtccctcaaagactctaagtctatgctatgtagaaaatgcagtgtttcttatctagtaaggtgatcctctcttagaaaaagaaatgatcttgcacaggctctcaggcttttgtaatcaagactccttccagccacaacacctctaattacagggtttttggcatcctgattgtcccccaatgtactatgtgtaggggcactgtgggggtgccctataatttgtcaagcttattatcttgctctggcacacagaatacactgaatcaatttttaaggtctctttcaaaatgtgtctacgtcatctaaaacccataaatattaaaatcatatgcactagaaacagttaagatgtttaaattttccagaacacagagacttaggaaacaggcaagacacaacatgaaagcaaaaaaggaaagagaatgttacttattctattatctgccatgatggggaaaggggagacagaaaaacaactttctccttataaatcccagcttttgctgctgcctttactataaatattgttattcaaaaggttttcacctccttcttgggaggctattcagtgaagtataagatataaagagcaattttattgcctaaatgagaagctggccaaagtgtagtttcctcagctccatgctcagaacatctgattcagtaggttgagttgggactgatatacattttcataagcatgtgcagtaattctgatgtagctcgtctgtggaccacaactcaggaaccctagtcttttaaatgtatatttttttaataacatggtgctctaatttggagccctcagaaagaaaggaaaataaaacagcataacctgtgtcctccatgatagtttagtgggctctagtattagtttatttcatgacatgtaattgttattttcatttaatttgctgcacaattacttttatgtataatccatgttgagatgtgaataggacaatttactttatttaaatactttcagcattggcatacctgaggagataatagactatgagtagggaagacatgggctgatgttctacagtgttccagggtcagccattttcttgctgcaagccggagaagatccacacttccttctattctattgagccttagagtggccacaaggagtatcagttgctccctcctttgaaggctggagtctgtgaaggcagtgttcaagttcacttgttaacccacatcgccacctactgtccaccccccatccttaattaagaaacttttgcctgggagttgggcggagattagtgtgagaggctacagtatgaatgaaaagtgagattgtgaatgcacctctatcgagccctattcagaatgcttgatttgcaatagtttattaagaattacagcattactatccttaaatctaaagtctctctctctttcagtccagaagcaaattacttttgggttagaaatagcagccaagttcctgttaaaatgaaaacaaacctctctccaccttgtgtctaaggccctctttgttggctttaaaatgtttattgatttggggatttaatgttggatccaactgtgaatagtggccactttgggcctggtgagtgatcctggaatttgtcaaacaagtttatggaaggaaacctgaaaatgcttcaccctagtcctttgcctctttatttttgtgggttttttttttttctctttgagaatgttttctatttgagtggagaatgctctcatatggtacttttctctgatccttttggaaagagcaagtgtcctttgagaaatacttgttcttggttgttccctgctccccacccccatgcctgtccctgccacttctagagcaggtggaagtcgcctgtgggttcttctggtctcaggctttgactgttcccctccacaaatttgttcttaattcgattttgtattgaagcacatcagttatttgggcttccatctttagtgaaaagccacctttgcgtgttgttatgccacattacagtgttccagaaaacatattggtgtagatgcaaaatcttgccttcataatttttagccttatgttggattagagagcatattttcaagttgatctcttggaacctcagcatgaatctatattagaagcccagagaatgctaaacagagttttcactgagccatattagataacaaattattttacctataaatgagatattaattatatagattagatttttgttattagattatcagctatggagtgatcaccaaggaggataaaatagaaatagtataatcttctttgcccccctttaactctactatctgtggaatatactgaactttttacaaccaagtctttaatgctctttactttccctagcaaatgttcttccatttaaaaagtctttaaaatacttctttattttagcagtgcttcagaaaatctatcttagaccattctatgcttttaaatctatgataagattaattaagtaggctaacaacctcacttaaaaatattacctcgttcttgtaacattaatttctacagatttttttattgtgtagaagtagatacatagatattcctagtaactatagtataatataaaattaaaatcctatgtgttgaatcattatgttaataatagctgccatttctggagcactgtgtcttccaggcctctggtaaacactgttgcatacattatttgtcttagttctcaaaataatcttgagaggtttgtactattctttccatcttacagatgcagaagttgaggcacatgaagagaattcttaggatcctaaattttcataaatgccttcaggggaatttgacaatcaatctccattaggatcacattctagtagttttggccaaggagagtaaaggaaaagcttgtctttcttgcctagaagtttaaaggtcaaatcctctctctagccatattgcaattctggggacagttcctattgattgggcacttccatctaatatgctgttcaactgagattctttctggccaagagctgtgcaggggtaggtggcctcagagaaggagctgctggaagggagaaaaaggtggctttgtccaaaagagatgaagctcataggcatgctgtgcttcataccctctactagccttgctcatttaggttatttgctgaaaactatgcctgtctcagggagaatagtgggtgctggagatccgttggtgagtggatgctttctcttccctcatatagcttaattgttagtgctagagacagatactaaaataaatgtactggtgcaaagttaacaacttgacttcataagagccataaggggaaattttaaattgtgtgaaaatatatgactagaagagctgctctattctgggatggccatggagcatcacgaaaggctttgctgagcacatttgtgctggacttagaatgatggctaggagttactaggctaagaaagagggatgtgccaaagatctttaaggaacttaacatgaatgtggctgaggaaaagtgagggatgagcttagagagtgtggaaagggtcagataatggaggacacagtcagtcgtgataaggattttgcttttttatcttaaaagcaatggagctcatgtactttcctcttgatctgcccaagtacttcagtcttcttttccccttttatgcttttcatctgtccaagctcttcagctgagctttcctcactgatgacagcactatctggagtgaaggaggtgcagatcctgagatggactgcacaccccttggggctggatggacagactactcttcgagtgagataagggatgcaagtgtaaagggcgagtatgttgcctcactcaatcacatgttcaccaccctctctgccaacctttctgcctcctgctacaccctgcctaagccatgctgaccaaccttgtcactctggcctcactggagcaagaaagtcttagaatgctggagggttccacaagaataaaaagagcccaccacatctgcatgcataaacactacacagctagctcttgcttatttctgagtccagcaaatattatttgagtgtttttacacatcactgatccaataaggaaaacttgtataaagactaatgtttttatgcttcctttatagaacatgaacacatttgaggttttgttacttattctggagcattaatgcaagatccaagaatatcagctttaagatttgtttttctattctcagaataggtttgaaacagagagcaaaatacctacctgtatgccttctttagtgacagttgtttctaaaatatctgtctttcttctgagagaactatttgagtagtgagaattaagtaggaatggacataaagagattatcatgaagatggttttatgatcatcactgtcattgccattgtcaaagaggcatttattaaatgccagatttgattttagcattgttttaagttctgttacctgaagagaattcaaaatcacagtctttgtcctatgggaatttcaatctatcaggcagccttgatttagaaacatttgaagaggacataaaggtaacaagaatgaaaagagattggatcaatatataaaaactgaaagcatttatattacttagaagttaaaagtcaaaacaaatctagaatactgttgggatagtcagaataggttaggctgtgttgtggtaacaagccaaccccatacctcaggagctagcagaatggagtttatttctcacttcatacttcatgctcatcacaggttggcaagagtatgctttgtgtcatcattgttaagggacctagactgagggagcctttactatccagaatgttgctcgtcaccctggaagcaggaaggaaatcaggtgaattctgactggctttgaaaggtttctatccagaagtgacactttactttcacattcgctccattagcccaggcaagccacacggtaatgcatcactcgaagagaattagtaaaacagtaaagaaacacttctgatcaaatttagtaattattctagccacagtaatcagtcaatctaattagatgataatactattagtacttatcagcaacaaaacatgtgctaggtatcaaatgctttgttaagcaattcacacacattactacatttaatctttactgacttatgaggtgggttctatcattatctctattttccacatgatgaaattaaaactgggagtctttaagcaacatgcctcaggccacacagctggtattttgtagagctacaattaaaacccacttactcctaatttaagagtctgagtgttttttcaagattcctatcatgtcacagaagtccactgacttgttttgatcgagctgagaagaacagactagagtcacttctgacctggccacttagaattattaagaagtgtctctgctttgctagaaatctgtctttggctttgttggtatttagaaccagatggatgatgatgatgattattattattattgtaaaccgtcttccacttgttttctatttcctttctttaagggtgttagtgaataattctttctttcacccgggttcctggagctccttaagaattaacttcccaggctctttcatgtttttctggcaccatcttggatgatgagggcttagaacattttgtgactatgcccactgtctggaaaggcttgtaggtgaaggattctttaagaaaactcagatacttttctcaaattcacttatgatgatgttttcccaaatcattttttatcaattctatttttggtttctctcacttatgaattgtttctgtctccttcattttggaacatttttctagttcattgtttttttgttttttcactctccctccagtgtctagcaaaagcctaacacacattacttggatattcatatcttaaaaatgaaagaataaattagtaaagtggtggattcagaattctagttgtttttcagctcctctgccttgattacctctcaccaagattttaacgaagagtgctatgttaacaactgagccacttactttctccattattatataattttaataagtttggtagcatgttttctcacctgtaaaatgagaataatgatagcacccatctttcagggttagaatgaggatttgataatttcatgctgcaaagtacttacgatactgcctgacacacagaaagtactaccataacagcaacaacctctttatcctttgccttgggaatcaaatattttctacagatttcacttttcaggttttctttgtacactgaattgtacctaaaatttcttgtgcctcctataagagttcatcccgaggagattggttgcattattaccatatatttagatatttatttcctttaatctggtcatttattatcaggcaaaattcacccccaatatttcacataggttcttttctattttcccgaagtgttggcaggtctgagaaataaagggaaagagtacaaaagagagaaattttaaagctgggtgtccgggggagacatcacatatcggcaggttccgtgatgcccccaagccacaaaaccagcaagtttttattagtgatttccaaaaggggagggagtgtacgaatagggtgtgggtcacagagatcacatgcttcacaaggtaataagatatcacaaggtaaatggaggcagggcgagatcacaggaccacaggactggggcaaaattaaaattgctaatgaagtttcaggcacgcattgtcattgataacatcttatcaggagacagggtttgagagcagacaaccagtctgactaaaatttattaggtgggaatttcctcatcctaataagcctgggagcaccacaggagattggggcttatttcatcccacagctgtgaccataaaagacagccgcccccaaagtgaccatttcagaggcctaccctcagggatgcattctctttctcagggatgttgcttgctgagaaaaacaattcagagatacttctcccacttgcttttgaaagaagagaaatgtggctctgttttgcctggctcactggcagtcagagtttaaggttatctctcttgttccctgaacattgctgttatcctgttcttttttcaaggtgcccagatttcatattgttcaaacacacatgctctacaaacaatttgtgcagttagtgcaatcatcacagggtcctgaggcgacatacatcctcctcagcttatgaagatgatgggaataagagattaaagtaaagacaagcataggaaatcacaagggtattgattggggaagtgataagcgtccatgaaatcttcacaatttatgttcagagattgcagtaaagacaagtgtaagaaattataaaagtattaatttggggaactaataaatgtccatgaaatcttcacaatccacattcttctgccatggcttcagctggtccctccattcggggtccctgccttcctgcaacaatttatcatctgtttgggttattgtcccagggaatcatattttggtaagacacgtattctttttagcttaaatacttgttattataatacaataggcttaatgactttggctccatgtatagcaatgttttcatttgttgatttgttcttttattcaacacatatttattgagaaaaagaaaaataattacagagactcttagagctagaaagaatcttaaaatcttttaggcgaaattcaccctcacttgtacagacgtaatactaagcatgcaaaaagatcagtggcagaatttgcttcttcagtgtcaaagtagattcaatgagagcagcaaaggaaggaacatttcacttcttttcatcttttccttgggtaattccatttccctcaataaagaagggaggttcttccatgaaattaggagtttctgctcctgtaggtttgctttagtattagttgaaacattttgaatcaaatatgaagaacagtaattcatatataggctgaaggacctagattttaagttgttatggctggccccaagtctgcattgacataaggaatgtctagagtacattctcaggtctgcagccttgcattctgatgtcaagaagcttgaatggtgtcacagaaagggtgtctgaagacatggtgcatctgtttcctgtggcttccaagcaaattaccaccaacctggtggcttacaaaaatacaaactctcttgcagttctggagcctggaggtctaaaatcaaggcactggcaaagttttagtccctccagaggctctcacggtgactccattccttgtctcttccagtttcaggtggtgctcagcactctttggcttgttgctgcttcactccaaactctgcttccatcctcacatggtgtttgctgtgggtctctgcttctctctccgtctaacttataaggatacatgtgattgcatttagaacatgcgtggctaacccaggataagcaccttctctccagatgcttaatttaatcatgccttttgtcatataaggtaatagtcactcttttgccatatgagataacatttatccattctggagattcacaggttctggggattaagacagggactcatcttttccaggggctgccattcaactcactagacctgaatttaagttcttgttctttgactgcctttccatgattgggcaagttactgcatctctccaaaactagggtttctgctctgtaaaatgagaataataacgcctaatttacagggttataataagaaataaaagtggtaaatatatgtatttatatatatgtaaagttacctaacccagttcttagcataattagttgctgtagttccaggcattcaatagatagaacagattttaaactactttaaagactagtgtgaggctggcctatacttagttaagaatttgttaaagtttgatgatttggttgaaaaaatattctggagtgtgatggttaatccctctggagaaccctgactaatatactgagtaactacaaaatgattttatatttagttcaccattatacatagaatagccacaaaatggttttatattcagataaccattatttgttggccatgcctcatttaataatatttcctctgtctgctttccactgcttcataaccactagcacattttgaaacatattactatgtgatgtcaaattctttaaataataatgagttttagtttgagtaacaaaccagtgatgtctgtgatgtcacaggcctgaaaaaaaaactgttgcaatgatcttcattggctaaattaaaatataaagagtagtatagaatttatcatccacattttacagaattattgtttgagtcatttagggtttctattccagtctcttaattgaactgtactttctatatctgcaagtcaaaacactcatcaaaaaatatgacttcaaatatgatagccaacttttgtgttactacatagtgttaattttacagttttttatatgaaataactctctgagttaggagacaagtaaagaaatgttgccaacactcatagatatgaataacaacgtaatttaaggcatgttgcaaaacataaacttttaatatatccctctataaattcttacttttagtattcttaattctcagatattactccttttcatatgattgcatttatattcttgtttaattctctcttttttctacttatatgatttcctccccactgacttctgctcctccttcctgcttatagaaagaatgttgacctcaaatgtctattattttttcattcaatgaactacagtaaagttgatgtgtaggtgacaattagtgtaggcaaaaggtagagtaatgttgctttccaggtatcttccaactctaatattctgtggacttatatacttgagagtattcattctgcgtgtaagatctcacacttctatagctgatacattataatctgcctatgtctctttttatctgatctatagaaaaaatattattttcatatcttcatatgtttttgggttaccttaggctattaaaagaaaaataatgaagatgttaagatatttcaggacagtatgagtatgttggggtgtgtgtgtgtgtgtgtgtgtgtgtgtgtgtatgtgtgtgtataaaagattttactttttactcagccaacgctttagagatcttctgagtttccaagtaaatttatttgcttaagatgtgtctgtttgctttcatacagccattccacatcttccaagaaatgacttcaagaacatctgcttcagtactcataaacatcctatctgctcatcattttcattcttttacaacactcccactttcaaatcacatccaaaatggcaaaaagaacccaaagctaacatgattttagatgtcaattgtgtcctctctgtgaatgttttccatatttgaaatggctgtggaattatcttgcctctacccacagtaattgagaatgacaggaattggaaaagggtcatttcctctgtctcctgggattctgaaagctgtgttttcttttatacctgatcaggtctgccagttgcaaagctatacaatgtagtggagaactgcatacggttaattatgacaattacaatcagttctttacaatctctgctgctgttatgggatttaaataccataatgtatgtcaaaaggacaaaataatgttcctatgttttctgcttacagctgcttttatgattgggttttgctcataaacaggtggttataaagttgcaatccttccatgaattcctttatctttcctgtctcctaacctggcttccctggtgtgtcattgaacacaagtgttgagattcctagcatctctgaggtgatctcagatcctagacagtgtcccttgaatatgctgcaataaaaatgaaaccacttatggtcagcagaagtaggtagatgaatttagttaattctcaaagtctcccttgctacttcagacctctgtggtttgccttcccactgcgtcctgcaccttctctctattttctacctttgcttaatccctactttttcaattttatctcagtgaaacactgtgcctagtttcttctcaccattttggtctccagctcatagcatgttgtgaagactattgcatgcggacttgaatttatgtgctgttgatacttgggtacttgtctctgatgttacaagttaatccatacagtgcacatgtggtccctcactgttgctcaaggcagctggaaaataggtaaggtaatctttttctttcagcacaccttccgtctctgcagctcttacctctacctgaaaggtaggtataaagagaattatggccaatgaaactccatatgagagccctcccctcctccccagagtatatcttgcttaaacaacacatttacggttaatgaccatctggtaaaggtgacagcctttagtcctcctaattcttaactgtctgaaaaaatgtgcccaacctgccacggcttgtgactgaattataaaccatgaagcataataaagtcattaagtttcaacatgtcaaaatggactcaaattgcatcttgcccagaatttgatggcctttccccagcacttaagagagcagggctgtgtactgttcaaaaagcactttgtcatttctcgaagtactcttagctttgtgtggctgtctggacacaagcatcagcatctccaggagaaggaggaaatcgagtgaagtgagagcatggaggggccagtatgccacttcctagggaaaggcaaaggcatttcttctcaggaaaagagcagagaatgatgctgtacctcatttggttattgctcaccctcctgaatatatgattcattttacagtgggaaaattttggataaaagcttgtgctttacaattccgattacccttccccttttatcccccactatcaaaaataatcatattctataaacgtcagtggaaagtggtgagagtgcaactacgttttggagaaccaggtgtcagctctgtcagatttctatgaataggcacatctatatacactttttcaaagaaagaaaggtcactcgccaccctacttgtaaaactgtcagaggatttaggaaagaactaagttaggctgtcttttcacatgggaaaggaaatctggttctcaagatatttggggcattgcagtgaataagggatattaatagaattccacccccggcctctggctaagaacttatctgcctagaatctgaggaggaaaggaatctaagagttacccaaggctcagtctcactgcaataggaggggataacactgaacatggtggggcagatgtgggctttggtatctgttgctagtttatcctcccttcacccaccagcgcagtactgccatttcttctttcccctggaattctctatgtttagtgagcgagtttaagaatggaggatgctcagggatcttcttctcttatatagagactgggataatttgagtgttccatgttctgacacaggtggcatggatgaaggggtgtcactgaagaagctttggcaaaagctgatttacctttccaaaggctctgtgtcaggtgctggataaccgttaaaagaaaggaaagcaagccctctggcggctggcatgcagaaatgcacctgctaagccaatgagccattacaggccgtgccttcagattagagaaggacatgtcaaattagttggagagttttagaatactttatttattccagcttgtacatgaagttatcgatgcatctgctactccaagcatgttcagatgaaataatagaagaaagtctttaaggtattaaggttcatcttctgaaattgttcaacacttcttaaactgcagcaggcccagttgggcactgatagcaacttaagttgtcattactttgtgggattcagatctcgagaatatttatttagtgagagggagccagcaatttgtttctgtaggcaaaaggagattacagaagagagaccccctttgttgctgaattgagtagctgggaggagttgctggaagtgatgaatttaccccaagccatgaaggatgggtaagattagaacagataaaggaaatgaaagtgaacgtttgaaatataggggccacgggagcaggagtgggtttgtttttgaagtcagtagcaagcaagagttgagagtcagtggtaagtaattatgcacagagaaaacttggcaaatagataagaaaaaatcacattaatatttaaagtggtttaatatcaattgaatcacaaggacatcttaggtattcattatgaagctagagacagtatagcctctggacttaaggagtgggtctgtattcaaatcgtagttctgacacttctgagagtcctcaggcaagttagttagcttctctttgaccatttttcccaatctgttcacttgggatgagaagataatgtatctttagactcagatacacaaacattatctaaatccaggatgtagaagttgagtgcaaggaaagtctcagttgtccccaggctgcatatcattcaactggtgagtttccagctgctggtgtgcacaaacagaagctgaaggaccaatggcaggagaattacaaggcaagtttatgaatcagatggatatttggaccagatgacacccaggggccctccaacctagaggtctggtagttctaaaaattccatgatgtcccacaagagctaactgagatgtggggataataatgacataagtttacatcttacgctaaaaatgttgtttaaatttagttcaaaatgttctgttctatgtgaaaaaaatactatcattttatttaatgcaacctatcactgaaatgactatctcaagctgtttctctctatctcgtggagggaaggagtggaattgggggtagggtgcagggtggaaagaaaggagaggtaatactgttacccagagccaacatgttgctcttcaaaggggcttcagaaaatagaacaaagattccagcctgaatgagaaaggaggtggagagtttgaggaacacaaagctttaagtggaatttaccccatctaattatttgcgaaggaaagggtggaaagaaatgttgacagcaaagatttcatggagaacaggaacaataagaccctgtgccagagcactgtattctttgatgtaccacatatggagaagggatatagaacttgagttcagcaaggtttaaaaggcaaaatgtaatcacttccctttaattaactcaaacaatgcacggcaggttatgttaatgtgcctgtagctgagatagaggcagtaggctgccactaatacctgagagagagacagagagagagagaggaagagggagagaaagagaaagagaaagagagaggctcctgtaatgccagagcaggaagggcctagaaaccttatagactaattttacagatgcgagaacaagcctagcaaaattacagaactcacccaaggttatatggtctctcagtgacaaagtgaccataatacctcaggcctttaccaagttagtattctctctaagacactgcatgacggagtccatagtgatttcaagttagcccaggggttaaaactaaccatagtacatttgaatacggattaacatttggtgtgtcctttgaacaaaaggttaaatagaaaggtaaaatgtagaaaggtatctacacgtattcacttcagtcaagctttacttttaaagttgctttagaatattcttattaaaaccagtggtgattttcatgcagctgttttaattaaaatgttgtatgttttttataaacaaagtgatgaaaatttctggttatagccttgtagaagactgagcagggaaaccatcagaattgcaagtggagcaaaaatgttataatttagatcatgtgaccgaaataccaccaccgctgggtagaatctgcttaaactgcagctttggatttttcaggggtaaacaaacctcttatgaaaaagaaagccatgcattaaaattataaaggcacatgaaatattacaggaaagaatgagaggaagtaaagaaaactaacattcttctgttttactgctttcagggaagagttttatgaacagtttccaaaagtgttcttaagcggttgtaggttttattttgctttacaatttgacagtattttaagattctgtatttattctctttttgagctgaattatgcaggactaaacagatatcttttgtaaaaccttttatttccctgacagttaggagaaatatgaagtaggaaattctttggtaattgttggaggttggtatagtgcagtagataatgtccctttactgaatttattatcaaaatacacaagtcagagggaaggagatcaaaatatagcttctatttggtgatatactggtaaatgtttaattttcttccttttagaagagaggagactgatttatagtgttgacatatttttacggtataaatactccctccctggtgaaattcaagatgccaatgggatgtcactgaacttgaaattgggcagaggttcatatatttggctcttgcaagccagtgcaaacagtcttgggacagcactgcctgagtgcatcactcgtaaaggctgtgttagagagtgtggcctagatctcatagattagcagacttgttttaatacatcacttcagaatcagtcaaccttcaaccacaggtcttttcttctttggatgcctgtaccggtaaaactttcagcaagaaggagcaaagcaaaaagtgtgcttaccacaggcaggctggcagccaggagagttagtcgtctcccagactctaccaatctgatgaattcacaatctgaatcaagctggggaggccaggcatgtcactcagatggaaggaaacaacgaaagtgagaaataaatgttaactcttagcagcatcagaattcagaatgattcttagaaaaatgttacagggtttgtgtcaacaagaaggtcagaggcagaactgtattttaaatatccaacattttggcatatagctattctagcaaaagcatctttgaggctgtcatgtggcaagaattgtggttatcagaaaaaaaaataggagtttttaggttacacttaaaatataaagaccttaatagacctttattttatagaaagatatggaagaataaatttatattcagttccttcaaattaaattattttttcaactgggtgtaactgaaataaatagggcagccatagtaattttacttaagcaacttcattgcctcagagagcagatgatgaactattttagtgaatatatgaaatgatatctggcaagagaaaaatacttgatcatctcacttccttctagttgatgttcaagagtccctgcatccagatttacagctctttgcttacacatccatcattgttaatatgccaataccctgacgaagcaagcctggtattggctgcatgagtcagtttttcctggtagagagtggtttattattcttgttgctgctgttgtagtattaacatctgacaatttgataattaacaatgattataaattagcttattactataatgacatgagtctaagtggacatttgatatagcttatttttgagtgtaaaaattctggttctaagtcaggtgtctggaagtgttttgttattatcaccgtgctagaagataaaatctgagttctgaatcaacctactttcttattctgttgcctgtgacattgaatctcatgttcatatgttcatgtgttttatgttcatatgtttttacatttgcttccctttgttagaatttctggttaggtgtgacccaaaactcttaagtcaggtggaggagcattttaggactggctctgccatttaacttaaataataagttattaagttattataacttaaataataagttaatgaatctttccaaatctgagctttctcatatataaaataagaatgctaatgcatctacctcctaggcaccagtaaagattaagtggaatcatgtatatagtgtgtaacacattttgtgtgtgtgtggttagtttctttttttttttttgagtttgttttaatttttagctttctcaaataagagaacatgtgaagtttgtctttctgtgcctggcttatttcacttaacataatgacccccagttccatccatattgatgcaaatgacagaatctcattcatttttatggctgaatagtactccattgtatacatgtatcatacggttttttttactattatactttaagttttagggtacacatgcacaacgtgcaggtttgttacatatgtatacatgtgccatgttggtgtgctgcacccattaactcatcatttacatgaggtatatctcctaatgctatccctcacctcttcccctaccccacaacaggccccggtgtgtgatgttccccttcctctgtccaagagttctcattgttcaattcctacctatgagtgagaacatgcggtgtttggttttttgtccttgtgatagtttactgagaatgatatcatacattctttattcattcatctgttgatggacacatagtttgcaggggtacatgtgcaggtttgttgcatagctaaatatgtgttatgggagtttgttgtcagattatttcatcacccaggtattaagcctagtacccattagttatacagtaatttcttaatacatattataacatttgttaattgtataagttaaaaattttattactataatatttgttaattttataaattttgtatgataaaatacgtgtattacattcaatgcatggctacaattagtccacgtttaaggactgactcactttctagaatttggcaatactatgtctctcaaagttttcctaatgaaataagctatttatctttccaacccacagctcttcaggttcacatctatttctttgctttctcactgccctgacttctacccttccctttttgtctccctagtacccaaagtcctcttccccactgcacctgccattcttctccaggtgaaagtctgatttaggaaaagtgtatgagaaactctcataataaagagtgcatttgtattcttaaagcattacagcagagctaaagcctaagagtataatttcaatattcaggctgtgggtaagagaggtatttgctcagccgtagattccttttgatgcctctgaaatcactgtcatatctgtaactatctattgtacagtccatatggcaacctttaattatacctgttggaataatccacttagccaaagtcaagcatcctctgattacgtgttctcttgttatttcctagttgtcatatatccttggcagctgtcatcagccgaatttggtgtttctaatttttagtagctgtcatcctgtcccaagtttctgtaacacatgcttcggccttgccaaacatgatttgctttaacagttagtcataattttttgggccttaccttggcgggctagtggtcacattttactgtaggtgatctttacaagtgacttcagctccctcttctagctttacctttttttttaattgcacaaaattctatgtagcatgtcaatcgataggcaaaaaaagatctgttagcctccattacccaagagtgggccatatttcagtggtaggtaaatttggtccaatagttatgtttgaaatgccaacaatgaataaattaaattaaaatttattgagcacctacagtgttatagttatttgcttgctaatttgattttaagtgtgtgtataagtatatgcatgtgtgtgagtgtgtataatagaggctattcttttcaaggtcatacagctactaagtggaaaagctatgaattaaatgaaaagtttcctggctaagaagtccttgctttgtcctcaaaataggtttttgctaagcctacattagttagaatgggaaatatatatagagatatatgggctgggcacggtggctcacacctgtaatcccagcaatttgggaggccaaggtgggtggatcacgaggtcaagaaatcgagaccatccagggaatattgtcactgaggtggagtaaattaagcgtatataaaaatacaggttgagtaaggttatgatagctactgagtaaggttatgatagctggccaacatggtgaaaccccgtctctactaaaaatacaaaaattagctgagtgtggtggcacacacctgtagtcccagctactcgggaggctggggcaggagaatcacttgaacctgggaggccgaggttgcagtgatccgagatcacgctgctgcactccagcttggggacagagcgagactgcatctcaaaaaaaaaaaaacatacaaaaaaggtatatatgactatagccctttttcttcataaggtttatagtcttcaacgatagagtgacttttatgtttttctaccagaagattcgaagttttgtagagacaaatgtttatgacattattactttggtaaagttcagtaaagcaaacaaacaagatgaaaacctgcctgctgagggttggttaatctcttctgaaaaaggtacactttggtataatgattcataaaaagcatgtggacactttacagctttacatttagaataaaacctgtaatcccaatgcctgttctatgtgttatacctgtgttttcctgaattatatgtctgtgtacctcctctttatacagtgtttcatctaaaagggtggcatttactgctagaatttgagatcatgaaaaggaatgattttagcacaaaaaaaactaaacctgttttctatcaaattctaagaacccagaggcaatgaatgctactgtcaaaaataatttgaagaaagtgtatctgacagtatttttcaaatttagctacaattttggttttactttggggtattgctccagtggagattcgttcatgattgtataccttcctagaatatacagatttttcttattaggcattctaaggagagcttgttactgacattctgcagaactttacagtcatagtatttcatctgtaatattatcttatagaatataaagattttcctgtaaaaatggaagtgtccccaagcctgtgtttctagtcatgtttcaatcactaagtagctttctgacctggtcaagccactttaccatctttctgggtcttctttcctcattggtaccaagaaagggtcagagtatttgaaccttaatgtctcttcttagttccaccatgttgctatgcacaaccctcatccactgcttatgactgctgtgtaaaacactccaacctcagtatgcctacaggcattccacaggaggtctatgaagcttttcacagttgcaaagtcatttttcccctttggaaactggacttcaataccattttggttcaacatgtgttttcttacactgataacaagaatgggggctcctaaaagcatagatgttctttatgacatcaacctcgaaaatgtaaaggatatattcaaaatataactcctctaaagtaagtaaccatttatccaaaaatttagagggtatattcaaaatataactccccaaaaataagtaaccatttataaagtaactaatgtaaatacttctggattctaaaatgtatattgggttcttgggaacttgaaatagcaattattttataaatcctttgtaatagtcaatagcaaagtaagatcattgatgtgtgtttactccttgttgtctcttcttatacgtttttccagaggatgaagttcagtacagtaataaagtaaaattaaaaaaaagctaatgtatttgtagacttctaaagtcttcaaatatttattctgccctgttgagtgtcttatggataggtaatattatctttaaaggtgatgctcaactttcatgctgttttatttgtttttttcttgagacagagtctcagtcattctgttgcccaggccggagtgcaatggtgtgatcttggctttctgcaacctctgcctcccaggttcaagtgattctcctgccttggcctcccgagtagctgggattacaggcgtgtgtcacaatgccaagctaatttttgtatttttgtagaaacatggtttcaccatgttggccaggctggcctcaaactcctcacctcaagtaatctgcctgcctcagcctcccaaagtgctgggattacaggcacgagacaccacacctggcctgtgctgtactatttatttttttatcccatggttacatatgttatgcaatgaaaatgttttcatgctacacatcaagtataaaactcttcaggccagactcctatacagattaagatggcatatatgaattgttttttttttctttctcccaaaggcataggttaggcatatttactgtctttgccaggccttttctcactttttaagacatccgaatgtgtagatttccttccttttcaacatttacattggaagatgaacatatttagaatgagccaaaagaaaaaatgctgcataaagcagtgttgaaggaagttattctggcagtcttagggttgaaattcgcaatccattacaagcatggaagctgtagagccttggatgaggctctacaaggattgggatttgtagaaatttgatgcgtccaaactctgtaattaccttaaagaaatccaagctttctgcaattaaaaatgtgtaattaaaaagtcatccagtgtgtgtgtgtttgtgtgtgcgtgtaatttatatccataaatatgcatctactatgtgaaacatctcttaagggatatgaatgtatgctgaaataattcagctagtgtaaagagggaaggaaaaaataatttatattactgggggaaggcagtcagatgaatataaatggggaagcaccatccccagcagagataataggttgagaaggagctataaatagggaaaatctgggtgtgtatggaaaaagtgacttcaacatatgattaattagaggtggtggggaaaacaatcaaagaaatatcaatgtgtagtaagtaaaaaatgtggaagggtggtgggtagaggagcaaagtatagtggaggttactgaatgcacagaaaaataattaaactcttaggttatacccttatccaagattctgaattagtttcttctactcagcttttccggggatggttagggcttctacagataggaagtagaatgctgtgaaaagaaggtacacttacgaaggaaagtttctgaaaataaaccagaaaactaatttgctaggggagttccctagtggcagagagtttacaccatgtgttgccctttctctctgcacttccaggaattccatctgcagaaggtgagtgacaggccggtggtgctggtaaagtctgtgctgaggcagtaggagagctgatgtcaatgacaaggcaacccttgactgcagccctgacacctgtctggggaatttagactttagtgacaatccttgacctgccatgcaaatctggagctataccattgaattattgcccgtgattgggtgtggaaatggagagctttgtgggccaggaagcaggcagtttgtaatgtgtggatttttagcccggcaagctagatgttctaccttcactagagtaattttaattcattctcttctgaagaaagaggtaaagatgaaggttgtctagggaggaggaatctcaatatttttcttcattaggacagttataatgttgagaccaaaaagatgtaagtaaaggtaattaacaaagggcaatctacttcctttggagcttataaattcctcaactacttagaaatgctactctgtctcaccctgacatttgatctttgtacttcagataggatttgacgtacgtttaagttctcagtggactcaggtttccggaggacttttttgttaactgctgattgaacctttattctgctccacatgattcctttgccagcttgtttgaagtgtttgttcctggtggaaccacaacaaatatgtgagctcattttctttctattaggtaaggtctttagagtttgggatttcaagtattcagtgtttcatgccttcagtgttcttttagaaatctgtatgtattcctacatttttcacaggcagtaatccagagaatctgatatggtttggctgtatcccccacccaaatctcacctcaaattgtaatccctgttatccctatgtgtcaagggcaggaccaggtggaggtaattaaatcacaggggggcggtttcccccatgctgttctcatcatagtgagttctcacaaaatctgatggttttataagtgtctggcatttcccctgtttgcaatcactttattctgccaccccatgaataaggtgcctgcttctcttttgccttccaccatgattgtaagtttcctgaggcctccccagccttgaggaactatgagtcaattaaacctctctcctttgtaaattacccagtcttgggtactccttcatagcggtgtgagaatggaccaacactggatcaaatctggcttatgtaaatctggaataaagagtaataaaaccaaccagatgctaataatatgacgccacctcttttctcccatccaagatgtgattctctagattttccagtctgatgatgttgtggagctcgcagttgacctgtatcttcttgatataagttccatgtggttgagcttggcgtttataacagaacagcaaaaaatgggatccctttcatcagaattcccctctttgcccccacactttgtagcaattccctgtttgccactttcaactctttgttgatctaattattggtatgtctacccaagaaaatcttaagcttatttggggactgtggtcttgttatatatatcatctcccgagatactagaatagcttaagtacccaattattattcagtaagtgcctgtttactgttggactttcttgaaaattcatatagaataccttcattttcttcacactttggtctgtaaacagtgtggaagtagtgaagaagacacaaagtcactttagacatgtttattactctcacttttatcctctcccctccatcagtgaagactcctacttgccatctttcctctaaagatccttagtccctgagaagcaagagctactgaagattatatcctaataagtttctaaaactcaaaagttttggtaggaaagaacatgtaggcttaattcctttctctttgacagtttggcccaattggatgctcaggtgtaatatgctattattagccctgagatgaaaatttcagggccaaaattattagtaaaacacttaacatttattaaatttttacagagtatttaatgtgtaaatatttactgcactgggtaccttatatgcattgttacatttaattctcattataatgatttattagctattacataggtatttttactatcatccttatctatacggagagtgaggcttgatgggatcaagtaatttgccagtgtctactagctcttagatagtaaattcagcattcaagttcatgcttaaattctaccctctatgccctccatcttatataaaccttaactccaggaaaaacttacctgtcttgtactaactgtcatatatttggtaggagaggcaaggagacatttttctaatcacattctttcagtatgtgttgggataaatttcaggggttggaatttccatcaagtgcacatgtacacctcttagaattgtcactttaggttatgacaactaggatgcattttttaaataaaagaagtgtattttgtatatgtattatatactgtattcttacaataaagtgagctaaagaaaagaaaatgttattaagaaaatattaggaaatattaagaaaatgttattaagaaagagaaaatatatttactattattacctgaaagtggatcatcataaaggtcttcatcatcattgtcttcatgttgagcaggttgaggaggaggaagagagaagttagtcttgctgtctcaggcatggcagaggtggaagatatggaggaggtggaaggagaggcgaaggaggcagtatattcagtgtgagctttattgaaaaaaatacacatatgagtggacctacacagctcaaatgcatgttattcaggggtcgactgtaccttgataataacatcactgccattaccgtattctgagttggtggtataaatggcatttttctaggtgatcgttatatatgtgtatcatgtatattaccaggtatagtcctgtaatagttccacctttctgcataaaagtcttcacaaagctaaactgagagttatagtaactgtaattatggaaggtaatcacaacaggaaatatgttatatgaaatacaacttttacaagttgttttacagtttgtgttatatgaaataacaattataggctttgttattctgaacattaatttgcattagccaaacaggagattcattttaggaatatttgtatctgtctactctttctattatctatatataccaataaacattgacaaacatttaagcattagaatttttgtctcaattgaatgaagctttcaaagatgctttttcttttttcttggaatcctgttgaatttccttgaaaaataaataagagttcacaccttctcagagtttcctctgaggtgttttgatactgttaacatgagcatcaaagtaataccaactcttaaaacacacataattacttaactatcagtgtatttctaagaaccctgtcatatgcacccttcttattttatgctcatgttgtaaatagacatacatgatgctgtgctgtcatagagaaaccatccatgttcactgcttaaagaagtgagtgtgagtttgagtgtgagtctgtgatgtatgtttagtctgtaataacaattctattaattcaatactgttttaaacatgcactcacatcctgtcatcagtaaaaccaagtgtcagttatccacacaattaatcaagttctcactcaggctttctagtaattcaactagtttcccatttccttatttcttctaggtgacatagttgcttctccatctgtaaagccagtataggatattttaattatttagttagcaatgtttttattaggcactcttttaggcactgacgatattaaagtgaacaagacagataagtccctgtttccatgtgaactagagtttacattccagttgtactagtaaacaactaaaacctctacataaggcagtttaatattgaagaatgtcctgaggaatatgaatcagaacaatgtggtagtggtgtggtatacacatactatttacttagggagacctttctagttggtgacttgaacttacacatgaatgagaagtagctagtcacaagaatatctataacaagattgttataaatagcaaagatagatagatagatagatagataaatagatagatagatggaaaaagccctaaagtatgaatgagcttggcagatttgaaaaatagattgactagtagagagtggatatttgcgaagatttattactaatgatagatctttaaatatccacatagctttaagggagcagtaaatttagcttaaggttagtaaaatgttcagtaccagcaggatatccctataagattttttaggattacagaacttggataaatggtaaattggatcaacatcatgccaattaaatttgttgtatggtctgttttattaaatctctaattcgtatttatataatgtataattataacttgctgcttatacagaatggttacccgtttagtattttatctgttcaacaaccatttactaatgtcctatcatatgcaagatagagtactaggggctgagtatacaaaaataaataagaccactctgtcatgaaaacatgtacaaaaaagtagataacacaggatttaaatatatttagtgggaaatatgttttctcagtttaaacatataaaaattataaagtggaatttcagatgagagtggcattgatagatataagtaggcatagctgatgcagagaatgttaaaatataattttgcaggtctgaaaaaccatttgacatttccttgtaattctggattaatgcttatatgattatctctgccacagtggaaaagtttataaatttaaattaatggaaattgctgttgatgaaaccctctagaggataatacatttctgatatgcctatagggctccgtatttaagctaaactcctgcccaagatgcaggatgatgaagtcctttatttcggccatcagacctattaaaaccacgagtatccctgtgagtccacaagtcaggctacaatacaacatcctcaatctgacaagaaaatcaactgatttactgaatttatatgaaccaattcttatatgcatgacagccaaaaaagttccaaaaagaaaacaaattttgcattagtatgagattttgaggttaggagcctacgtttagaggtttatcagttcagcccccgtatggagctatccagggtgctgaacgtgctctgcaactcagtccccttagtctctgggcttgacctattttttccattgttgtttcttatcttcaccttttattccctacccatactgcctgctctgattgctctttgtatgatctcatcaatcatatgtgacagatttttgtcccgacccttgctatgccctacattctaacctagtacattcttcaacccatgtttagccaaatttcaattaaaatttatacctacagccttcccaacaagtgccttgactctcaattttgtttcttgaagcaatgagatcattgatttgatctctaattataaagtaattaaaaacaattttatttcagtccacaaatacataaatattctaaaaaggagcctttaattcatttaataatccataaaaataaactgaaaaatcaagcgtggacttctttgtcactttcctctttttcattgtgaccttctctctcctcccacttctccttcctcctcatcatcattataaattcaatgagtcagaatggtttaattgaaattcttcatttaaaaagtaggatcttggtaaaatgtaggttcaaagacaattttacaatagtttaaccttagtagatgaaaaatagtaaaagtataaacaactcctgtgaacatattgtctttgaaattggtaaaataaataaaattgagatcacttcttactgtacatctccagcttattttaggatgtatctcttcctttctgactggaagactcaaaatacatttagagagttggagctggtgttgacagtcaatgattagggcaaaagttttgcatgtacttcacctctgtatttctccctaatttcatccattgtaatttaagaagaaggacatgcctgaattgaaaagttcaacaagtgaacttttgaataaacagtgtagatttttatcttaggtccaccaatccctaaccatgtaatcttgggtaaatctttaactctatggatctatattttttaaatttgcaaattgagaataataaaacatcctcacactgaagattcctgccagaattatatgagataatgcatatccaaagtttagggcagaaactgaaacctagccaacattttaaaaatgtgaattattgtcattaacttatcctttcggtgcttcacctctccatacattttaagatactctggtcattatgagtacttgccacaagtatataggagataaaagatttattttcccacccattattaggttcatagctgaggtatcctgtaataagagacagattaacaggaaaaaaagcatacaaattaatataatttttatgtgacattggagcctttgaagggaagacccaaagaaacagggaatcctgtgtattttagactttggtttcataaagagtggacagtcttggggaagtatggctggacaaaagtgggcatggcctgatggtaataagctgggggaaacttagcaaggcctattgttcagattcttcctggtgtctctgtgtgttcagctgctttcctctagttctagagagaatacctctgaatgaaggtctttatgatttgctttagatgaaagtcagaggattattttatggtctgcttcaggggagaagagtgagagaaagtcaaagagatctttctgcttctgctgctttctcaaatgccaagttgctgtattttggggtagtatgtcctgaaccccatcaggtacttgacatttcatgaaggtaagctgatcaatctttcatccatggcactcattaatgtctcaatttgaaatgttgtgagctatgaaaaaaagacaaggaaggtagtgcttatctactcatgaacaaccattattaactcactattaatcattgattacaattgatctattggccatggtattgttgtgaactttgaaatatattgtattaacatttctatgaaaatggtggttgaaattctgcaggcagataatgcagtgttaacataataagtaaaataattaatgatagtgaagttgtaaaagtaagaaggttcaatgtgcttgaaagtcacagaattttgaaaaatgcaagagataaggaaaactgatgaacaaaatgtgacaacttgagactggctatgcatactgaaatgaaccagtgacttttaaactagaattcttagagtgtacagcctacagaaatgtaaatatggctaatacaggtaactttctaatttaaatacctatcaaagcttctgttggaagaaaactagatttatacattgtgacatgctcaaaatccttgtcttctccaacaccatctccagtaaaatactcctagcataaaatttattaaagtgaatatctctgaaattaggttcttttggaattaaacaaaagagaccatggttttccaggcattgttgtagatgtcactttataataagacagataaggcagtcagtatacagaggtttggttttatggccagaactaacatttattcaatcaatgagagagatcaattagagcagcattacttctacagtgggaaaatttcagagcccctgaaatagaacattattgttaaattatcaaatatgttacagttgttgctagtataatgaccctttctctttatcagaatcagggaagaaaaaagccaaatggtgactaatttatcaccaggttcataactaagttaccaaaagactgaaactaatcaggtctgattttcaaaataagcaataacatttaaagcatatttgaatatacagatgtttggatcactgatatcctaagaattctatagtctctgctgattttaaagtcgagattagattgttcttgtatacccagagaagcatagctctaaagggaaggtgttctggggaaagaaaagaaaaaaatgacgttttcatcatcacactgaaaaagtgccaacaaatcctaagtaattttgtgttgattatactaaattagaatagtgatggctataatcatttgatccctgaggcattaatgaaaaatcagcattattttgtgtggaatatgtattattatccttgagcttaggaatgattattagtaagtctgattaaatctggaagcagtgacacaagctatctttaacccaccaatgacagggctatattgtaaatttatgatgaatgaacacagtttagcatttttagcacttgttggggaaaataagaagtctgcattcattttcttgattagactgcaaagtagtacagagaagctcataaaaaattcttcataatgaaatagtgttcctactgatagattaacctatcatagcttccaaaattcacaggactggttatccttgtatgatcaaagatattattcagcaacattctggagatcatgaattcctagatacagaagtataaacaataaaaatactaccatgttgcatgcatgtattaccttcatctttttttttttttttttttttgagatggagtcttgctttgttgcccaggctggagtacagtggcacggtctcggctcgttgtaacctccgcctcccaggttcaagcgattctcctgcttcagcctcccaagcagctgagactacaggcacacaccaccatgcccggctaattttttgtatttttagtagagatggggtttcaccatgttggccaggatggtctcgatctcttgaccttgtgatccacctgcctcagcctctcaaagtcctgggattacaggcgtgggccaccgcacctggcagtattacccttatatttttaaatgctttcacatttactttatggtattcttatcatagtaacttaagtgagttagactttttaccacctgctctatcagtaagaaaactgtagcacaatccagtggaggtatttgctaaaatcacacaggttgtcagaaataccagtattggaaccccagggtcttggtttcaagtctaatatattttctgggcctcagtttagccattaattttataattacagacaatgtttttgctaacatcttgaattctttctttttaaaaagatgtctattctgtattcatagaaaatattagagattcttactgatcaaatggatcacagcaattgtttaattttaattttcagtgctaggtaatggagctcagaacacactgactcaaaatttggcatttgaggaatcagcagaaggaggccgtagaaacttgaaaggaatctacttgccccttcttccctgaagcagtcatgaaagctaactgaattttcccagaaaataggtcataagactattatatcagaggcgttcttcctgtacctggaggaaaagaatgtccttatctctgaaaacatagggacactgaaaagaatctgaacaagtaggccttgccgtgttacccccagtttattaacattagattgtactcttttgtcctccaattatacttccatgcacgactgtccactctttatcaaacctaagcataaaaatacccagatttccctgtgtcttcgggccttcatttctgaaggctcctgtgtataagttttatataaataaatatatgcttctttatgaatgaatataaattttacttaatataaatttatgtaaatttaatatttttataattataaaattacaaaaatgattgtaattttaaatcatatataaatttattataaatttatatataaattttaatataaaatatacttaattttacttaatataaatttacttaatataaattattaagtaaatttgttttctcttataaatctgtctttattacaggagccttatccaggaaccttgtgatgtatgagtaatctttctcccctgtataggcaaaattgtttctaaaatccccatataatttagggcaagttctgatccttgcatagtagcatctgacactcagtagtaacttgattaaatattagttccttttttcctaattcccaccccaaatgctgtgaccctctctgcactcaaaagacaaaatctttaaaattcttagttgatctgaaatttgtgttgatggcctacattattttattgttaaaactatgattacaggtgactagtcagtaacaaaacataaaaattgtgaaagtacagccaaaccctgttttaaatgctagatggagttagtgttttgtttccatcaaagccacaatatttctacttgaaacataggccagggcagtggctcacgtctgtaatctcagcactttgggaggccgaggtgggtggatcacctgaggtcaggagtttgagaccagcctgaccaacatggagaaaccccatctctactaaaaatacaaaaaattagccaggcatgttggtgcatgcctgtaatcccagctactcaggagcctaaggcaggagaatcacttgaacctgggaggaggaggttgtggtgagccgagattgcaccattgcactccagccagggcaaaaaaagcgaaactccatctcaaaaaaataaaataaaataaaataaaataaaaaagaaacatagctttgcaactgaatggcatcccattcacttagcatcataatggaattctgttgaatagcttaaatttagggcaatcagagccaaagactcagttacggagtaactgtaggtcccgcttggcatgtgacagattagattccttggagaagttaaatccagaaatgagtcattttaataaagcaaaacacataatataaagggtatggataagaagctatgaaaatgcctaggatagacaaaaagaaagatatcctgggatagggaaagggacatttgaacatcaaattaagcaaagccatgaagtttggaatttttcttggcattttcttcccgtaccctgcaaatattaaatcaattgtcaatcaattgtcaattttacctttaaccatttctcttcttcatgtctttctccacacgatcactgatctagggtgagctcttactatctttacttataataggctagtttattcgctatttctatttccaggcatatcactctcaaaaccatcatccagattatttaaaaccttaaatctaatcacatctcccacttgcttgaaaccattcaaagtcttctagttgcctacaagataagatctaaacttatgtttctctgtggtctggcttctccttacctgtgccacctcctctcatgatgagccattctgtgatggtgcttcagcctgtaaaattgtttgtggtttcaaaaatattgcacttcatttcatgcctccataccttttcctcttcttgtaatgccttttcatattcatctccaacagggtaagttctgcacataattcagtgtcccttttccagtttgatgttgcagctcttccttcatctcaaatatccactggattaggtacatctgtgtgtacttcatcttatccatcctgttaaagaaaaaattatagaaggacaattgttaaagcatggtagggaaagttttatttaggaccatcatgataaatatatgggccactgcaatggaattgtttgcagtgtaggagagagaatgggctcaactctgtatatagcatgaacaagtgagaatttttaaccaaggaacagagtagaggtcagcagacagacaatgactaagaggtaacatcaggagtaatgggaattctggctaaactgacctaacagaattcttgctgaagacaaaccaatgtgatcaggtatcacctgggagttggtggagaatgaagaacttaatcaggtatcaagagtaatcagatatctaaagtggggcagttcttactaaactgacttagcacacttcttgctaaaaccagattttacaaggaagtgcacagatgagcctaggagaaggtagaggggtctgactaaagttttgatcaagtaaaaaagtctttatcaatcttggtatttcccgttaagcacaatgcttggaacataatagttgctcaacaaatgttggctgatctgattataagaataacatggatagatcatcctttgtaatctataagttttttaaaagtttatttttaattattatgaatacattccagttgtacatatttatggggtatatgtgatattttgatacaaacctgccatgtgtaatgatcaaatcagggtaattggggtatccatcacctcaagcatttatcattttttttgtgttaggaacattatacttctgctcttttagttattttgaaatatacaaataaattattgttaactgttattaccctgtaggtgttactgaacgctagatcttattccttctatctaactgtgttttcgtgccttttaacaatccccctttttatgttcccctcccccactacccatcccagtctctggtagccatcattctactctccatctccatgagttcaatattatttttagctcccacatattattgagagtatgcaatatttgtatttctgtgcctggcttacttcttaacataatgtgcttcattccattatttcttaacataatatgctttaattccatctacgttgttccaaatgacaggatttcagtttcttagtagctgaataatatttcattttgtatatgtactttattttctttatccattcatctactgatggattcttgggttgatttcatatcttgtctattgtaaatagtgctgtaataaacatgggagtgcagatatctctttgatatactgatttcctttcttttggatatatacccagaagtggcattactagatcatatggtagttctatttttagttttctgaggaatactccgtgctgttctctatagtggctgtactaatttattcccaccagcacactagagttcctctttttccgtatcctcatcagcattcattattgcctgtcttttggataaaagccattttaactggggtgagatgacgtcttatcgtagttttgatttgcatttctctgatgacaatctacaagttaatatgtctgaaaatctctcagtcatcctatcatgtttctactcttcaatgggaaaaattaatttatcaagccagattgtcatcttttcttaaaaaattacatgatatgaaattcacagctttcctattcaagtgagtttttcttatgtccagctagaatcccctttgggttaatataagtctttagtgtacgaatttgaatctttgcctgaggtgctacactgttggttctcttaaaaatttgtggcattatttaattcagtaaaatttgtgtggattgatttgtatcctttgaatagttagtattatataaatatctcagtctataagactcatccaaaactttggaattggaagtccaatctcctctccattagaagtcttgtcttggacatccagtctctatttaatccaatgatatgctccctgatttatctactcagactttttattgttagttaggtttattctttattttaaactgagatccgtcatcacaaaagccattcccatttacctgttgtcctttggctgtattgccctggttatatattactgggttttgctaaatgtttcctatcttttctttcaagttaaatctttatgtctctgttagattatcacatataaatgtgtaaaaacatagatattcctgcaaagcttacaaggaaacaataaaacagaaaagacttgatctaactcctccccacctcaatccagagctattactttcactcttttagttgtttcttctgattttacttccatatttccaaacaatgtggttatggtgctatttttattttgatgtctttacattcaatacatcaatgttgattttaggttttattttataaatatcctcaattttatcttccaattcttttgttgaataaatctttgctaataaatatgtatatacatatatttattatatatgtatatatatttacatataaataaatatatatacatattttaatatatatattttattttctaagggctttatgttgtattatttcttattttgatagcattcagattgcagtttttaaaagatacaaatcatttcttttatcatattaatgatgaggcttttaaaatcagttttctattctctgcattgtatctcttttttattccattttctttctttcttttctcctatgtaccttagtctcttgtttcatatttctattagagcctatcctacattgtctagttaatcttggctgtttgttgtcacttaataataaaactctaacaaaccattagaaactgtataattatagcaattttcaaaattattattagtgggtgaaattcactaaatctaaataggtggggatctacccattttattaagagaccaccctccaaaatgtcagatcttttctctcaagtcatttttttttagtaattcagtttctgaagtcttagttttctctctgtgcgttttctgcatttaggtggatagcatcttcataacagaggagaaaagggagtctgttaggcagattggtctcaggggtcagtatataaatttacacataatcctactatttttcttataacttcgcactgctgtcacagcctgagcctcttcaagtcagattccaatgctcttcttaaacagattctctgagtgtgtttgctgatttttgctgcagtggagagggtatttctcagttgatgtgatccttatataggcttttagtcactccatctgttttcagccccactgctggctctgccttcagaaatatgtgatgcctccaagttctctaactttatagggttctacagcaaaatatccttgtttactactggcttctttctctgtaaaaacttagctttccacttttttctgtcctactgtcaattaccacacatctatacacttttcatcttccaaatcttgttgacatttctcctctgctattgtcttttcatccagtctcttttgctactgcgaactatacagcctttatttttttcacaaccattttagtaggattttgaaagaaaatacagatagaaagcttgtgtttagtccaccatacttagtgagaagttgccataacatttttgaagattgaatgtacagtatggaatatgttcattatctcagtaccatgtttgggctcataaaaataaaaatagcagacatgagtgtggcctttattcatttgttcaacaggcttttactgcttgcctatcatgggaatggcaagaaacatcatttcagttaactgaaaggacaaatacaatattcttagtgatctccttccttcagttccccacaggaaatttgaggttgataaaacagcagcaaaagcatatttttagaagataaagagatggttcgtatgatgtacagaagtctacttgctactcaaagtgtgatcagtggtctagcagcatgcatccctgggagcttattggaagtacagattcttagtctcctctctgacctactggaacacaatctacgttttaatgaggtccccagggtagtcttaaaattggtccaagggaaaggattttattagaaaaaaagtgaaccttcttttatcccacctagggttaatgcataggaattttatctgtagtcaagatcataggcaccatgtgaagtgattttcttttctttctttttttttttttttgagacaatgtctcactgtgacccaggctgaagtgcagtggcacgatctcagctcactgcaacctctgcctcccaggttcaagtggttctcctgcctcagcctcgtgagtagctgggattacaggaatgcaccaccatgtccggctaatttttgtatttttagtagagataggatatcaccatgttggccaggctggtcttgaactcttgacctcaagtgatccacttgccttggactcccgaagttctgggattacaggcgtgagccactgtgcctggcatgaagtgattttcaaacatagttgatcataagaaccttgaaggggattatttgtttaaatgtagattcttctttcttttacattgtcgtaagtaatgtaatcaatgtggaatagggctgtaaacctattttaagggcttctgagatgctaatcagtcagatttgggaactatcagggaaaattttcaacccttttcatcatgatgtctcagggaccaaatatcttccatttgctacccaccacttcctgcaactcctaccagccatcactacagatgtatcatatcagatcctattttcttcatctttgccttctcctcaaatcatgtatagtcttgagactcatctgttcagttggcagagtgtcttccttctcccaagacaacatcctcgttttcatttttcccattcactctgtgccactgcttacctccatgcccaaatctccagctctctctttgctggcaggtgtcatgttctgacactgatttggggtcaagtctggggttctgaatcaggagcctgtgtttgatggggagtagatgccagaaggcattgacaagtggcaccatgcaggcgaataatgcaagaagagtcaccttgtgggaaaattgatgcctgataatctgtcccaccagggtgtcaagtccgagagtgagaatccatcaattaaactgtgggacggactttagagaggacagacttgagcacaggggtgtggagaattggttatggaagaaattcccaagcgaaatgaatatagttggaggaaatgtgaagagggtggggagtttcctgggcctctgctggaagagcagaatgtaagagttgagaatgttaaaccagcttgcataacgttttgctgaacagtttaattcagaagccaattgagatatctgttattcctgacaaactttaaaaggttctagaactggcaaaacaactaggtctgagcaaagtgaaaagacatagtgtgaccagctgggacaggaacgctgcaaacttgctaattagtctggaggaagccaattgcccacatttttatgtactgctaattactaaagtagcagcttgctataaagacaaaaataacagcatgatagtttcttgaatataggataaagtggcctttgggatgtaggctccatcaactttaaaaatattctgtagtttttaaacttaaagcatacagtgccgtaataaaaatacactttggaagtcagttattcacttttttccataggctgttagatgagaaattatagaatatatggtaccctgttgggaatttatactaaaggattttgttttaaagataccaactctccatttgaataccatttctcagctcattttaaacatttacccaattaaaaaagctaaataagtgattttaaaatgtgttttattttaaatacacagtgtttttttctgaaaatgctttctcaacccagttatatctgtgaaaagagaatgtcctttaggaatttaccaacttttcacgcagttgtagcattcattgtgggtgttcagtaaatatttgcagaaagaatgagtgaatgagcaaaggaataaatacacaaaaccttgtgtgcatgagaacgataggatttcacacttctaaggaacaactgagaacaactactccccttgtattcttttgaggatgaggaaatttaggcagaggacaagtaactcctctggggcctcacagctggttaggggcaaaactgggtctgggccccatttcttatgtctatcagcccagcagtcttttcattttaagcttatttgtattccctttaagagaataatgagttatttctgcagggctaattctgacctgaatcatattaaatcagcaaagcctggttttcttacactttcaaatgcagaatgacaaaagtaaagcatcttttaaaacaaaacaaagccaaagcaattggagtatttggttttattgaggagtgatgttttcaaaggcagagaagggagaaaaatggaaactctgtgccatggacttaacttgaaagctaaatgtcagacttgatgtaaaggaggaaaaccagccctgaggacctataactgcataaaagaaaaaaagcagatttctattgattgcagcaaatcaatagaagttcatgtatttgcggatttatttattgcttgcattggtcactgaaacctctaattagattcatagtgtacttagtgtattgtaattatatgtggcagagcacgtttgatgaaggtggatataagtagatgaatatttagacccagcaataccactaatgactcacatgccaggtaacatttctttacttgtaggacttattaagaagtggctgtgaattgtcttcttaattaaaggtttggttacatgaccaaagagttgttaataatggtgcagtcacttatcaaatgtgtgatcccacctaacttatttataattctgaacctagtgtttctcatatgtacagataggttcctaatgacacttaccacatggggttgttgtgaggattaaataagagcatgcaagtaaggttttacatagtgcattccacataaaaagcactcaataaatgttagctattattactgttttcagtcactccaggcgagctatattgtaaaaaaccatacttccattgcttcttcactagagcctagcaaatcattgttttctactggtctactatttgtggatatttctaccccaagatcctttcccaagaggacaatgcaatatagttgaaagattcttcttcacttggtgttcagaatatttcattcaaattcaacattcacaagtgcaatttgtactcgatattgtagactttccagaaaggtgaggttcattcattcaattgcttcttggctgagcaaatttatattctcttaaatcttgataagtcagttaatcttctctaaaattgaggaagttatactcattccactggggtgctatgaggatcggatgaaggtatatagcaaaagtgcttatttgtaaacatcatgttgttgaatgaatattggttattgatattttctgaaggtccccattccatgcctttttcagggccccgtgtaaagccatcccttctctgaagctttccctgacttctctaccttccatctagatgtcaactctcctccttttcactctcactccatttcagttgatcttccttggaattcaaaatacatactgccttgtagagcagtgatttgtatttatttcattccttcttctacactttcagaaggaagtgtctacatctcattgacctcattgtcccacacagtgcataacacagtatcttgcctgtaataatgctcaacaaatatttgattaatgaatagacaggcttttatgaatccatgtgtaatgttaagttctatgaattatgtagaaatagtaaaagcaaataaagactcaattacaattttaactcttcaacaagatgatcaaatccttgaggattagaaattaattaaaaatgaactcatcctttattcattcatcccattatttaataaataaacataaatcgagcaccttccaggtgccagatactatgttggattcgaggaatttaatgcaattaaaataaatagtttcatcccatagaggttgcagtttgtaagtaataagaaataaggaaataattccaaacttgcttttgcaggatgaatatttagaactttctttattaaaagaggtcagtaaaacattcttaactgctttttctatccattattaattccaataatttggtcactgttcattagtgagattaaatttggctactgagagtaggtcatgcaaatcatctttctggttaaaaaaaggcctgtagctactgggtgaaatttgctttgaattatttttcataatcacaagtaattgggcatgtcgtactcagttataaataaatatacaaaagtacactgatctactttccttaataatgagtttgaaaaccatcgctatgttacttaaacttacttttcttcactatttaaaaagtccagagggcacaagtaaccttcagagaatctttccacattacaaggcaaaattatttaataaaatttctgaacatacattttaattgaaaagtcataagcaattctacactgatggggaaccagccaatgtgatgcaaaatgaatttctcagtaactgttttgtgtgtaggtaattttaagtgaaagaaattttttttctattgtacaaaccaagactaatttattcattgttgttccaaagcagcagaagccaccagaatgtcacattttatttttaattcacaaaattaaatatacttatggtgtacaatattgagttttgaaatatgtatacactagaatagtggactcaagctaacatatgtattacctcaaatactgatttttttgttgtgagaacaattaaactctctctttgcaattttcaagtataaaatacattgttattaactgtagtcattatattgtacaatggatttcttgaacttattgttccatctaactggaattttgtaccctttggtcaaacatctctctaatcccacccgcctacaccacctcagcacctggtaaccaccattctactctctcctgctatgagtttgttttttttttagatttcatatataagcgaggtcgtgcagtatttgtcttcctgagcatggcttattttacttaacataatatcctcaagatttgtccatgttgttacaaattaggagatttttatctttttaaaggctcaataatattggttgtgtacatataccatgttttctttttccatttccatttatgtgtcgatgaacacttaggttgattccgtatgtttagccaaggtgaataatgctgcagtgaatgttggactgcagatatctctttgtcattctgaattcttttcctttggatatataccctgtatcaggatcactggatcgtatggtaattctattttaattttttgaggaacttccatactatttttcataatggctacatgatatatccccaacagcagtataccagggttcccttttctctacatccttgctaatacttatcttttatctttatgataacaactaatctatagtaatagctaatctatagctaggtataaggtgatatttcgttgtggttttaatttgcatttccctgataattagtgatgttgaacattttttaatgtacttgttagccgtctgtatgtctccctgtaggaaatgtctatttagatcctttgcttattttttaattgggttatttgtttacttgctatgaagttgtttgaattctttatatattttagatattaaccccttatcatagaatgacgcattttaagacaaggaatgaatcttgtgaaagcttaattccctgtcctaattcctcaccctttacacctccttgcactagacacactcatttacaaactctatacttctactgtattcctatgactggagggtgtttatgagaaaagcaggtgagccttagagtaccagtatatcaatttttttccacagtaggttaagggattcatggagggaccccccctgccccccaaattgatttgccttttgcattagtcaaggttctggcaggaaaactggtgacactctcaaatgggggtaataatataagaattgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaagaattgacccatttacaatagtataggcagggtaagtctgttgtcagggaagccaataaaggatggagaagcacctttttacccattacctctcttaggcttgaagggggaaagggagtgaatatttattggaacaaagagccagagatgtggctgtaactgggagagggcctcccaataggatctgaaaagttcagtagtgaaatgcaagcactgcaacccgaggcctggcagggaggagaccaaagaaactgatatcccaatctcacttttcccactccctggctttctgccaatgactcccatttgatgcagtccagaaagatgggcttcctagagagcagagtagggtggaaaatggattcagagggccatgaagagtatcagagtatcaagaatacctgttacattataaggaatatatatgtatatatgtatttattcatatggtacatgtgcttacaagcaggaagctattgtgtatatataagtgttatgtatttacgcatatggtacatgtgcctacaagcagaaagctattaatcctttcaagaacctttacaggcattattcatttaatattgataaaaccatttcaaatgagctgataatggtttggctgtgtccccacccaaatcacatcttgaattatagttcccataatccccatgtatcatgggagggacccagtgagaagtaattaaatcacgggggcaattacccttatgctgttctcatgatagtgagtgagttctcacaagatttgatggtttcataaggggattttcccccttttgcttggcatttctccttcctgctgtcatgtgaagaaggatgtgtttgcttccccttccaccatgattgtaagtttcctgaggcctccccagtcatgtgaaactgtaagtcagttaaacctcttgctttataaattacccagtcctgggtatttcttcatgtcaggctgagaatggactaatacagtaaattggcaccaggtagtgggatactgctgtaaagatgcctgaaaatgtagaagcacctttggaactgggtaacatacagaggatggaacagtttggagggctcagaagaagagaggaagatggggaaagtttggaacttcctggatacttgttgaatggctttgaccaaaatgctgatactgacatggacaatgaagtccaaactgaggtggtctcagatggagatgaggaacttgttgggaactggagtaaaggtgactcttgctatgctctaaaaaagagactggtggcattttgcccctgctctagagatctgtggaactttgaacttgagagagatgatttagggtatctagtagaagaaatttctaagcagcaaagtgttcaagacgtgacttgggtgctgtaaaaagcattcaattttatatattcacaaagatagaatttggaattggaaattgtttaaatgagaagcagagcataaaagtttggaaaatttgtagcttgctgatgtgccagaaaagaaaaacccattttctgaagagaaattcaagccagctgcagaaatttgcataagtaatgaaccaaatgttaatcaccatgataatggggaaaatgtctccagggcatgtcagagaccacaacagtccctcccatcacaaacctggaggcctaggagggaaaaatggtttcctgggccaggtccagggctcccctgctgtgtgcaacttgagtcccagctgctccagccatggctaaaatgtgccaaggtacagctcaggatattgtttcaaaaggtgtaagcccccattcttggcagcttccacatagtgttgggcctgtgattgtatagaagacaagaattgagtttggtgaacttctgcctagatttcagaggatgtatggaaacacctggatgtccaggcagaagtctgctgcaggggcagagccctcatggagaagctctactagggcagtgcagaagggaaatgtggggttggagcccccacacggagtccctactggggtactgactagtagaactgtgagaagagggccactgtcctccagaacccagaatggtagatccactgacagcttgcattatgtggctggaaaagctgcagacactcaacagcagccatgaaagcagccaggaggggcactgtaccctacaaagccacaggggcagtgctgtccaagccatgggagcccacctcttgcatcagcatgccctggatgtgagacatgtagtctaaggagatagttttggaactttaaggtttaatgactgccctattggattacttgcatgaggcctgtagcctctttgttttggccaatttctcccatttggaatgggtatatttacccaatgcctatacccccattttatctaggaagtaactaacttcttttattttacagtctcataggtggaaaggacttgccttgtctcggatgagactttggacttggacttttgagttaatgctggaataagttaagaatttgggggactgttgaaagggcgtgatcatgttttgaattgtgagggcatgagatttgtgaggggccaggggcagaataatatggtttggctatgtttgcacctaaatctcatcttgaattttagttcccataatccccatgtgttatgggagggacccagtgggaggtacttgaatcatgggagtggttaccctcatgctgttctcatgatagtgagtgagttctcacaagagctgatgattttataaggaggttttcccccttttgctcagcacttctccctggtgccaccatgtgaagaaggacatgtttgcttccccttctgccatgattgtaagtttcctgaggcctttccagccctggtgaactggagtccatgaaagatctttcctttataaattacccagtctcaggtatttcttcatagcagtgtgagaataaactaatatataagccttattattctcatgtgatataacaaaatatattaatgtagatgtgtttacagacatcttctttattccagctcaacagcccaaattcttttcaccttctgtaaagaagagtgactggaagagagactaagttaattgagataattaataagtgagtgagagaataaatgaattatagaggaggaaccaaaagcacagagctggaagtggaacaggaggttctcagcaattttaaaagtgaaggcaccgtagcagtggaagtatataaagggagtaaagtcaggctgggaaaacagaaggcaaaaatagtgttcatctagactgtgtgtcagattacttctaatatccttcaaggtacttgagtgaggaataatttcctcttatgtttctattggtattgggttgtccttttggatgaggctcagctcagagactgaaccatgtgatgtctgtgtattttagggttgcactcactttgcattaattttaactgagagttaaaggggttaagtgccttgcctaagatcacatactcagaaaatgcagagagcttactccagcccaggtttgttcatttcagatacattagtctcaattcagctttggttgaagtcacctgtgatgaatttgttgcatgatatagttttctgggggaaagatttcttttaatacatggtaagtatatagtaccccttttatagttggatagattagttctttaaatttcttttgtaaagaggatagattagtaatggtcaagtgtcattgagtgattcagacgaatagttccatgattaaatcttgtttcctttactttttgtataatgctaatgtatcccttaaaataaaaactccatttagttttcttcagttcatttaatcatggcattgttactgtaagaaagttcttctcctaatggtttctaattgctcttaaaatcttgtttgaatcccagaacaaatctctgtgttatatgtcaccagtgacccacccttactttctctcatttactgcctttcataagcagaaagcatttattttttgggtatttttgcttattttttaaaaataaataacattgatttttaatcctgggatatggaagatagtttaaagaaaacagcagtgtcggtggatagcaattaccaccaacaaaatatcttctgggtatttgatctatgaactttgtttgcactcctgcccacatcagtttttgtaacccttccaacttcctcctaagggcaaactcactgacatttccacaactgttcacctttctgatcctgataggattactatatattttgtttaggtttctagatatgataagactatctacctatccaacttggatctgtggcactttattttcctattaattttaaattcaggatttaaaaaagatacttacatagtgataaaatgagttgactcacaccctgcattattctaaaccaaaattaagttatattaatacattctctttaatcaagggtaaattcacatgccccattgtggttagtgaagtggtgaagggaaagttgaagccaaacagcctatgtcttaattctaactcagccactaactagctgtgcaatcttggacaaggccctgaaactctctgggtctcagttttctcatttctactaaaaggacaataatagtacctattacctagagttaggaagatgaagttaacaaagtgatagtgtattaaagcgtacctgacacataggaaacattcagtatatattgtctgctattattaaagctcctacacttattaggtaggtgaacttaatcagattatttgactttaataaacagcaatgatcatatttataaagtagggattgtaaaatataatgcagtgagtttacaagtgtcataatgtgaaatatataaatataaattacatatataaaatatataaatataaattacatatgtaaaatatataaatatacattatataaattatgtatgtaaaatatataaatataaattacatatgtaaaaagtacatagccatgttttgactcataaagagcattcattaaatgtggttacaatttttagaagacattatcagtaatattatcagtaatagaataagacctacaaaaaagggtaggggagagagtttcatgttgtataaggggagtgttgatttaaaagccttagattaaaatctgcaaatgaaactaaattaaaggtgttttgaagtgattttaaccgccaaacaaattgcatttaatacataataattactttattctcccattaaaataattatttttaagtgaataacagcttctttgaccaccctacctgtagttgcagtaacagtctaccagttgtctttccaaatttgtatgatgtcatcagcagcttaatagagcattagatgagaatgtctgagcattactatgctgactttgtaaaattgtaatccaaaagcaaagaatcttgacagcttagacagttggtttgatcttattattaatgaacagaagatatatcttaggctattttaaaagtgaatttataataagatttctacttcctatgttagctagagtaaacactagctaataaaccaccctcctaaacctcagcaaactagcccaagaaaagagtttaattttggtattagtattgctcactcacataaagcccaagcaattaggagcagaggaagggatgtgagggtttgctctatagagtcatagaggatccaaggtgacagagcctctgtcatcttccacacaggccttccaagatggttctagccaaatccagctagccaacatctctggaaatgacaagcatcacttttggtcatatttcattggtcagaagttagtcagagggtacctagttgcaagggaagctgggaaatgtagtctggctggcattgctttgttgcactaactcagtcctgtggaaaaggagcacaaatatttggtggacagtaaatgatctgtgtcatatccttattactcagatccatagtaataatgtctgtttttatctccttttctaattcctagtaaagaagcaatcaaataaaaagaaataaaaacactgaacagtatgtgttcatttgtctcatccattattgtatatagtgcctgatacagagttcagtatatattcagtatatatagtacctgatacagagttcatgatattcaataaatatcatgagtgatcaaacacatattctctgccttcttctcttcctcccttccttttttctctttttcttgcttcttttatatctctttctttttttctgatcccaaacactttagagtctttaatttgagctagattctatgataagtgattgaagaatcaaagacatatttaaccttggggaaagtcataatgggaataaaggaaaaaacattaatataaagtattagtaaacatttctaaattactgatttcattaaaatatttaacagtcttatgaaagactaaagaatcattttgagttcatctactaggcatggacaagccacttcaggaagtttaatatccttctttgtgcctttgggtttaatctgtgctagtgataccccagccttgacagaattgctgccccaatggcccaggctgtgggattctgcacaggaaagaccacttcatggtgaaaattctctaaagttttgctgtgaatcataccataacctaagatctgtgttatggtaaactggatactgtagtggtggaggatgtctaacttcgttttgtgtttcacagagtttcaagagttttcctgtaagcctctttagtctttgtatatttaatgtgctccaatcctacttacatctcaactgtgttctttctgatggcgatggtgatgatagtgccaatcatttatttagcactaacaactgtgtgctcgacactgtaccaatattattagaactattatttcttttactcatcacatcagccctattagatatttagagatttggaaaattatgttcagatagatttggtaacttgtctaaggtcagacatgttaggaaaaggcagagctagaattcaaatacagttttgactgagctcaaagcttgtgtaatcaccacttaggctgatgatttgtttaggctattgagagagaaagattattttatctttctttttttttctggaaagagggatgtatacagatcttttagtagtaaaattttgccactacattcagtgacaaaaacaggagttacttttgcaccaacctgataactcttcaaaatgtttggtgaggctggactcaaacataagtgcatggatgcctgatttttttcccccagtattcaagaacctcagggttttcctgaatgtgctatagacattccagggacctcctaagttttgaacattgcattattatgaagattaggtccataagttttatcagattttctaaaatacgagtaaacattttttaaacccaaggtttgctgccaacttctctcctctacagatcctggaaagaagaaagaaatggcttctaacaaaaagaaggggaggatttccagctcatttctaattcaggctcattggagaaggaagtggcatgggtgacgataagcagcagtttttatgtctgaaggaaactgaaaacagcatctcactggggtggccaggagctcttctgctgaagtctctgtgtatccagaatgcctgggattggattcttgtcctgttgcctctgacttcctagaagtggcctctgggccgtctttatttattaaatcatctgggtatgatctggctctgatattttggcattcgggagtggcagaccaagctcaaattgcaatagtcctttaaaaagatgtttctaaaagccagatatgcactgacatttcagaaagaacatttgtgcctaatttccagctgccaagttatagttcatcattcagcttcatattggaggccttcaggctttgatttatttaggaaacattggtgaacaatgggatcatgatctgcaacatgacagatgtaggaagtccatgtcccctaaaggaggttttctggagactcctaacaattaagagaatctgttctgtttctaagttgacagcaaattattgaattctgagtatccagaatgagtttggggagtaagagttgtgaagggcagacattaactgcttatttaagacataatacctgtcctttggaaacttatggtttgttagggggtagtgtcctagaaacaatgtaagacaatttgttaccaaatgataaatagaactttaaaacaaaaattttcctactgtcagggaaactaagttttccttttctttgaaggcatggagaagtgccgagcagtgtgttacttttcctctattccctggttcgttcctcacccacgtcagtttttcttcatatttgtctttattggaacccacaaagtttattcaaagttattatcagtttcttcccttttgtgaagaaaattcaatttttatgaattagatttttaagatggcttgtaatgtacccatacagccaggtataagaaattacctggtagcttcactgatgcagatgacagatacctgtggggacttacagtctagttgggagagtaatcacacacatacacacacacacacacacacacaccccagatttggcatgagaagaacaacgctgaagtcgatatctgcctattttgtttataatggtgtgaccttgggcaagtcacttaatttttcaatgtattttctcatctataagatgggagatatcttatatcctaaggctattgattatgtcagatggaatctcatctgagaaaataccttagaaattgtacagtatgataaaaatattgacttttattttctaaatcatacatagcaagatgcaggactagtttaattgttgtcacttttagaatccgattttcacatcatcattccatttcttatgatatttaacatgacaagcaaaagaccttgttcaaaggggaagaacaaataagattaattctctgtaaatcctttaaaattttattatccatctcttcactggggaaatgtctagatacattttcctaagtggttccatctttctgtaaatggctattgacctgctgagtgcagttttgctttcagagaagcattgcacttggtgtgtgatttgagtttgggatcatgaccttatttcctttgcacttgattgctttacttcaccaactgcatccctgattttgatattatctgtggctagctcctttcatgattttgggaatggctacctctcagttttctgaatattttttagtacttgctgttacaatgtagacattgcaataatgttctaaaattatatgtacatttacttactcaacacaaatttaaagagtacctgataagagctggtactctgagtactgagcactgagtacctggtagaatcattaatacagaagacaaagctctggcctcaaggattctgcagtacagcagcagggaggtaaaacacacataccacatttgtttactgcaagtgtgggaggtagataggtgtcccctaaaaacatgtgttcccagaacctgtgacgtgaccttacttggaaaaagggtctttgcagatgtttaagttaataatcttgtgatgagatcatcctggattgtacaggtgggccctaaatccagtgaaaactatctttgtaagagacagatgaggagaagacgtagagacttgtgaaacagaaggccatgtgaagacagaggcagagattggagggatataaccagaaagaatgcccataggcagcagaaattggaagaggtaagaattggattgttgcctaaagccttcagaaggagtgtgaccctgtcagcatttggatctccgactctggcctttaaaactgagagagaaaaaaatttctgttgttttaagccagtgagtttgtggtaattttttaatggcagccatgagaaacgaatacaacaaggaacaggataatctacaaaatacatgaattatacaagagcatcagaagtttgtggaaatttagtataaaaaacacctcttattgaaagtgtgattgttactatacagtcagtccagaagcactgaattatgaaaatatcattgcctggtatgtgtcagttatgtttataataatataaataatctaagcacacattgtgtcctgtaattttaattttactctaacatcccatgcaaaggtttaactgtaggtggccatttcatgaaacaaatgccaatttctcatggaccaatgttctcccagcagaggaaatatatcttcctgcccacactgggctacaacatcactaaaattacaagcagaaaggaggtctgcatttctatagcctcttcttttcttatctagtagtaaatggttataaacttgacattttccagttacaaacataagtaataatattgtaataacaaaagggaaggtccaatcctatagatcccactgatggtgatagagtaaatcaaggaatttggaagaagtggtatctagtttcacaagttgaaaaaccagaattatcttcaggcattcataatttcagtgtcatgggttaaggtgtttgggggcaaaatgagtttctggctgtgggatggatttgagtggtgttagcaatcattcaataacagaagccactgaagcagccttcgtctccctaatcaaaatgctgccatcataccattttgctcccaaaatatgctaaaagtaaggcaccaacggtaataagtagtataggtaatttttaagtaccataaaagtttacaatattaacagttacatttgttaattttgtctggcttagttggtggtgacttcagatggtaactgggtggaataagacttctaagcccacataagacaggatggtgtgatctttctgggagggtgccacgtctgtccaatattgatacaatagtgcaccagtggcagcttcttggttgggccaagtaagccttctcaatgtatttactccttcagtatttataacaatcaggaagctgtaattattgtccatattttactaatgaagtaactaaaacttagagaagataagcaatttgtctgaggtcatgctctagtagtgagcagagccagaatctgaactctggcatgatgactatagcgtctgtgtttttatgcattactgataggtatgggtggtatactggagacttagtgagtatttaggtgtgagtaacgtctacagtgacgtcagggagctcactgtacatccatgacatgagaaataaaattcccacgcttccctgtcttgaagctgaggcaatatattacatgggttaactgacaattcagacagagtgagagattcattatattcaccacaaatgaacacagatggacactcttcaaataaagcttcctattgaattttaatagtgctcttctgcagaacacatttgaaaaatggatcatagcatattcatattttcctttagcttgccaaatgtgagatgattaagaaacctgcttaaactttaaatattcttaccatacacatgcatttttcaaatgtatgcgtctgcaataaatatttgttaaatgaatatgaatgtatatacacaaacatacatgaagcaataggcgcacacacatttaatttgataaatatttgttgagtatctactgaatataaacttgggctgaagagttatggaaatacaaagacagaattcttttctgttcccaagaagctttataaggggaagtgagacatgctcagtcttgttctggtggcagctctcaaagtgtggtctctggctcggcagtgttggcatcacttggggacttgttagaaatggaaatgcttgtgccccaccatacacctgctaaatgagaaactgtggctgggggtctagcaatttatggttgtaaaagtcctccagggaactctgatgcacgttaaaatttcagaaccactgggcacaggaacgctttaatgtgctaaaggatgctaaatattactttcacgtggagacatctgagaaggcttgaagaaagagattgtatttgagcagagtcttggagaacaggtagattttggctgatagaaacagagaagggaaataaagtcaaagagaagagaggaagtcaacttagctcgtttgagttggcagataggctgcccatggatgaaaacccagattaaaatcaggcagtggaaatccctgagcaacacgcttgtgagtttagacattgttctgaaagacattggcagtcattgaaggtttctgagtggggaagaagtgtgatcaaaactaccttccttttttttttttcttacccagtgaatgtaattcagcacttgtactgagttcatattaacagaacttgatggttgtaaatcagtcttttcttcctcattaaaatcacttcaccattaagaattatctataggttatggctggaatcatgttatctctgctctttcttgactattctgacacagcaggcaacttaatttcaacaactcggtaatgcccccatcttctgtgtgtgtgtgtgtgtgtgtgtgtgtgtgtgtgtgtggtgtttgctaagaaggagtcacacggctgcttttgaattcagctgggctttaggaagctgcataaaaacaaagaaaaaatgttgctgcttgctagtgcattctttgttatgtagcaatcagaaggatgactgtgctctgaagtggtgcaggtggcctcttctgatactaattccagcgtctcaactagttcagcatcaaaagggagttctctggaagggaaataattctgtccctacccctgattgctcctatttgcccagcattgtgggcacctgcttggccacccaccttccttttctttgccatccacttgcgtcatctttctcttcccctgggtcagcctgtatatttcaatctatccacaccctgcgcaagctcattcattcatgggctttctctctgcaattttcattgtgcctccctttgttggcataattgattccctgctttgcaagagcaggtggatgagttggtttattcctttaaaaaattcctcctcttttctctttcattgctctgatctttagtcaatctttggttcagccagcttgttctccttctattgactaatctctctctgtatctttcataatggtggtgggagagtccatgccgaatctcctgttggttgaagaaggtgaaagtcaattggtaaagtcactgtgatttataatgttcaaactggggagggattgagtcgtgaagaccagaagtactgataatcatttagcttatttgctggaaggctccactagaccctaatgaaacaatctcatttatcttccccacatcctaatggaattgcagaattaatagtaaaaccattaagccttcttgagcatgtctcatctaacactccaggatctttgttacacatttttatttttctcaattttggattttttgagggtgcgaatttacttagctgagaaatttagaagtcctttattcagtctagtataaagtgtccagataaaaacataccttagagatattgtgggtgcagttccagaccaccacaataaagcagataccacaataaagcaagcatataaattgtttggtttcccagtgcatataaaagttatttttactctatagtctattaagtatgcaatagaatgatgtctaaaataaaatgtacataccctaattataagtattgtgttgctaaaaattgctgatgataatctgagcatacagtgggtcataatcttcttacttgtgaagggtcttgccttgatattgacggctgctcactgatcagggtagtggttgctgaaggaggttagggtggctgtagcaatttcctaaaataagacaacaatgaagtttgctttatcaattaactcttgcttttatgaaagatatctttgtagcatacgatgctgtttgatagcattttacccacagtagaacttctttcaaaattagaatgaattcactcaaaacttgcaggtgctttatcaactgaatttatggaatattctaaatcctttgtagtcatttcaacaatgttcacagcatctttaccaggagaaaattccattttaagaaactactttctttgctcatctatagaagcaactcttaaaatccattccagttttatcatgagatggcagcaattcagtcacagcttcagtttctacctctagttctagttctcttgctacttccaccacatctgcatctactttctccactgatgttttgaacccttcagccatccatgaagattggaatcttttccaaactcctgttaatgttgatatttcaaacttctcccatgaatcacgaatgttctttatggcatttacaatgttaaatcattttcaaaaaattttccatttgctttatccatatctatcagaggaatcaccatgtcagttctagccttacaaagtgtattttttaaataataagacttgaaagttgaaattattccttgattcatgggctagagaatggatgttacgttagcagacatgaaagccacattaatcttcttgtactcccatcaaagttctggagtgactaggtgcattgtcaatgaatagtaacattttgaaaaaaaaaaaaatcttttttttttccttagcagtagttctcaatagtaggcttaaagtattcagtaaaccattttgtaaatagatgtactgtcatccaggctttgttgttccatttacagagcacaggcagagtagattttgctaaattctggggccctaggattttttgaatggtatataagcattggcttcaacttaaagtcaccagctgccttagcccccaacaatatagtcagcccgccctttgaagtcaggtattgatgtctcctctgtagctataaaggtcctaggtggcatctttttcctatataaagctgtttcatctacagtaaaaatctcttgcttggtgtagtcaccttcatcaattatcttagctggatgtaacggataacttgctgcagcgtctacataagcacttgccgctttaccttgtgcttttatgttatagagatgatttctctccttaaacctcatgaaccaatatcttctagctttaaacttttttctgcatcttcctcacctctcttagccttcatagaattggaaatagtttgggccttgctctgggttaggctttggcttaagggaatgttgtggctggtttgatcttcaatccagaccactacaactttctccatataagcaataagcttgtttaactttcttatcatctgtgtgttcactggagtagcacttttaatttccttcaagaacttttcctttgcattcacaactaggttaactgtttggcacaagaagcctagatctcagcctatctcagttttcaacatgcctcactgagcttaatcatttctagcttttgatttgaagttagagatatgagactcttcctttcatttgaatacttaggcctttgtgggagtattaattggcctaatttctatattattgtgtctcagggaatagggaggcccaaggagaggaagaaaaatgtgagaatggccagtaagttgagcggtcagaagacacacaacatttattaagttggccatcttatatggacatgatttgtgttgccttcaaagaattacaataatgacatcaaagatcactcatcaaagatcaccatctcagatataataataatgaaaaagttttacgtgttgagagaattaccaaaatgtgatgtagtgacatgaatcaggcacatgcagttagaaaaatggtgtggattgacttgctcaaccaacggttgccccaaaccatcaatttgtttttaaaaatgcaattgttgtaaaatgcaaaaaagtgaagcacaaaaaaactaggtatgcttgtgataggtttctctcctattctttgaagaggcttttaaatagagttgattgcatggcattgcctagtaaaatcattttaaactaatatgaaattatataagctctgaacagggcatttgatgtccactagggaaagtaaaacatattttttatttcagcataagaagcttatctcttccatcttgtaaaataatataataataatagaattagttaaacatggtgattactattacgtattttatgattccaataattcaagcacagacactatcttgaatgcgtcctagtatattcagctccacaatgatgcctagggtttcatgttgaaggctgtgaagttaacaaaggaaaatggagatctgattactagcttccagagattggttgagaattgagggagaagagagatcaacattatatatttcacatggcagagggtaataggagcttttatagagaggcaaaatgcattggtagaaagagaagagagagcctaattccacttgctaaaaatctatggaagccacctaaaggaagaatgaaaaattgaatgtttatcaataagttggaaagaggagaggaacattatgggcagagcaaacagcatagaaatagaataatacatggagtatttgttagcattcagagggaatggagatgacgggaaatggtagaacatagttagaaaagtaaattgggcagaattggtgacaggggattcaatttggtaagcagtgggtaaccattcatggctttgagcagagtttggcaaactatgatttgtggaccaaatccatcccattgtctgatcttgtaaagaaagttttatttaaatacagtcatactcattcacttatgtattgtctgtggctgctttcatgctacaatggcagcattgaatagtggtgacagagactgcctacaagctgaaaatatttgatatatgactttttacagaaattttaccgatgtcaggattcactttaataaagtgtttcataaagtgtttgtttgtgccgtgatgggccatccaagattgtaatgggcgatcattggaaacaaagatgcttatagagcagcatcttgcatgtcacaaatatttgaatgaatgaaaaaatgcatatttctgttaagacatcacagtaacagtaggagatattgctttttttttctttctttttttttgacaagaccaatgtgaaaataatcagagagtggttctctggaccacatcctgttcttcaggggagagacattgaaaaacatcaggaaaagcttatccctagaattgattcagaggacaaagctacagttatgagaaaggccactttggagaaatgttggataagatgtccagtgaggcacagaatggggtgacactgggagtgacaggatcttgatggactctggccatggcacttctcaaacgtttttggcagtcctatttctattttcacagactcctccacctccactctgtcctggccagcacccagttctcaagcattacacatttatcccaagtaatgcgtagggagcttcctttcttgcacctataaattattcactagtttcagattggggtgaaaagaggaaaacataattaatccagaattatttcacatgtataaattccttgcttggttttgtttcatcatcagggcttccttggccttccatggatggcatataccttattaatttatgcttagcaatcttttgaaaataatttttacatgggtaactcactgaaacatcatggcatttatctcacatcatgtagttttgtcagttttgatgttagagaacgtattctgccttacttttatgtagcaatgtgaccaggaaatctcatgtaaaatctatgcctccctaatatgcaaaaatactgaaaatgagcacctcttctcccttccttcttttttaataaatctagtaataatagctggaataatcacaggatttctaaatggagtcagcatggcaaaggaaaatgttggtgatatatttattaagtccatagaagttaaacttccggagagctcccaagctaattggtaccccttgttcaggactggggactattaactgagagaattcattgggtgttttaatatctagccttttaaaatctattttaaacaaggactttgaaggatgactgaaatgtggttaaatttccacagagaacttacaactccagcaatgggaactccccaggtacagtgatgatacgaattgtgttggatttcttgaatttcatcttcaaagcacaagaatgagaaaagaaaggagacaggaaccatttacattaagcagagatgcataagtttcttaagtggtgctttccagagcacagctgggtttcgtgtgtgtgtgtgtgtgtgtgtgtgtgtgtgtgtgtgtgtgtgtgtgtctgatatatcaagctgtcggttatattccatagattcatagtattttcctcctctctatattccatctctactttttgtttataacaagttatttactttgcccatctatcttttaagcaaattatcttgattggaaataactggaatgcttgataattatataagaaacttaaatacttggcctattcatttatcctagagttttagggaacatcttggtctagcataggcattctcaaccatcatattgaaaaaaattgtggagcattatagcacaaatgattttacaaaataaaatgattgttaaaaattagaataggttcatagtagcctcacgctctgggttccatcatgcttcttgggagagagagaaagagcagactggctggtcagaaccctggctttgactgaagaacacattctgcctgtaagcataatttctcagctctgagccagagaaaagcagtgggactcttttctctaggaaatacagtctgcatagatagaatgaagcagaattggagacacataggaaaacaattatccctttgtattagtttatctaatcctctgctttgggaaaacaggaagagagaaaaagaagagggaggagagggagggagctaaaaacaaaggaaaacacttcacaagggtttgccctcccccaaaaattcaagacatgaaatagaatctatcacatatgattgggagccttgtgttctggttttctccaatcctaagcccaagaatttgttcctcctgatgctgtagatagtttcacctgagaagattttactcacctctgcgtcccattatgagatgggaaacctggcttctgccacgtgggcacagagtagatacccactagattttgttgttttgtgtgtatggttgccagggatgatcagtgccccaatattcttgccccatcaatattcttcttagtgagatttgcaaccttttaagcattgggaacttaagggttattatgaatacctgtcattttaagctaatatacattctttacagaataaatgcaaaatgttcacattcatgagaaaaaggaagaaacttttagctgacacataccattttgcatgttatataaatgtattctgctcagtacaaacatttttgtgaacttaaaaaaaatctcttaaatgtttctataaaagtactacttcttgaagtttatatttgaatgaaaatacctcaaattcttttctaccctgacttagaactatataactttaactctctttttcatttttaaagatgtgatattcctctgatgagataacgtggagctttcctctaaaattttcttgtgttcagaccttttttttctcttccttctggtcttcaaaaagctataggaatctgacctaggaacactgtttcctcaataattggcattttctattttcactttggttttccccaacttaattgatgagatatataatctttctccatccaaagaaactacaatgactgacactaacatttttgaacccatctatgcccatttccatttttagttctacaaatgttctgacaccattttttaaaaaatcacaacaccccaaacagtgggttctatttttttttctattgttatagatgagtaaactgacacctaaagagggcccttagcttgtggctggcatctcaggaccaaaatgcctgcgtttgaagcccctgggaatttggcctttggagcctttagcagcttctaagcctagtgagtttgtggcttcaggtcctgtttaggtcctgtttctcatttgtggagaggttggtcttgttttgaaggcagcaacctccttcattttttttcttttttttttttcactatctatcattactacgtttggtgccaagttggggcctcaaattttgaacttaaaacatgacatgcctggaaatccttttctctctcttcttctgaagggtgtccataaagtctgggatgcagacaaatatatgtaatgtcattaaaatttttacaaatctgtaaaaaataaaatagtattatcaatgttttcataccttacagatgcccttcactttaaataaagatttcctgagaactaaaaataaaaataccatgtcctcaagtttggattagtccagggagtagggagaagggctgagaaagagaagggtaaaattatctattcttgacatcactgtaataaattgattgaactgtactgcatattgaatgcttgctcttactagggtctcttcataaatcatctcattattcctcaaaataagtcagcctgctaggtttgatgagcccatttgacagatacacaagtccaaggacatcaaatgactcgcccaacatcactagggcatgtgggctgaatgaggatgttcagtctggtcacatcaaaagccctagctcttttccctataagctagaaataatattccatcccttttctcacctacctcccagcaaaaacaaatgacataaaaatatttttttctatctgcttctgctcatgatacctttaaaatgccttattcatcaattcattccccatctcaggctcaggtaacccttgatgggggatttgtatctaattttctctgtatttcttgaaccatttttttttccatgtgtccatctctatggatccaacctcatgatttcctggaccatttaaattgtcttttattctttcttttttctctatcacatatcttggctctaactcacctgctttccctttgtatttctcttttaatattttacatgtatgtattaccccaactagacagtgttttcaagggagaacttaggaatttttcatttctttccaccatgacatcagacatctttctgatgtcatagcttatgaaataaaagtctataagtatgtgacctgggtaaaacataatcattttgagacttaatgatatgatctctatcaaagttattgtcaactgcagttcattctgctgttatttttatatttgatgataattcagaatttcatgtccccttctataatacctcacatgccaaacaaattaattgtgttaatgacaggtaaggaagctcctggtcactttccttccttgcttcagacccagcttcaaggtgggccagatggggcacaggctgcctcctctgtctgggttcgagttacttgtaaccatgtctgactgtcctggggtgcctcttagctccagttaatttctgaatcctcagcaagttttaaaagtctgagcaagaatttcctttcttactctgttgcttcatctttttcctttcttctctcaaatattcaggatggaggagaaacggcaggctgagccagcaatccatcttacttgaaacctatttgaaggttgtcgggtatgcaagggggctggaaatagggactgagagtttgattccagcatgaaggccaggcatcagtaccgatctaccttgtagtgtggtaaatagactttggcatcagctaaattatttctgtgagactgaagtattttgatcgaaatagacaagtgagcaaagggatttgcaaaagaattctgttttctggcacaggcatctcaatgaggccttgtgcagaatctcacatccgagcgccccctgatggcaacatatagacacgcctcactttctgtggccaaattactccatgaaaggaatagtttctatatttgactttaagaccttatttctaatttatgttttaacctgggatgtgtttggtcaccacttatgtatttgtttttcatatttgtttgatttcaaattatctgtgataacagtattagattataaagtgcattttatgaagctattttaaaataaggtattttcaaatgtcatttaatgttttcttggaaagattcaaagtagtagagtgcttgaggagaaataaaagcagaggaggaataaaaggagatgaaggaggaggaaggggaggaggagaagttataaataaagattagcccctaattctaaaacattttttcttgatctaaatatatgaacaacgaagtccaaattatttaatgtttcccattgactataggatgaaatttaatactttagcctgatgtacaaggctcttaaagatctatccttgtctaactgagtccagagccaaccctacagctgcccaccttgaattttatgctctggaaatactaaatgattacaattacctaaatataacatagttatattcaggaaatacatatattaaatattatatatatatgtataatatgtaactatgttgctcatggatctgtgactgtgcacaccatagttccctctgtctggaacatatgtactgcctcttatcctcctgcaaatctcatccttttcaaggtaattctttcatttcagataaaatgttattctctctgtgaagcttggccgtgatttccctcaactcctgctctccacaagtttccactttgtactgagctcttacattgccttggtcattccctttctcttctccctacctatgttctgaggaaataaacaatgaagtttcatcttctttttttttttttttttctgagacagagtcttgatctttcacccaggttggattgcagtggtgtgattatagctcactgcagccttgatgtcctgggctcaagagatcctcccgcctcagtctcctgagtagttgggactataggctcatgccaccacagctggttattttctttgtagagatagggtttcgccacattgcccaggctggtctcaaactcttgggctcaagggatctgcctgcctcagtctcccaaagtgcttggattacaggtgtgagccactgcgtctgactgaagtttcatctttctagtccagcttagcacaatacttggtgcaggtgcgtaagacatatgtgttaaattgcatacttcccatttcctgaatggaggtgaaataaaggaaacaaaagttaaatacatttttcaggagatacagaaatttgtaactcgctgaaaaagtagctttttattaggactttgccttttaaatcattacacactttagtctttcctcttaaactaaattactatttattattgactttacagaagaagaaactcgtgtcatacttatatgactttttggaccctggtgacatgtgactaataggtaaaaagaacatacaatgctgggagcaatttgtccagtggcccaattttatatgatgcctcaaatgaagtgctgtttatgcaatgaagtgcgtttcttgctttgttagtagtcattgagcctctgcacacgtaaatgtgtagggaatgaccattgagagacaaagtgtttgtgatgttacccatttatagggtatatcaatagttcacatttacggcacactcctttgaggccaggcactttacacacactgtcacaccttatcctcaccatcacagtatgacattaggacaattatgtctatttgcagatgaaactgtgactcatagagatcaggcgatatgtcaagattattcagatagtaaaaggcaggcttgggttcaaaatcaggcagtctggtttacagagcctggccattttttagggcagttgttctcaaccaggggcaatttttcttcttgggatatttggtaatatcagaagacatcattttgattgtcacaactgggagagagggtgttgctggcatctagtggtagagtccaaggatgctgctaaatatctcagagtacacaagacagtcaccacaactgagaattgtccagcccaacatgtcaataatgccgaggttgaaaagacctgttttatgataataagccaggtagaattcatgacaattgagtttatacaccaaccagtccttagcctttgctgttttccgcctgttgcatttctttaagtgtcatttattttcatggctttgactattaactctatagagatgatttccaaaaatcaaatacagatgatttctagagagaacctcaacctctccctcgaattctagcttcttattttcaactctcaggaggccatttttatttgaatgatttgctgaccgttccagtaaattcaaagtaactgttgctcctaatttctccctctgtggctttgtcctttttatcctagatactgttattcttttcgttagccaggaatgaaactctgatttatttcctcttctcttttccatagttctcctgacttcctcgtctccaatcagttactgaatatgaatgacctttccctacacggcttttcatagtatattcctattttcccttccacaatgctgacctaggtctttttcacctaccatgtggtattactgtaatcatgttccagctaatcttctgactccattattttcctctttcaacatgatcctgcacaaccacccagttaatctcctgaactaactctttggccatgtatccttttgtagtgcctttctgccattgagttcagtgtggattgcatcttgtgtttaatattcttcaggatttggcctgcaccctgtcatcttcagttgagccaactccttgcattctctgaagtgtactgtgcctatttctgcctcctttcctttgcccagcctgtgttctacagaggatcaccctagctactccacacctacacaaaaatatcatattcttaagacctgatcttgaccatttaccttcactttagttcttcctgtttactgcgccattcaccctggtcctaagtcatatgttctttctttgtatttttatttgaatattttataggaacatactttgtcatcccaactggacagttagtttttgcaaaggataactaatacattttcattttctttctcagcacctgatatcataacttttttgaataaaagtctaactgtttgatcttggtaaatgtaatcattttgagagtttatcatgtataaaatgataaaagttgtaatgttgctgttctacaaagcctattaatattttaccaatttgcaaaggagaactaatacatttttcattttctttcccagcacctaatgtcatagcttttttgaataaaagtctaactgtttgatcttggtaaggtaaaatgtaatcattttgatggtttataatgtataaaatgataaaaaatgttatgttactcttctacaaagcatattaatattttcccaatttgaaagataatccataatctgtcgagtttctagagaatacatgaaaatactaaaactaaagtggatagagtttatgtgagtattatattcagaatcagtattaggggattaccaaaatcgttacttaaaccaagataaacaaaattaaagaacatacgatttggtggaatagaaaattgtaagtttaagggcagtggctaaaactggaataatttatgttctataaggggaatggctaaataaaattaaaaacacatttttaatgttattgatagaaaattaacccataaaaattggtgcattggtcattatttagactaatctgttaaagttgattatcgcacaatcatattttctcttagataaaagatttatgatacttagtaaaaatggagcagagatttcaccattatattatataattataatttcagtgaatcaactgcaaattcatcaaaggctatttacattctgcttcacttaaattttccagttttattttccagaatttttctttacactgtgccctgcactccaactagactgaatgaactaccactactttcttcccatgatttcccatatctacttcctctgttatttcttctacccagactgcccttcccaatagttttctctgtgtctacacaccttcctgacaccactcaaatatcatctccaccaccaacttgccttgatccctagaaataatcagacccttttctgaacacccttaaccatttattactattttgtggcacttatttcactcccacatccaatctgtgtgaatgggcatgacataacttttctaccaaacaatatttctttggggaaagaattgtctccagttatctttttttccctgatcctaggcaagcaaggccattgcaattgccgcacaaagggtggaaattgagctggtttcaaagaccagattcggaaacttgaattcattttctctgtttggtttcttctttcatacttgcttttcccacttggctggagctggggcctaggtagattcaggcttacatatagccatatgaacagaagggaaagaaaaggttttttttttctgccaaaacttttctattttagaaaaatagggaagggctttgttaactgtgacttggggcatgtgctcatttctggagcaataactgcagccaacagaatatggtaaaataattcgctcaatctgggctgagatacactccttaaagtcaaggactcctgtctgttaccgaagtagggaaaacagtgctgggcagacaaagaaactaccccataaaagtagaagatatctttcagagtctcaacacatataattattggcagtttctttaattatttttttctatttatttactattgaaattggattgcatattaaattttggatttagttttcttacttatcattatagtcagctttgttgcatggtcttatacattcttcttaacatgtgtggtgctcttcataaacatatgaggtgctttggaatagtatctcctgaacacgtcaagatatcaccaggaaacaaatttgactttaggtcacatggccacttttctgtctccatcacaccggttttctagctggtcagagtggggatagagtctaaaggggaaattaagtatcatgtgagctttgaattatgtaatgttaacaaatgtttaacattactattttctagagtggatttttgtaggaacactttccaacttgtatgcatgtttcccattccacatagagttcaaaatgtgactacttacagactgctttccagttagtatatttaagataaagaagcctacattacacaccttaagaatgtaggccatgtctacataataagaagaacatattttttaacttttaagtccaggggcataagtgtaagtttgttatgtaggtaaacttgtgtcatgggggtttgttgtaccgattattttatcacccagatattaagcctaatacccattaattattttttctgattctcttcctcctcccaccctccaccctctgaaaggacccagtgtgtgttcttcccctctatgtgtccatgcgttctcatcatttaactcccacttataagagagaacatgtggtatttggttttctgttcctgcattagtttgctaaggataatggcctccagctccacccatgtccctgcaaaagacaagatcttgttctttttttatggctgcatagtattccatggtgtatatgtaccacattttccttatccattctatcattgatggacatttaggttgattccatgtctttgttattgtgaacagtgctgcagtgaacgtaagtgtgcatctgtcttttgataagaaataacatcatacatgcaaacagctgctagcatgtctttgttaacactttttgtggcttaacatctttactaatatttatgattaaattcaatcctcttatttatttcccattatagaaacaagtagtgtagagttgtacgagactcctgaatttatttagtccaatgtttcaagcttttcagaggtttattttacaaacccatagtagtcagtcatgatactttggtttaaatacatctgatcctatcttcatcttgctatggggaactttctgtctcaccagtcagctttttccattgttaggtatttctgattgttggaacttcctcctcccaccagtctttttcagaatctactgtcaaatctgttctcatagcaattataatttttctttcagaattataattttaaaaatttgcacatttctgagaggtcttcaaaaagttcctggaaaatgtgcattatgaaaaaaactgggcatcacttaaaaaaatttcaccaagataaacttgtactaacttcttgtaacatgtctgaacaggatctagtttgagacactaagaaggataagacattggtttgaatagaggccctatcagagcaacatgaattctattaaaattgcagcaagaacaaacatcaaatttatggtgaggcttgggtagaagaatggtgagatcattgattctttatgaaaagaatggggacaatgccccaaagaaattagcagtttataagtagaaaactcattttaaggaggaacaagaagatcttaaagatgaagcctactatggcagaccatccacatccacttgtgaagaaaacattcatcttgttcatttcctaattgaaaagcctaggttattaacagcggaaacagtagctaacaccacagacatctcaactggttcagcctacacaattcttactgaaaaatttaagttgagcacactttctagttgatgggtgccaaaaccgtcgtacctagatcagctgcagacaaaagcagaactttcaatgaaaattttaaacaagcgggatcaaaatcctaaaacatttcttagaagagttgtgacaggagatgaaacatggctttaccagcatgtaccatcctgaagacaaagtacaatcaaagcaatggctaccaagagcaggaagtggtccaatcaaagcaaaagcagactggtcaagagcaaaggtcattgcaacagttttttgggctgctcaaggcattttgcttgttgactttctgaacgtccaaataagaatagcatctgctaatttagtacagtgttttgagaaagccaaatttttagcagaaaaatgcccaagaaagcttcaatagcaagatctttttcattatgacaatgttccttcttgttcttctcatcaaacaagggcaattatgtgagagttttggtggcaaattattaagcattcaccttgccatcctgatttgacttcttctgacttcttattgtttccttgtcttaaaaaaatctttaaagggaatccatttttttcaattaataatgtagaagagattacattgatatggttaaattcccaggaccctcaattctttagggatagactaaatggctggtatcatctctgacaaaagtgtcttgcacttgatggaacttatgttgagaacaaagtgtgtatttttaatttttatctacttgcccatgaagttcatggagtgcttttagatctgtctttttctctgtctgtttatctatctatttatctgtcaatctgtctacacacccatgcatctactatccacctacctaccaatcatttattcatataaatttgtttaaacacctggaaaaatgattatatctccctcttgccttctctttacgtattgctaactatactcagatatttgagtcattcttagtatgatagttttcttactgttgtccattcctgtcttattttttaatgttctggttcttttagaaatatgttatccaaagtaaacccactgttcttgctgtaggagagagttcactgggcctttccatgctgtggtgtggacttttacttccattgtagatatagcagaaagagctcagtgaccgagagcctgactgcttggatttatactctgcctccacctctcactggcaatgtagctttgggcaagtcacatatcctctgtatataatttttctcatttgtggggtgcagatataagtggtggctatcttggagggttgcaaagaagagcacttccttggccaatagtgtgccctctgtcatgaatatttccctgctatcattgtaacttaacttttgttgctattttaacaaccaaatcatgactatttgttatcacttctgggcctttaaagttgctgcttttcccacctagagcattttcccccaagatagtcacagggctggcaacctctaatcttttagcagcttgaatgtcattcctcaaaaaagcctccctgactgctggttctgcccttgccctggtcactctctagccctgggctttatttcattttctttatggatcctatcaccatctgaaattcttcactaatttgcttgattattagctttctccctctgctgaaatgtaacacatgtgagaccagagcctccttagtctcatttaccaatgttaacagcaaccagaatcgtgcctagcatatagcaagtgcaccagaaactttgttgaaaaaatgttttgggtccatgaaaacttccaaacatgtttcagatgttcagatgactttttctttttaacttgctctcctccaccccatatcaatgcaatggatatttgaaaactaaatccagaacctgaatttatcctcaataaatttgacttttcatattccattcagagttctggtattcctatattgttttcaatttaatgctagactttatattaattaagataattttatggtaacaataacattatgcatgcattgagtgtttgctacatatgaagcacttataaatttttacatataatctcatttaatttttaaaacaaccctatgaaatacataacatttttattcccatttttataaatgagaaagctgaggtacaatgagggctggtaattgggcaaagtcccacagctagtaagttatagagttgggatttgaacccaggccttcagatatcatcaactgaataattcatcagtgtcatgaggaattttctgaactttgtatgacttgaaactttgtgatgttttgtctgtatctatatacaagtcatgataagatgcctcataataataccaagcctctgtgatattccagtactttttattctggttactactgaaccaagaattattatattttagtcatattgtcaatgagttcactacccacagagctgaggacataaggctgctgtggaaaagggagtaaacacttattaaaagccaggataggcaatgtggcattcctgtaaagcactaattagtattttcagcagaaatatgttttaccaaacctattttgctgtcatttgaaagcatgttattttctgcatgttcacatttcaccttgcttcccagagtgtttacagcaacttgccacagtaacacatactaaaataatggtatgatacacaagtaagaataaaaaatgtgatctagagaaaaataagagttaaacacaagaccctagggtggaggatggtctgagagagagataaatatttaggccttaaggaaccacacacagttcccctggttgagccacaaattggtatgtttttttccttatgtacaggttttttttttattatactttaagttttagggtacatgtgcacaacgtgcaggtttgttacatatgtatacatgtgccatgttggtgtgctgcacccattaactcgtcatttagcattaggtatatctcctaatgctatccctccccctgccccccatcccacaacagtccccggtgtgtgatgttccccttcctgtgtccatgtgttctcattgttcaattcccacctatgagtgagaacatgtggtgtttggttttttgttcttgcgatagtttgctgagaatgatggtttccagcttcatccatgtccctacaaaggacatgaactcatctctattcttttattagccaccaggaagctttaaaaaaaatacccagaacaaattggtatttttttttaaagcttcctggtggctaacaaaagaatagagaagcaatcagttcttactgtcagttagaaaaagctatcccagttattcaagagaaacacagtatagcttgagactatatgtctccataggcctttttgtaagaagtattcagtgatataatttcccctatagcagacctacaatgaactgcttagtttcatgtcactgctgctcatattgtcctttgctaaaagctgagaatatgacactaaaacgagattcaaggaaagaaaatctgtaaaggatggaaaacgcagatagtatgttcaaaaggttagatagaacttggaggatcatttattcttcttacatcctccataaatacatagcttacctgggattttgaataaatgtgggcagcagaccattcaaagtaagattatctggaaagtgcttggagtttctgagtggtttgctgttggatccatttgttttagaaaatgaatgagaatacatggaggattatagccttttctggaaattaaggacctaaccaagttttttgttttttgaattaaagggccctgtccatatctatatataagtgagaaactgactttattggatgtctctagtgtttattcattccttgttccttcgtttattccttcaacaaatatttattcagcccctactatgccctagatacctaagctatagcagtgaaaaagacaggtatgatctctccttcaatagagtatacattttaagaggcaaggcaaacactaaacaagatactaattatacagttacaatcttgataagatctactaaagacaagtacaggtcggaaagtaagcacaaaaatgagaaactcaattccatttttacagcttccttacattatagatgatgttacctctaagatttttttcttttttcttttcctttcttttctttctttctttctttctttctttcttttttttttttttttttttttttgagacagagtcttgctgtgttgctaggctggagtgtagtggcgcaatctcagtccactgcaacctccacctcccgggtttaagcgattctcctgcctcagcctcctgagtagctgagactacaggtgtgcaccaccatgcccagctaatttttgtatttttagtagagatggggtttcaccacgttggccaggatggtctcgatctcttgactttgtgatctgcctgcctcggcctcccaaagtgctgggattatagatgtgagccaccgcggccggccacctctaagatattaacagccttctaatcactaaatccaatgtcctcttctaatctttagaaatgttcatattcgttggcatgggaatataaccatgaggtttaaagtttctgcttgtgcctttgtttgtagcagataaaatcttttgtttaaaagaaataaagcctacttgaagtccataaagagaaaacagatgaaatctggactgctttgtttggagatgcctcatgggaaggtgggagctctggctttccccacacttggtaatctcaggatcgtcttttcttgatccccatggtgctagtttggaagccactattctagaattctcattattatcagctatttatgtattggctccctggcagccctaaagactctgcctggactgacacatcccagtcctattcccagttctgtgccggagtctctgaacacttcttgaactgatctgagccaagaaagaaacttggacatctttggatttgtgaaatccaaactggaccctcttcatttgctgtgatttcccacccatgattacagttcacactctacttactaccaggtctccaaccaacacctcatttattagtccatctcctgtgtgtgcatggattggtgagggaaattagaaggaaaggaagatgattgcatccatcaattgaatcaatgtattctgggctccaaatatgtgctaagcattgtccaaggaagctgagggtataactatgaacaaaagaaacaaaaatacctgcactcttggaacatacattctaatggaggatatagacagtaaatacatcagaaattaaaattgtataacaggtggtgataagttcgttggggagaaaataaccaaagaaaaaggatagggtatgtcagggtgaggaggaccaaggtttactactttaacgaatgatgtaaaagattgcctgagtgagaaggtggcatttgaggaaagatgggtaggaatgagtgatacaggtgtctgcaggaaaagcattgcaaacagaggaagcagaaagtataatggagcttagttaggagcctggtatgtttgagaaacaacaaagaggtcgtgtggctaaagcaaagtaagagatgagactagaaaagtggcagaggagcagatcctgaattgtcctgtaggccattttgaggactttgggttctactctcaggaataactgggaagaagagtgacacgatctgtcttcagttttgaaaagatcaccctggctactgtgtggaaaatggaatgaagggggcaacgggaggtgcaggaacatcatttgggagtggttgacacaaaacaagcaagcaataaggggaaggaggggggataatttgttcaagtaagcctctttctctgttccatttgattggaacaaatggtacaacttagcagaatgtccagtaatagaggagaaagcaaataaaaattcaaagatattgagatagtacctgagtggtaatttaattaatggaaaaggaaatctcagaaagagatgtttttgcctaagggctagttgtgaaagatgaccctgaggctcaataaattgccttccattgtcagtggtatgtgcgtgtgtagataattaaagaggtgagaataaaaatagagggaaaagtcaaggattgagttttcaattttagagtttctatatatggagtactgtgtggtttataaaacactggtatttaatatattttattactatataaatgaatgaactacgtttcccaaacatctttctacgtgtgaagcaaaaaaaaaaaaaaaaaaaaaaaaaaaccacacagaaaaaaaacaagcaagcaaacaaaaacagagggaacaagagtttagagaagtcaaagaaatagtattcaattttctgtttagtaccatttattcagtgttcagtgtcaatgaggttatgagaaatattctagatactggagatacaaatataaatgaaacacagttcttgcccttaagaagcccacagtcaaatggaaaatatatagaaataaatagcactgtaatgtgataggcagacaggattgcttaattctcactgaaagattcagatcagagttaccctctgtgcagcttcttgatggatgatggggagggccagcatctggggttggagaaaagaaaggtgggtctcagggaagaaattccatgtgccaagatacagaggggtaaaattatgtggccttttcagtatatgaaagcagtgattcacagaacttagatgatacaccttgacaagatactcaagactcccaagacaagacactcaagagagtgtcttgaaaatagagtctttaaggagtaattcaattaaaattatggcattagtgcagactgtaattcaatacgactggtgtctttgtaagaagagaatgtccctataagaagatactcaagaattccaagataagacactcttgtgtcttgggagaaattctcatcttgggagtcttgagtgtcttgtccaggtgtatcatctagtacagaaaatagctcaaaaattgtgatagccttgagaatatattttacattacttactgtcgaaactgggactgtttttatcacaaaaaggggcactattaataattacactggaatgggtataaattaaagcagtctggggaaacccaaacatatggtcaacctaatgatacctgttttcctgcataaaggggttataattgtactaatttatggtgcaaactgggtgctaaagctagtgatgagtttctctgctagaaaaatgttccaaagaaataaaccaagacagttaatgcagagttttggtagaagggataactacttttagatggtaggtcacagaagcttgtccgaggtgaggactttgggctgagtcctgaatacaaacagccagctatgggaagctccatggcaggagtgctccagggagagggaatcccaaaagccctttgtgggagtccttctgttagagaagacctgtttggatggagaatacaaaaccaggggggcttgggagatgaggtccgagacataaggagaggctagttcatgttcagccatgtacatgtggtggggaatttgagttttattctaattggtggaagcacagcaggtgatagagcatacctcacgtactagtttacaagggctgccttcacaaagtaccctggactgggtgacttaaacaatagaaatttatttcctcgcagttctgcagggtggacctcccaaatcaaggtcctggctgagttggtgccttttgagggctgtgagagaaggatctgttccagaactttcttcttggcttttagatggctgtcttctccctgtttctttacattgtcttcctgctgaacatgtctgtgtccaagtttcctcttcttataaggacgccagtcatattggactagggtccgccctcatgccataattttaattgaattacttcttaaagaccctatcttcaaatatggtaagcctctgtggtattggggtttagatttcaacatacgagtgtttggagggacagaattcagcccacaacacctcattaagcctggaagagaccgtaagaatattcgattaactggataagaagcacttaaacccaatttctaagaaaagagggataaaaaggtatactgtttccaggtatagtatgaaggtcatgatataaaacagaaagaagctttttagaagggaacaaaaaacactggggcttacttcaggagggatggtagaaggagaaagaggagcagaaaaaataactattggatactagggttattaccttggtgattaactgatctgtgcaacaaatcctatgataggagttcacctatacaacagacctgcacatgtacccttaaaccgaaaattaaagttaaaaaaaggaaagaagccttatacagaggactatatatagccttatataaaggactatattaagaattcttgtgagaagtcattatttaggtgtcaggcatctatagccatttaaacagagtctgtgtgtaacagtcttgagctgctgatgaaagaaggtgtagaagagtgttggtgccaagatctggagtggagtggtaggatcctgacctggagcacccaggaatgactgtcctttgtgcacaggtgatagacaaaactgggggaatgaggagttgaacatggaggtatatgaggaaggctcatccgctcttcagaaatccagaaacctaagtgtgaaaacacagatttgagggcctccacctgacttggtgggatgctcttcataggagatattctcctaatgtacattacaaagtcaatctaggagtaatgtaaaagtgatagttatcttaaacaacctgaatattttctagatatgtgattttgcaaaaataaaaaaaataaaaaaataaaaaaatgaaaaaaaaaaaaaaaggccaggcatggtagctcacgcctgtaatcccagcactttgggaggccaaggcaggcagatcacctgaggtggagagttcaagacaagcctgacaaacatggagaaacctcgtctctactaaaaatacaaaattagccgggcgtggtggcgcatgcccgtaatcccagctattcaggaggctgaggcgggagaatcgcttgaacctgggaggcagaggttgcagtaggccgagatcacgccattgcactccagcgtgggcaacaagagcgaaactccatctcaaaaaaaaaaaaaaaaaaaaaagagagagagagagaaaagaaatatctgtgttaggaaaaaagctaggaaaagctaaattctggtcatttcataataaaacgaataatgaaacaaacagaaaaatattttatgtggaagaacagaacagagaccttgggcagaagtaaccatgacacgttggggtttgtataagtaataaacgctgagatatatgccttaaactttagactgtctgagatcagtttaaggcaaagatagaatattatgactaaagagcgtaaaatgaactgctgagcatgcaagtaccataaaaaggcccttccttcagaattgagctgatccatattttttctcttgatttcattttctacttaggaactcagttcttgacaggccacatatacaatgaatgtcccaaagattgcaatactgtatttttactgtatattttttatgtgtaggtacacaaatatttactattgtgtaacagttgcctgcagtattcagtacaatcacaagctgcacaggtttgtagcctaggagcataccatatagttcaggtgtgtagaggttacaccatccaggtttgtgtaagtatgctctataatgttcacacaaagatgaaatcacccaatgatgcatttcttagaatatttcctcatcgttacgtgaagcatgactatgtaagcattgagaatatgaatacacatgatttccaccaagagaaagcatgtgatcccaaatataattggtaaactagtattaaaattttttatatgtctttctcaatatctgttatatgagacacacttgtttcacatagaacagatgaactatttgttttccatcactagaatatttttcttctaaaacttttgacctatttgggattgaaataaatgacttctaaatttccatccattgctaatatctgtaattctgtgtattacagataattggctaattacctgagtatggtgttgcttttttcaatttataacagtttagaccttttaggatacagttgttgaaatatggcaccaaaacactaagcatcttatattgatcgtgtgtcaatttacctaaccttggcaattattttcaatatctattttccaaggaaagaaatgagtagttattatcaaattacacaagtggagaagaattggagtttaggtaaatattttgttctaaaatatcaaatggtcatttaagctgaattgggataaaacaacccctatgaattttgctggatggacaccataaatgacagcaaccctgttcttctgttttcatcatagtcaaaaaatgctttagagtttactacttctacatatctcatttagttttcataatggagattttctaatgcatgttttatagatgagcaaacaaattgaagatgttaagtgacttgttcaaagtcatatatgtgaacacatattgaacataacttatttggccttattactataatggtcattagaatatctttaaaaatataattttttaatcaattgacattacacaatttttatttgaagctttcaaaattaacagtaataatgttattttattaagcacttattatatttcagtcacagtgctaagcacgtcacagtcatcatctaatttactcaatctgaaggtatgccattctctgaaaatggcaatatacgcttacaattatttgtagcatagcattctacactaaaaagatgaaataaagaagttgaaattttctttatcaattaggatagctaatgatcttctgtggcaacaatcagcatgtcttacagcttaaaacaacaacgtttacttctcatccaccttacatcctatctttggtgtacctggagctctgtctcatgtcgtccccactcagagactcacgctgatggagcagccacaatctagagcctggcctgccacagtggtagaggaaaagacagactggtgaactgtgcagtgatccctaacacttctgcccagaggtgatgccagtcaccttgatcgaagcaagtcaatggctacatcaaatatcaaaaaagtgggaagtgaaatcttaaaacaccccggaaaatactggaaatttttattttagttttacttgaaaaaagtataaattttgattttctgtattaaatcacttattcaaacaatgatttattcaacagaaagcattgaacactgtatttcttttctgacaaccacttctccaattctctgacaccaactgggtgcccaacaattttattcaattctgatactacctggagttagcacagatcccccaggttaaggactcagtctcacaagacttctgctactctagacaccagacactgtacatggagtgctcgggctacccacagttttgtgcagctgaccacaaattgggggttctcatgaccccctccacccctcagtttccataattcagtagagccactcacagaaccacgacatgttctttatttgcaattattggtttattataaaggattcaacttaggaacagccaaattgaagagatgtattggacaaaacatgaggaagaggacccagagcatagatgccctctcctggcacactgccctgccagcatgatgatatgttcaccaatctggaagatcctcaaaccccatcttttagagttttgtgtccaggattcattaaggtagacatgattgattatacattgcccattggtgattgaactcaatctccagcccttctctccaacccagatgtcagggacggggaccttcagttctgttcctctaatccagtagtttttaatgtaatcagtcctcatcctaaagcaaaaagctacccttttctcccccatgagttatttcattagggatcttaaatagaagactattccttcagaagattttaggagctttgtgccaggaagctgggagaaagatttttttgttgttgttacactacacacagccatatgctgagcttggtgcaaggcacgggggatacagtggttaatggagcagacacagtccttgtcctcatgaaacttcaagttaggcaaactcattgaaatgaagatcagtctagagaagttagtaaaactgaaacaaagataaataaaacatgaacttgattcacagaaacacttacctccatatatgaataacatcaattagtaaactgggaggaggaaggaggtgctgggtgtggaatggacgggaaaaatggagaagtcaacactgaatttctaatcacctaaatcactttaagtctcatctttttgacatggtgatggtcaaagattggcacattattcttatcaaagcacaggatagggtgctaggtggaggaaccaggaaagattagtcagagaagatgccttgaaattctatgttagattgtcatctaggttatacagctcatggacaaaaatacatgcataaaatgatgcccacatggattaatggatacatgaaattttaaattcctagacaaacatataaatcaatgaattattaagtttatactagttgtatatgggactatttgatattgcttactttgttctttgaattttgcatttaggagatttgtagtatgagtttcttgcagaaatcttaacatttccttaaaaaaccacttccctaaaataatccttgaggaaacatatttgtcagaaatgttcacatcatattccttttgttctggtttatctcatcctccttgacttctccacatctctaagtaggaagttatttattgctgctgaagttgtaaccctggtgatttcgctatcaacttacaaatcacttcctttccatatgactacagcatgtaagaatgctgaggttttcttttctccaaataaggcagaatgcttcaagaatattttatcgtcctatatggatattctatacctttagagtgaacactttcctctattaaaacattaacagtcataatgagattcagtccaactggaccgagcttgtgaataaaacaagatgctccagtctgtggttcaaacattttgaacttcccagaatataattaggtatagaatatagttcttatctttctttgagaactttttgaattattgttatagtttctaaaatatcttttctattttgagggtaaggtcacaaaacagaaaaaaatgtgtatcagagtatgttgaatatggctgtttgtcagatcaagtttacgctgtgtatgggccttcgtccaatttagatgcagatggtataagggactttgaatatgctatattattattcagctgacttctccagtaaataatagtgttcttcaggaacagaaaaccaaacgccacatgttctcactcataaatgggagctgaacaatgagaacacatggacacagggaggggaacatcacatacactggggcctgtaggtggaggggagcagggggagggagagcatcaggataaatagctaatgcatgtggggcttaatacctaggtgatgggttgataggtgcagcacatcaccatggcacatgtttacctatgtaacaaacctgcatgtcctgtacatgtatcccagaccccaaaataaaattaaaaaaataataatagtgttctttagcgtctttcatgtgaatggaagttttgcagacattgtcacagcagcattttttcccgtgggtttccactaagtggtgccttcgccttgggggaaaggtgtctcagtcttattccagtctgcttcatttactgttgatgtgatgattgctgcctatgtagtatgtgactttctagggacaggcggtcaggtttttctggacccctctttctctgaggatctcttcaaaggaatagcctttggccttgagtgctgcctcgagcccacaagcaccttctcatggttgagcacaccctattgcttgactcagtgaaatacattgaatatcctgccaacactttttgttgtacatctctttgccctcaggctagctacagaaagaaaaagagagagagaatacatttttacatttcctgttcttcatgttgaatgaggcagtttatcttctgaacagctgctttgaaggtttgagtatgttcgatgcactaaacataacagcatagaaatgaaaaaaggaggttggcaaactaccttcttatcttcttttaaggcttttgaaggatttaagttgtttcaccttttagtggcatcacagagaggttgagatttcacttagagagaatggctttgatgtgctattttgtatattagtgaacaggttcacaaagatgccattctctaatcaatgctcctgctcccacaagacagaagagaattgaggaattaaggaaatgccaagaggtagaacatccagtatctttggtggagatcttgctttgctatgtttccttccttcaagttatttgatctgtgcgtgtgcctgagcatttattgtacaacagatactgtgctaaggcttttataagctttgtattgcttaatgttcatggcagccttgggaagaaggtactgttagagtaggaatgctactataatcttccaactgggttgacattaattccttaacctgctctttttgacttttcttcttcaacccattgataatctaattgtcctatatttctgtaaggttattctaaggtattttttgagattccttattaagaccattaatacggctgggcatggtggctcatgcctataatcccagcactttgggaggctgaggcgggtggatcacctgaggccaggagttcgagaccagcctgaccaatatggtgaaacaccatctctaccaaatacaaaaaattagcagggcgtggtggcacacgcctataatcccagctacttgggaggctgaggcaggagaatcacttgaaccctggaggtggaggttgcagtgagccgagatcgtgccattgcactccagcctgggcactctgtctcaaaaaacaaacaaacaaaaaaactttaatacgtgtgagtatagtagtgaacaattattatgggcttagtaagtgccaggttttatcttaagtagtttatgtgcaaacccgataacacccaaacaaccatgtaaaatagatatcataagccctattgtattttaaatgaagaagagatgataagagacatccctaagctcccactgacataaaatacagacaccaggatttgaactgggcccatcttactacagagcctcaggatttaacccccactcttccagttttcttcatggcctattgtcagagtagaaacattatttctattctgaacatgggctgtgctcaataaattattgcttcatctccttgatgataacaaaccattgcctttcttaaaagtcttttctaaaaaattttagcctagtaatttcaaaaaaaagtaaagcagtaaaatacgtcatcctgtaaagtctaaagatttgaaatttaaaagttttcaggctagagaacagaacttgatgtaatttctagaagtgaaataactcttgttaaaatcagatgctgctggtacgcaatccaaaagggattgtttagaccctagaagcttcaaataaattgagtctcagaaataggggggaattgagtcacacagttctgattgtttttgtcaacctactgaagaggaacaggagcacccttccgaaagagttcagagctgagtgtgagtattcacaagcaagaacctctggcacatcttcatctttataattccaatagcaatggcaaacaagaagactcaatgtttaacttcagatttcattagacggagagccgtgtttacaatcagctgactcatttgagcgttctgacaagctctcaatcctatctggatctgttaggttgtcttttaaaagaggaaatatttcaacagagataatattcctataagctgtgaaagtctgtctagaaatcaattgttaagcaacctatagagtttagagcagaaaaagctacaaaatgaagtaaatttttatagtggtttctagtgagaaacaatgtatgccctaggtgcagtgggccatggagaacatttattacattcttcttgtatgaacactgatatacgaagaaaataaaagctcagcttttgccttataacactacacttgccatggtacacttcaaaattcacacatgcatagggagattatttacacatgtgcaaaactaggaaaataaaataatgtgaaaacatactagttaaatgtgattgtgcagctcttttacttctattctggattggtgtttttgccaaaccctccctatgtcaacacaggtgacccctctgaaaggaacgtgccaattatagttgacaaaggggcttggtgcactgaatcttgagaaatgatcttgaatgacctccaggatttaaatatagttattgaaaggggccgaaccaatgagatgattcacagcttccgcatggagccatctctatatgctaagtacgaggccagtcctcataaaaacccgccaaggagggcagtagcaccattgttaccagcacagactcctccctttcctagctgtgtgaccttaaggagaaatatacactccagaaatctgctgcttcttctctgaaaagggcacaacaatagtcgcccattgtagagaggattaatgggataattatattatgtaaaactcactgaagtattttgtttacatagggactattcaataaacataaaaattataattattacagttgttataattccccttttacagctgaggaaactcccaagaccacagaataagtggaaaagttgaaattggaacctacctctttttgactccaaatgaagtgttctttttaataggtacagtagttcccacctattcatgagagataccttccaagacccccagtggaagcctgaaaccacagccagcaccaaaccctatatacactgtgtttttcctacatatacctatgataaagtttaatttataaattaggcagagtaagagttcaacaacagtaattaaaaaaatagaacaactgtaaaaataatcctgtaatgaaagttatgtgaatgtggtctttctctcttatatatttctggaatattccatttaatatttttggactgaaactgtggaaagcaaaacagtgaataaatactgtaattagtgttcattgataacataattttggccaagtgcagtggctcacacctgtaatgccagcactttgagaggccaaggtaggttcatcacttgagcccaagagttcaagaccagcctgggcaacatggtgaaaccttgtctctaaaaataaaataaaatacaaaattatatatatatatataatgtatatttatatataatatatatttatatataatatatatatttattatatatataattatatattatgtaatatatataaaatatatattatatattatataattatatataatataaaatatatattatatattatatatatattatatatattatatatataaaatatattatatattatatatttatatatattatatattatatataatttatataaatatataatatattatatatataatatatatataatatataatatatttatatatatatataatatatataatatatatataatatataatatatttatatatatatataatatatataatatatatataatatataatatatttttatatatatatataatatatatatgccaaatgtggtgatgcactcctgtagtctcagctactctggaggctgaagtgggaggatctcttgagcccaggaggttgaggcttcagtgagtcgtgattgtgccactgcactccggcctaagtgttggagtgagaccctcaaaaaaaaaaaaaaagtttttttcagaattccgactatatgccaagcactctgttgggtgctgatcaacaaggtagactaagtctttccttatggagcccacattccagctgcctctgacaatgcttttccccatggcactcagaatcctgattcctgagtcctacagaacattctgtaacttggtaattctgaggctgccttggggaacaagcgtaaggaggagggtttcctcagagcagaaaggagggaatgtttttcctgcaattagagagtgcagtgacagtggcaaccacagtagcctcatagagcaccagggatgacagggaagaaagtgaatgctgacctcggctgaaacagcgctggcagcttcagcagatatattacatggtacttaccattacttcatacagtgttgagagttttggctcttgagcagaatttctgggtctgtattttacctatgctgctcatgcattttatgatcctatgtgggttatttaagctttttgtgcctcatctataagattgagaccattatgatattgatttcataggtactttgcaggcaggattacctatctgagagaaacttgatttatttctttgatgcatgcaaacttaagcttgccaatgctcatatttgtgcatttttccccacacaggacagtgcagtcgttaaggcaccatggttagtgtcatctctacatgcctcagcctatctcaaggtctcctttggacagtttgcaaatgagtgcctgcctgagtctctatatctgagggagtcctctgcctgggggagcttatctgcccatgctcaagacatgagggctagaatttgtagataaatacaacagcttccttgtcccttggagatgattctcagacatattccacaatctctcagaggctccctggtggtaccaaatcccagttgtccacagcaatagtggggttgttaaccagctttcctcccttctctgtctcactgccccacttcctcaatttgctctctgggatcttcccccaaataaatgacatgctcccaaatccttgtctcaaggtcttgttttaggaggaaccccaggcaaaggtagttacagattttagagcaggacttcctcctgcaaattctgacttcattacttacagggattttttttttaatactttaagttttagggtacatgtgcacaatgtgcaggtttgttacatatgtatacatgtgccatgttggtgtgccgcacccagtaactcgtcatttaacattaggtatatctcctaattctatccctcccccttactcccaccccacaacaggccctggtgtgtgatgttccccttcctgtgtccatgtgttctcattgttcaattccaacctgtgagtgagaacatgcggtgtttggttttttgtccttgcgatagtttgctcagaatgatggtttccagcttcatccatgtccctacaaaggacatgaactcatccttttttatggctgcatagtattccatggtgtttgtgtgccacattttctgaatccagtctatcattgttggacatttgggttggttccaagtctttgctattgtgaattagtgcctcaataaacatacgtgtgcatgtgtctttatagtagcatgatttataatcctttgggtatatacccagtaatgggattgctgggtcaaatggtatttttagttctagattgaggaattgccacactgtcttccacaatggttgaactagtttacactcccaccaacagtgtaaaagcattcctatctctccacatcctctccagcatctgttatttcctgaatttttaatgatctccattctaactggtatgagatggtatctcactgtggtcttgatttgcatttctctgatgcccagtgatgacgagcattttttcatgtgttttttggctgcataaatgtcttcttttgagaagtgtctgttcatatccttcgcccactttttgaagtggttgtttgattttttcttgtaaatttgtttaagttctttgtagattctggatattagccctttatttaatttttattttgagttcaggggtacatgtgcatgttttttatatagataaacttatgtcatggaggtttgttatacagattatttcatcacccaataattaagcctagtacccattagttatttttcctgatcctcttcctcctcccaccctctaccctccaaaaggccccagtgtgtgttgttcccctctatttattcatatgttcacataatttagctcccacttataagtgagaacatgcagtattcagttttctgttcctgcattagtttgctaaggataatggcctctagctccatccatgatcctgtaaaggacacgatctcattcttttttatggctgcatagtattccatggtgcatatgctttatcaagtctatcgttaatgggcatttgggttgattccatgactttgctatcgtacagtgcttcagtgaacatacacatgcatgtgtctttataataggatgatttatattcctttgggtatatatccagtaatgggattgctagatcaaatggtattcagacaagcaaatgctaaggaaatttgttaccacaagaccttccttataagggaagcattaaatatggagagaaaagaccattatttacagtttttaaattaaggaaatgattaaacacttcattatttcaattttctcatgtctaaggaaggtatgatgataaaagctacatgatattttttgtgaagcttagctgaaacagtacctgtcaagtgcttctagaccattgcaagttttcaataaatgttagcttttattattattattattaatgtcagcctaccttaaaacttctttaaatagatggcatgaacagctgtagataactgcagggtgtaaaaattctggcagctttttttatacctgtttaaactctttgagcttaacgctcttcaagttccctgctggcctgtaagtaatagaccaatgtcagtggaggagacatgtagatgttaagaatgaactaagtttgtaaggtaaaaagccaggcttcctatatgcctcagcagatggtctgataaggacgctgagagagagtatcatgaaatagaagtgaagtggattaacaagaaaatccatgttcctggcacactaaggtgataagtaaatggttttctgtggctttgctaaaattttgaaaaattcagttagcagcaccgttgcctaaacatagtatggtatgttaagaaggaggattctaacaagcacttgttaagtgcctattgtaattaagacaaatatgatttggtttgtgctctcaagtctggtgggagagataggcatgtaaacagatgaattacagcacgaagtgctactgctgcaccaagacaggcaaataattcacttaagctaaggcagggaagaaagaaggaaggggatttttatatacttttatctgcgctgaaggtggctttacagatgaggaacccgaaactcaaagaatgtatgtcaattcattaaggcatgcagctgctaagtggggagccagcatttgaatcaaactttctttccccaaggttgtctccatcatgccaggctgtagtggtgacaggtggaaaggtgtagtgagccatcttctaggtatatctatccctgagagcaacaaatcctggtggttctctctgtatatagtcacagagctccagggcatgtagtacttagaattttgtttttgctcattgcacaggaaatggtatgaaactgaggtaattcatacacacataatttgaatataaagaagaaaatgatagaggcatctggatgacctgatatttaatatagtaaaaggaaaatgttttcctaagcaaaatgagtggtatacaatgaataagttgtggtcaggaaccatgtccccagagttttggcttttatcctttcattgattcacaacatgaatttttttttcctaaatatccttcactagaaggcagaattaatcaacctttgtaatttaacagattatttggatacaaaactaatgatatttttattcaaacatgtcaagaccttggggatatagcatgggatttggggagcaggttggttgttgggggcagtcgtctaaagaatcagtaacatttgagtgcctaaaatattaattattgtcctaccagcaatactgttctctgtccttaatgatgaattaagagattagaaaatagtaaaaaaataaaaacaaggacataatttccatgcgataatgataggactttgtgatatcacatttaaaaagtaggtgacttttatgagagaggaagtgaggaaaagaagccagcatttattgaatgcttgctgcaggcttctgtgccatgggtattaatagtcccattttacagatgaggaccctgagaatcatatatttagtgtcaaatgctttacctaaaagggcaaaagtataactagaacaaaagttcaatgcttaactctgaaaaaatctgttctctttgctacagaccatgccatcttggtgaaaatatcccaaaagatctggggttgagttacagtgccaaaggggagaggaatgtaatattgcaattagatgatgagagattgtcttaggaacactgaagtacactggcaaattttgggaagcagagataaattatgttgctaaaagccaaggaaggctgggcgcggtggctcacacctgtaatcccattactttgagaggccgaggcaggtggatcacctgagatcaggagttcgagaccagtccggccaacgtggcaaaaccctgtctctactacaaaattagctgggcatggtggcaggcacccataatcccagctactcaggaggctgaggcaggagaatctcttgaacccgggagatggaggttgcagtaagccaagattgcgccattgcactccagcctgggagacagagcaagactccatctctaaattaattaattaattaattaatttttttaaaaagccaaggaaatcatttggctagagagtgtgagcttgagaattggatagaagtaggggaagttaggctctgtggcactgggtggtggaaagtctgcagtcagcactttgatcaggtcaaacccagtaatatttttgaactcttatttttctctgtcaggtgccagcaagcaaaactgagtaaggaaataatagtttatggccttatattttagttagtttgagtacctgttgacaggtggtccaatttttgtgtttaatttagaagaaattctgaaggatgaggtttaataatcacaattgaagtagtggatatgggatcagagtctgattgcattggatacaatattccaagatcactgaatgatacaactcctgcaaaaaggatgctatgacaatataagcataaagccgcagggaagtggacagaggtcttaagggttggaaaaaggagtgggcacatttgtgaaatgtagcagagctatgggatttggactttgcaatgtacttgtacagtaggactaaagcagacaagcatagaatgcatgccattaattcttagccttgaggcataccttctcaataattaggagaatgaaaagaggtgttttttatatatccttccacctttatatatattttttattgttcaatgaagtagaaccctgtataaagaggagttcagggaatctattaaaaatccagggtaccttctatgtcctagtcagagttcttggagttgttgaattataaaaatatgacatcccaacacacactgtagggatcaaaacctaggtgtgtggcaggaagatagctcataggcaattccaatatttgcagttgaaatttggcatgaaacactgacaatttgcatcgtctgtccatccttcatgagctgatgatgcccaatgcttgtctcacatggcaggtctcacttcgtactgaaatgatgaagttacttctctgcctccaacactagattgtgtgttgcctgagggcaggagcaatgtcatcctttttgactttctggcacttaaaacagaatgtggctcatagttggaggtcagtacatatttgaatggaagaatgcatgaaaatataaacgttagactcttcccttatggttattgttttagtttataaagtagatgtaaatatagcccaagataacatagcaatttggcaattctccatgaattttctgtaatagaatatttcagtaagcacagtatacttcctgttttaactttgtggctaactgatctttagttatttgacagatatttttctggcaggcaatgcgctaaacattgggggttctctgcaactgttttttattttaagtggtaaagttgctcttttaattcaaatttgttttttaattgacttataaacttgtatgtatttatagtgtacaacatgatgcttcgaagtgtcaataatcaaatggttaaatctagctaatttaatcataatttaaatagctagatctaaccattttgttattgacacttcaaaacacacaaacacacataatgaaatggtcaaatctagctaattaacaaatacattacctcacatagttatcatctttatggtgagaacatttcacatccactctctgagcatttttgaaaaatacagtatatcatcattaactatagtctctagactgtataatagatctcttgaaattatttctcctaactaactgaaaatatgtatgccttggaccaacatctccccactccccacccccaaccaccccagcttctggtacccacccatcttcagctgtttgtaaatacctacggttgatgaggaaatgcatttgttgaaatatactgaagcctgtggattattgtaataatccttttatgctatcaaagatttactgctctttgagcttaccttagttgggtcttgtaaattgagtgttatttgagaacagaacacaggagggcaccagaggacaagaaaacgacaaccaaaaaaaaaaaaaaaaaaaccccaaaaccaaagcactgaacttctggctctagaatagagaccctgctaaatgtatcatctctcagcagtccatttctattaagtcttattctttaaaggccatgaggtatttgtaaacacgagagctttccaaactttcattaaaggaaagtgtccctttcccagacaatgcttccagctcagtcagatgcccaagcatgaccagaaggagacatggatgaagagaacccagggggtgtctttgcacacatgatgctctaaagcattttcagatctcctctatgggcccagcaagagtgctgtttctgaggaagaaggcagattgctggacggattcacaaaccacggcagctccaactctcctaccgatgcctttactccaggtgcctcagccagtagcaacaggtctccctgttggtgatacccaagggcaccatttaagaagaaataaaaaatgatgagttcatgtcctttgtagggacatggatgaagctagaaaccatcattctcagcaaactatcacaaggagaaaaaaccaaacactgcatgttctcactcataggtgggaattgaacagtgagaacacatggacacaggaaggggaacatcacacactgggcactgttgtggggtggggggagtggggagggatagcattaggagatatacctaatgctaaatgatgagttaatgggtgcagcacaccaacatggcacatgtatacatatgtaacagacctacacgttgtgcacatgtaccctaaaacttaaagtgtaataataataataataataataataaaagaagaaatagacaatgggcttaagtgttcactcacctcctgtgcttccctgggcctacggttatggctcctaggcatatgggagaggttgagtcagtcactgtggcttagaggctgcagtgccttatcaatttctggcattgaattatgactagaatttgaaaaacatcaaacatggcttccatgacatcatagtctcagctcagtatgtcactgagaggttgtagtagtttgcagatgacagtgatcaatgaaaacccaatttatttgactcaaagggctgtggatatatgtacgtgaaaatgtattctacagccctaacctgctgcatctggctctggaattccaggtccacatttctgagtatctgctagtcatttccatgtatagagccatcccttggtatctccaggggactggttccagaacttcaaaggaactcaaatttgaggatgctcaaatccctgacaaaatggcatagtatttgcatgtaacctatgcccaccctctcacatactgtaaaatcatctctagattacttgtaataaataatacaatgaaaatgctatgtacacagttgttactgtttcgagaatattgacaaggaaaaagttctgcgtgtgtttagtacagaggcaaggttttgagaatattttaaatccagagctggtcgaatccacagatgtggacccctcagatatgaaggatcatctgtttatcccaccatctcatactcaggatgtttaaaatagagctaatagctgtttctttctcaaacccagctcttcttttctttgtttcatctaaattaagtagcaagaccaagttttccaggctggaaaagtgtaagtgatcctcaactttgtccccccaccttccattcctatcattcagggggtcacctcaaccatctcttctatttatacctttcattcatttcactctgctatagagcattttgaattcaggatttatttacctcctttctaagtaagttgaatggcctttctgtgctttttctgttctggtcttcacgtaatccgcttcacattctttttaaattcacctttcccaagattcatcattgcttacaggacaatgtccaattccttagcattacatgcagtccatctatctttcctaccttagctctcacttcacagctcataatccctctcctccccaatgtacacaaacacacccacctttccactgtggttcatcttctggctattggttatattttgccttcaattacctctgctggatatggaatagcatagaagttatgcacatgggccctagaactaaactaggggtctgcaaactacaatcagcaggacaaatattccccaccacctcttttcataaataaccatttattggaactcaccaaggaactatggagaaacaaggaagaatttcactataaaagacgccagaggaaaaaagagtacatattgtatggttacatttatataaatctaaaaaatgcaaactaatctctagtgacagaaaacagaaccctggctgctagaggagcagggagaggaagggagtacaaagagccatgagaaaacttttgaggataatgtatatgttgcttatcttgattgtgttgatgttttaatgggtctactcatatatcaaaacttataaaattgtacaccttaaatatgtgcagtgtatcatgtgtccattatacttcaatttaaaagaaaacatggaaaacattcagcatccagtgtccccatagcctcagccacagttagcccgaagagttgcttgtgtcttgatagagagaccactgaagtaatttccacagttcagggttatcattccattgctagttctaagaatcttacccttttcatgcctttggtctctcatcaaagatgtaggatggctggacttactaatcttcaaggcacttttcaaatttctagagtctctctgtggggcaaagtggctcacgcctgtaatcccagcactttgggaggctgaggtgggtggatgacctgagatcaggagttggaaactagcctggccaacatagtgaaaccccgtctttactaaaaatacaaaaaattagccaggtgtggtggcaggcacccgtaatcccagctactcgggaggctgaggcaggagaatcacttgaacccaagaggcgtaggttgcagtaagtccagatcgtgccattgaaaaaaaaaaaaaaaaagaaacaaagaaaagaaaagaaaaagaaaaaaatttctagtctctctgatctccatttaacatgttcagtctacaagtattttggtggtacctaaacttattcaggcagtatgtctgtggtctataaatgtacataccccacctttgctgtagttgatgcctctgctgctgaaatttgtttcttttctaagtgttgcatccctctttgaaacagcaggggctcacctggcaaaacagtcctgtaagcagtagtggagaaacttggctgctcactgttcctgttttgagtaaattacccttcttaattgaacattatatgatttggcttcccaaatttgtgttcttcttttcaaaaatctaacagtaatagagtgtatttagttaggttcaaaatcatattttttaaaaagaaatgcaggaaaaaattcaaaggatgtttaatgagaatatgatagactttgaaatggaagatatcaccaggaaattctccatttcttaggactatataagtgacactgacttcacacagtggttttaaggttgagtgtactgttacaggaatatgtaagctgcttaaaacatttcacaactcatggtcagacaatgttcctttgagaggaaaattcactggcgtttctcaaaaacctgactgcttaaaatccaagtgacccaatgctggccttgcttatttctagggaaagttgccttagcaacctactagcattaagttgcttaaaggaatgtgtgtttaacattgttataagccagaaacagagaaaacagttaacatttagacaagtgattattactggcatccaggtaggctgttggaataaccaggatatgagttgctaatcgttcatttattaatcttcatggaattaaatacagaaaggatgaatacagaggagatcctgtgctggacacattctctgtgttagttcatttattcgtcaccatatccccttgattaaagtgatgatgagtctttccattttgtaacttggagagactgaggctgagagatgtttagatgtttgtccaaggtcacacagctagtacctgctggagcagaaatttgaagccatgtctggctcattcaaaatcctatgttctttctcacaccctgctggctcactacttattgtgaggcatttgaatgatcattcagctatttcctttacctgatgtttttagtttgctggcttcagtttcttagaggcaccctattgggccacatgagagattatagaattatgttgtgatcatggtgggctattatctctgcaaactctcctgacaccatcagtgcaccaggaaggttggataatcctacgtggatgtggagaaatctcaacctttttttatttgacattaggatttttttttccctctaggtggtgttttcactgactttgtggattgcaaaaagttgagtttattttagtttaacagtcaagaatgtggttctttaggacattttctctttagtgtgcctggagcttctaaatcttatttaaaccttctttttgaaatagatgttgcatatctttggctgtaagaggaagtcaggacttgttctctctgcttccagacccactccccagccatgtagactttatatttgaaggtccagagtgatttttcttttttttttttttttgagatggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagagtgatttttctaaggcaataatctgaccctgtcattcccagcagcatgtagaaaatcaccttgacactccaggtacattcaagtgggctgccccagaggtcatggaacaaaaagcctcctagaccaagctaagatgtgaaattataaattgtttattaaatcaatttaaggtacactttaagcataaatcaaggggaaagtgattggttcaataaacacaggagagtgtgcaagtgggatagaaagactaccatatctcaatccttggttacacaatgttcatctaccttggttccctctctgccatattagtcttccctgctgatgaagtagttacaagaaccagagttgagattaagaaagggatacaacagctgggaaacactggtcctgttacaccattgccctcctggggagacacaagggcaagtatatctggccatagctatcacttgccaattagcctggtgactagatatatgttttatctctatgtatcaaccagagcaaatgtggggccagaatgggaccaaaatggatgtcaccaatgggttgaccagtttagggatgaaggagtcaacagagattgtctgagcttcataaatatttaaggtttactctgtactttcatccctttctatggggaagtaactctcttatttcatcctttttatctttgttcagcacacacgtgctctttttattttctctatgtctcacagctctcagagattatcaatttgctccctacgctttaatccattctataagttccatccaactttttgttgcttgctatgacaaaatcgaataatcttaaataatgcagcaaacacacgttgcagcctgtttaagatattttaagagttctttttgatctaggagataaaacacaaagttttcagtacagcaggttcttgtaagcaggttcttaaaatctcctcctggctacatctttagactcatttcctacctctcataaaaatgccctccactaccctacgacacggaagtactcgacatttgctgaacttgcatgctctcttaatctctatacgtggcagtttttaaaatctcttgtctacctggagcactagttctgcacattcattaaaaagcataagctttgctttctctaacaagtattacttgaacaccactatcttcttaaccccaaactcagacccaaatgtgcatgtatatatgcacacacacactcccaatagcttctctctttccctgtgttccttaggtataatgcaaagaactcatagtagtattaaagcacttaaaacattgtattacatttttatatcactctctactccattagactgtaagtaactttgatccagggatcaaaatatatttctccttttatctccagccactagtcaatgtccagtgtgttataaataagcagtaaatatttgatgagttgttgagttaatgagtaataacaaataaatgttattgtacaacaagttggcagatatttgttccttgaatagaatgatttttataattgtcatttacaaattcagtttagatgggatatttttctcttatttcttcccttgaacgttttcccccaactaccgtgtactcccattactagatttttttataaatcacttaaatatgtttttgtaaattattaatagcagcaagtagtgctgatctgttgggcacctaatgtgtatcaagctgtgaattagaacttgtcttccactggtcccaagagagctggatcagttcacaaccctgcataaatggtagctaggattatgattcagtaggagcatatgtagcctcaagcaggataattagttgtaataagcacataaccacattttctccctgtttctgtgttaggggatggcagtcaattcacactttgaatttcaatgtccataagctgcatttaaatacattcatataaatgcatgtcaagtaactaccatgtctaggccttggactagattctgaaaaaaataggcacaatcactggcctcgtggagttcatagccagcatcaccttaaaatcaatgagaagtagaaagtcaggttattgagaccaggatgatctacgctgcatctaactgggggatattaagttctcacagacattacaagcttatcccagtcaatataagctcactgtataatcaactacctccatatacaaatgtcccctcctccagtggcatgatctagggctggcagggattcacctttccttacccgtggtgcttctcaaaattcccctgctgcctcacccagccacccccattctcacccagtctaagtatcagttccaagaagcatttctagttcctctacccctttgttttccgcaaaccttcacatctgctccctcagaagcaccattggttatggaggtctgatctgaagttctacccatcactcacacattcatcatccatccagaaggcagttttatataaacccagataagcttggctttgcatctacttagtagctatttacccttggctgagataacttaacatccctgtttcttactgctgtcatctgtaaaatgggataaaaatgcttacttcccagtattctggggattaaatattaagctccagtacaaagtgtaacaatgactttatgcgtcattatccccgctggtctcccatagctgttctctagcacccctgtgccatctttgggattgtcgagttagccctgaagtggcaaggaccctatttcagtgctcatatttaaaaagcaccaccatcagcaaaaggggtgtagagaggaggcaccatttagaatcttggaaaatctgaaaaaacttgcttctaggccagagagtagagagaactgtgagattgtgtgctagccacagtagaccaatgttggattggagatgataggtcgtcttaatggaaagtgtgatggggagccaatgtggcacagtagctcagagtgtgggctctggagccaacataagaagagttaccctaacagaatatagaccacagagttcttcccttcaagtatggattcatcatacatccttcaaacctgccaagtacttcactttctttctctctaccaacctgcttcttaccaaccttctaaagtcctgttcttgattcaccctaggctcacctataaccttcagaagccctgtctctgactcttaactcttcctgtcttaacactgagcctctactttcagctttgggagccacaatgagtgtttcagagctgaagaatatctggagcccatatgtcagacatgaaagatttggaaaaacagaaataaaaaagttccttgaagtatttgaaatgatttattcaagtagggttgggacctaaaaatttgccaaatatatcataatgggggagtagtaccaggaacgtagagaaaggaagagaaaaattgatctcatagaaataaaacgtagaacagaggatactagaggctgaaaacaggagggggaaaatgggagacacagagagatttgataaaagacacaaaattacagctagatagaaaaaataagtgctagtgttccagagagctgcaggatacaacaatatacagtttcaaacagctagaaggagcatactacatattaaatgttccccaaacaactaatgataaatatttgagatgatggatatgctaatcaccctgatctgatcaatatatattatatgtatcaaaacatcactatgtaccctgtaaaaatgtacaattatttttcagttaaaaaaggaaaagaaacaaaaaaataaatattctgagaagatgaccttaagagagatgttggaagagagggagggttgggaaaatgggagatgtctgagaaataccctagaggaaatttgaaatagaaaaacagagctgaggaaagaaataaagatgaatcaaaaattaaattggagttatatgatggttcagggagcaacacatgtgtagagaaggaaatgagaggctggaactttggggaatcccagagttaagtaatagacaggggaagaggcagggaggggaggttgctcatgaaagttcatacatgtgggaaaaccatggacagccatgtcactgaagatgggagtggctgctgaagcctaatggtgatgaagaagactagaaaatgttccttatgcttggcgatttgcagattattagtaaccagatagaacagcagagaaaataactagctgccaaaaggttggtggggagggcttggagggcagaggaacctgggctcagcagcagtcaagggggattctgtgaagtctggggggagaagcaccctggtgggacactctaaaatgtcaaggtgaatggagaaagcaagggaaagaggcagggttatgaggagggcttctgtgagtggagtgaaatttaaggtgcctaaagaaagctaacaggaaaagtctgaaggttgagaaaagaagcaagatcactgttaaaaaaaaaaaatatatatatatatatatatatatatatatatatatatatatatatatatatatatatctcaaagaatctagaaaaaggataggaagtggagtcagaggagagtttagtcttggacaaggtggcagggtccttactctaataacagaagcaaaactgtggattaagcttataaggaagggatttcatttatttactcaacaagcatctgagtgtgtagatgcagacatgggcattttagacctggttttcaaggtgcctccaatctggttggggatatggataactgaagaattagtttgcaacagcatgagataaaccatgagggatgctgactggggtgttgaagggtgagaggatggcaggtggtgagagagacattccagagtttccttgtgagttacaggtttggttaggagggaagtggagctaactgttgaagaatagagattggccaaatctctggaatttcagaagcatcaactttgggaaacggaatttgctaatggagtggagtctgatgcagttcttcacttattttcttctggtatgcagaccaaaattatctgagaatgatcttttcacttctggctacaaaaatgcaagccaccagtagaaccacaggcaccagtttacagtgtagagagcactggactgggagtcagatctgggttgtacttatgtggtcatgggaaattccttcccctaggtgcagggactcaggattcgctttagtaaaatgaagggttattctttattgttctcagaaaggtggtttgagaatcacctgtgtggtgggctaagtattgtttcctaaaaatttgatgtctacccggaacctcagcattgtgacctgatttgtaaatagtgtctttgcacatgcaattagttaagatgaggtcacactggattatggtgctccctgattcctatgatggtgtcctcatcagaagagggtacacagagatgaagcccatgtgaagacaaacagagagtgaagtgatgcttctgtaagccaaggaatatcaaggattgcaggaaacccccagaaactaggaagggacaaaaatgattctcccctggagcctttatgacctgctcacaacttgattttagacttctcaccagaactgaaagataacatattttcgttgaaagctactaagtttgtgataatttgctacagcatccctaggaaagtaataccacctgcatccggaatatcaggaatcttattaaaatgccacttcatagtatccatcccagatcttctgaatcagaaatactgagactagagccctgagatttaaactattaacattatttatgtttcttatgaagttttaaatgtgagaaccactggcctaaatgatgccttaacagctctgaacaatctgaaagttaaaatgacaggactattttatgcatatagacgacatctcccccggtgaagtgtgttacttcccatcctataggtatcacaaacagaagtatttattttattaaatacaaaaagaaccagatcgcttccaaactacatgcttctaaacactttcataggttttgtgttctggcagcattttaaagataaaactattaagggttttattttttctggagaggtatttgtctctgagcagtttgatgaatatttaaatttcttttaatctgtgttctcccatcattttctgtatatgtttctttcttatctcattttatctggccttattttttttctctgcttttattcattttctgtgtactcagaaattaaaggcatatccattgtatgtttttatttaatagttttttactctttatcctgtacggcctgtggaaaatatttcactatgaggattagtcattgcatctctgaaccatccctgatgcatctcttggctaatggaggctgtatagtgtagtagttaaggacaaaatggaacgaggctacccaggtttagttccagcaattaggttatgcaacattgggcaattgactgaacttctttctgtgtcagttttctcaagggtaaaatgtggttgttaatgggacccatgtgttagtccgctctgctcagttatgctgcagtaacagatgcctccctggaatcctagtgacttaaatgagcagagctttatttcccaccggcattaatattcatcctagttctgctgcagtgcttcttcatgcctcttcatttctggaccctgcctgaagaggcagctctgatttgtcgcatcctggatttgtggccaagggaagagagctagcagagccatgtggtggccctcagaccttctaagtggttcacactatttctgctcacattttcttggctgtgaagcacataaggcaaaatgcctgacataagaggcagaaaatgtaaccctccagaaagggtggacctattcggaagaggctggtaggaaaagacagcaaatattgtcaaaaataatgtaatcaaccacagcaactttatgggattgacgtgagtattaagtaagttaacataggtaaagcacttagaatagtgtcttatgactattgtctggtggtctattattaacggggtcttgtgcaagtatgtgaagacattaattctttatttgagaatccaatgtaccttccaaggaaagtgctatttagagttgagaaagatacagaaatacaggtcttggtctatgccttatggaatctgtatactcctccatgaagaatgtgaagaggaacagacagttgatgacttccagatggcctgagtgcccaccagcagggtatctagtggacacctctgtacctgttcttccacatgattggtgtttatttgttcaactcccccagcagactctaagctcctttagaacagtgagtgtatctttttcatcttcgcaccccagaaactttcacaacacctgtctagtaggtcatcaacttttaaattaaacccctccttctttatacagtctgaaagtggggtggtaatttcactctcttaggtaagaacagttttcttctgcttgatgccccatgttaatgaggaactcagggtgcatggaggaggcagtcagcagtttgaagtttacatccatactgtgcccaaactgttgcacagaagtatgaagacagcgcatggaaattagtcctgtttgccaacatagtcggttttgcatgcgtcatacatggccaggcttgctgtattaagagccagctgcatttaagtcttacttaaggggaaacaaatacatttgaattgaaatacacttgatttatttttgttgatgttctagttttaattattttctctatgtgcatgtcttgcaagttttatttttgtggggactataaggatatgatatttccagggagacgaagagctataatttctcaacttttcaaacctacatacatattattttaggaaggacaaatctcatcatcttagttaacaagaaccagaatagagtgatagttctgctaatctggcctcctgggtcttgcagttgcatacaccagatgctaagaggataagacagattagccaggagtaagaccattctgtgtggcagctacctctgtccacagtgggtgatcagctaatgccatcaagctcataagctgataggccttgtaattaccatgccaaagaggctgcaaatatccctcttttcccaattttaccttatatttagtactttctattgtaggaaggagatgctgcaaacaccatggaggttgatctgaaaataccgtattcccagaactctttgtcttgggatacttctaaaatccaatgactgtatcttcatatctatacataaagtcccccatccagatgggatattcatccagaatatggcagatagaacctgaagggtctttgggtatcaagagcatatcacttagcttcttacttgaatagacttacgctatttaagaatgatcgtaacctcattcttggcagtagagtgaattagacaaattaacaaattagagttcccaaaagtcctccatggttcagagtgaagagctatgtgattgtgcttagagacctgtgctacttcctcacaaccccaggagtctggtcagtttttggtaatttacaaccatggtccctcagcctgccctgagtgctgacagcagactactgccttctgtactctgtgggcttcatggactctaggtgggtatttaggttaatgggaagtgatctatctgtggagtcaggacaggcagctatctaggttaatgggaagcaatctatctgtggaatcagaaagactggattctttatttaatttcacaattcaatagcttgtgagcttgtgcaggtcacttaacctcttaatctcatcctaggtaattgacgttacctacctcatgcggttgctgtaacatttgagttactgcatgggacatgattgagtgctatgtaggttttatcttagtttgagttcccttgagagcaaagcctgagacaaagacttgggtgagatagtttttctggagtggtccccaaaagcagaagtgaaggagcagggagagtaagcagtgcagaaagaaacaccagtatgagtgtccactgtcaagattcctgctctaagcactgcataggtgggagagatgaaggtgttgccatgaatgcctcccaggattttctgcttaaaacataggaggttggagtatttattcattggctcccttcccctccccattctttgatatttacccctagggtattcttgccctcactcccatttcttggttgctctttcttgcaggcagggcaggcaccctagctttagagaaggcccaagggctggccatgcttgaagtgggggaccatcaaactgtctgagctcacaataactgtcacctgctgcagtggctgaaatctgacattggctgagggaatatgatgccaggcggcacgtgatgcagggtctgctggaagcgcatacaaatatgatatttttcatactcactttcatttacaatatacacatttaacttttttttttttttttttttttttgctttattaataggttctgtatgctaggcctgtaccctggtcttacaaatactttaaagaaagcccaggttatactcttcattatcctcctagaattagattttctgtttcataattagcaatagtctcccatatcctccatgccctttacccagcctcaccctagtcctctttcagtcctgagacaggacaactcagggatgtaaacatggagaaactgtgagaacaaaccagagaggaaggatttttcagacaggctgactagggtttgagtcccacagctgtatgaccttgacaggtcacagagctttgctctgtctcttgattcctaaagctggggtatagtagatcagctgcatgctacaaaactaaatgagaccacgtatgcaaagcaactggtacttctttatatatggtactttcattcccctatcacttccccaaaaagctgcattttttctggccaggaagaatatatattaaaaggaaaagtagtgacttcatttatatctatctgctgcctgatatctttcagctccaaatttgtcaaattcactctactgccaagttccttctgctcctcttccttctccccctctaccctccataaatttactctcctttaatttattcatccatttctatgtattcacttattaattcaattatatgtatttactactatatggaatgctttcctgaatcggttcaatctgtcctattgctaaaatacagtctgcagctctcttcagctccccctccatttcttctctccccctcaacccatccactcatttgtttatttaatttattcagttttatttatttgctcactagtttttttccaatacattgaacaccctcttggtgcaatgtgccatgcttagttgttggggattacaaaggtagaatattctacctcaaagggcatagaagtgaatttttttttttaaaaaaaaactacaatacaaggaatagagtggtcatttgcaaaataaaatttttattgaattgctgaagcagtaaactctcagctgggagggtcagggaaggctgaggagggatggctgcagatagaaaggttataaaagtaatagagggagacaaatgtaagctgtattttgcattccttgattcctatttaaagcaaaatattaattaatattaatgtactagacctttaaattcataattggatatatatttttttctgcatgctagggcaaaaaggtcaattcacaagaatacagacttaaattagaaatgtattaggggatggtaggcagcaggtcttatggcatatcctcgttagaatctctttagctcaatcacattcagcttcaaaatctgtgactttagtgataaacagtaagatcacacgatcagactcaaaagcactataatacctaaaaatcattgtaagaaatctaatttgtattaatcataccattagaaaagtggagaaagtttcagtatctgttataaagtttttttaaaaacaagagtagaatcaatatccacaaaaggatcttcctgcctatccctgagaaaattgcccttatctcttgaaaagtggtttcatggagagagattatcgcaagaaagcttgagcctgtccccagcttaccactgctgagcactgctgtaaatttatggcttgaggtagaggtttggcaatacattggggacaatattctttttcatcttctgaggagccatttgtttctttggaggtatatctgctccagattcattccatttcaaaattgagatgctccattctctcagccaagatgaatgggttcattttacactgtgatcacaatttagagatgctattgaatgggctgccagtgtttgctttgtaatgttaggggcactcttttttctagtcttaaggcataggttacagcacataacagaaaccatgcaggaaagacaaaaagaagaaagagagggagggaaggaaggaaggaagaaaaaagaaggaaagaaggaaggaaggaaaaaaggaaggaaggaagggaacgagggaggtgggtgggcaaatagcaacacccaacaatcctgtatcatcaatagatagttgtggcctgaggtataaattaacactattctaagaaaaatcaggcaagcagtgaactttgattcatacgtctcagcagcaggaagctgccgggagctggttatcaagtgtgactcataggagagacacaataccagaagtagccttctctggctagtaggatcaatcatgtcttacttttttctggaatctttcccttttcagtgaggctgttttcatctacccagtttgtcagagcaaaccctaggaatcaacactgatttctctctttacttctcctactaccaattcacctcccaaaccaatctccaagtcctgttgactccacctctaaaatacatcccaaattttacaactttcatttctactgtctcctagttttagcctaaatcattttcatctcttttctttaatagcttcctaatagatcttgtttccattatttcacttttggtctaatatacctacagcaaccagagtgattctcaaaatttaattgagattatataatctccttacttaaaaccttccaagagcttccagtatgtgttgaagagctttcaggtttgtaccatgtcattaggacttcatgtgatctggactctgcctacatcaccagctttgcatgattggctccttcctaaatgcaccttctcagagaagccttctctgatcatctcatttagtatctttctacccaaccaactgctcaggacaagagtagagaagtcacctcaaagaggccttcctggaacattctacaaagtagccagtcctcagtcctcactccctacccccaactgcttttcatcgtattaccctgccttattttagatagggttgacagaactcaaccctatctaaaattatctcatgttccttaatttgtgtattgtctatcagattttctcaccccaaagtagactgtaaaccatgtaaggcaggacccgttctgtcttgtttatctttttatcctccacaatgaggatcagaatgagcatcagaatgtgaccacagtgcctggttgccttctgatgctcaattagcatttgtgaaagatgtgaatagatagtcttgcaaaaccttggcagaagtgagtaacagtattctattaataccctgggaggctgaagtagaggatgaggcacggagaaagaggtgagtagtccatcgttgaacttgttatatgtggcagtctcaatggtatgtttgcttattaaatcctgataaatattggtggcatttttagtaggttttaactagaagcaggggctcctggagggtgctcaggctgaatagctgggtcacttgtctttctcacacctccctgggagacttctctgtagaagacttcaagaaaaatccctgcaccttccacacctgttgtaggaggtatggcagctattcctgagccttaagtactccagtaagaatgaaatgaactatttgaggtgttctgccaaacgggctctaaaaataattatgatttaaaatgttttttttttccagtgaatatgaacgctttaaaactaagtttgtaaaaacaaaacaaaacaaacaaaacacctcctcaatctctgttgggttagacacccaaagaaagcaaccagaagctgaaattttgtggacagaacataaaacgcctttttcctacttctctgtcctcctcttcttccttcagtcctgttctttttccttatcatccctgcttttacttgcctgatctgttttgtctggggaggatgcctaatacaatgtgtgatgctatgggcttagtgaaatgcttgtcacagctcagctagcctagccaaaggggctggtggaagcaaaggtaagttttcttttttgacatatctttggtttccttcaaatctaacacagtccatcattttgagcatttattaaccatatcatttagatgtataattataggcatctttcactacgcctttctaaagagggtaattttcatatattttatgcattgtagaaattttggttcatgtgaaacatagtttgaagggaaatcaagttactgtttcatttacctctttgaataaatagaaagatgttcaggtaaaaccaagtgattatgatacagatctcaccccctccctccccaacctccacccaagcaaaagtttccaatggttccccatacacttttggaaacagagctttgtggcatatggaaggaatttctaccccctgcgtatgagcaaacccatctggtttagttggtttggccaggtcttagaaatacattgacaaacacgtgtatgtcaggggtaacttgtagtcttgctgcttatattgctcctggggggaataagaaattcatgtaatatgaacagtctagtttttaagaaaactgaaataaattaaaaataattaaaatccaaagttcaccttatgaaggtgtgtgcctttaataatgctcaaatatagatttttaacatacactctgattttctgtctgccaaaagagggaaaaatctgataatagctgagtgtcatcttcctccaagcaatcagcaatgcattatttcctaatattgctgtttgatttcattattggttctggcttcttaaagaaataagggttccatagggttactgtaggataggtcaagaaaaacaatctagtcagtgtatttcatccatgatatcttattccgtattccccattcaacagagaattaggccatcttctgtgaagcaaagccttacctcaaagagatggtgctaaatgagttttcaatgaggatagcttgtgtgagcatttgggtggtattattacccaagggattcattaaaggctctctgttctacaatagtaaacaattaaacactctatttttacaaagttctgcatcccagaaatcttttgcatctttattccaggcatgagtgtcattacctgggaaattcaactgaggagtgttaggtaatttattaacattctctacttagatccagcagtgatagtttaagcagcctcaagagaatcaaaggatttttttttgtgatcaatatttattacttaaactataaaagagggaaaaatacatgtaatacatacaactaatatgtacccagttgcagatcataactttcctagttattaaaaatgcaggaaagttaatggttttgagacgtttcttaagttctcactagtttcattttaaatttcagtgttttcttctttttgtctgaaccatcctttacttacgtgaatcactctttacattcattgcttcactgatgctacttcactgggtttttgcttgaataggccagaaaaagtcatccctagactacatcatcaagaacagttttgtatatttcaaccttcagcttgtgtctgcatcttgcattacttatcaattcacttttatgcctgggctacttattaggtttgtttctcctctctctttgccttgatttcccgctgagtgtaaacatcacttttcctctgtagaatgagttgaccttttgacttgattaaggataaatgccattgactctccacttctggaggccaagggttttacaaaatcccactgggacttatttatttattgtttgaaaatgaatatcaaatactattccatatcattttaatgagatggatgtgaatctttttttttctactttaagaataataagaattgttactgttggaggtatcaaatgtaactaaatagtagggcatgagaagcttcagttttttgggggttttttgagatggagtctcgctctgtcatccaggctggagggcagtggcgcaatctcagctcactgcaacctctgcctccctggttcactccattctcctgcctcagtctcccgagtagctgggactacaggcgcctgccaccatgcccggctagtttttttgtatttttagtagagacggggtttcactgtgttagccaggatagtctcgatctcctgacctcgtgatctgcccgcctcggcctcccaaagttctgggattacaggcgtgagccactgcacctggcctggtttttttttttttttttttttttacatttttattcattggccatcacattccaaagttttacagtcaaatggacagttaaatatttgtgtttgaatctgaccactgtgaatatctcaaggataccataagagctgatggacctccaaacgttagcatcactggactgagagaaagctcgttttatatctctataggtactgtcataccaatgaagcaatgttcccaaactactatgtttgtgttagtcattttccgcttatcttgtccccaatcataaaaattaagcgatgtacaaaaattgcctaaagaacagatgccaccttatagaagatgttttaaatagcccgtacttgtagcagttctgccttcatagctaatattctccacgtctttcttcacttttttctttcttattgaagcatttgcatgtagaataaagaggataaaaacataaaaaaacaaagacagatttgttttttctgagaacatctgttcttgttataaagaatccacatgatgtggtccattttctttcaatgccctcactgttggctgttgtgatggcaactgttacatcaatcttagacctgaacttaataagataatgaagagtagtatctaatcagttgaaaatacagggaaattctgttgtaatacatacattttatgtaatattgagacaaacatacaaagcaagataagctgagatgtaatctaaaatggtttattgtagaattactttattcctaagattcattgctctcatggcatcactacctaattttgagtgcatttggtcctttaggtttccttactaaatgttcaagattcttgtaaatttgggttgcccttgagctttgggtgcattctgaaaattattaaatataagtcatttgctgtgtacattgtaattaaaagaaaatttttcactttgaaactctgtttatttttcaagaggagagttcctccaaacttgaactactaccatagctcttataaccagcagaaaataggaatactaattactcaaaattaaaaggtgtagtttgaaattacctagagatttatattcccctgtataaaatgtcttcagtcttggagaggagggaggagtgtagctagtgacagttacataataaagctttcaaaattacttagataaaatatattgactctaattgatggttaccatagaaacagacttatatagacattgattattcaagcactcattaaagctcctactatgtacttggccctgtgctcagtatatgttggagccaagtatatggttttccaaactatttcacatatatccatagggatatattagccacttatatgttatatcattttatttcctagtcattttcaggaatggggctttccacatatagattgactaatccaaaaatatttaatcagcgtctttcttcatgagctcagctatcctcctacaaagagcaaacttggtctgtcttctgcttctatgtaatcttctttgtcttttaaatttgcatttcagatcaataacgatatacatcctaaaagaatgtgatattttcttcctttattaactggatcattttaatgcctctttgtctctcttgccatctttttcccctaagtacaattcctgttacccctgattctttatagggttcacttgaaccttagcttgagcatctggagcatggatctcttgagacaacttggtttattcctctatttagtggcactttatattagtcatgcttttgtcctgaaaagtttcagttttggaactttacatcatttcagtttttaggtatttggatccttttggaggatgatgaacaatgggaaaattctgggggccctcacattcccttcaggagcattatttatgatggggtttaaaacttgacagtattactattgtaatgcttactattgtgatttctatggtcgtgaatcctagtaggaccctgtgttaatggaaatgtcaagttaaggcatatgtgttgcaaagttcttttctcgtcctattggtggatactctctaaaagccagactggtgtatcatgccaaatggccaaattattctatagaaaaaatactatggtaaatttcctatatcttaaaggaattcgtctggattctaaaactttgagagattaatgactgctaactacagcttcctgtaaatgattgcttactgccattggcatttgaaaaccttatatctaagataaaagaaggcactatttttttcattactgtaccattatcctttatgtttgaattgagacttttgcatttggggactcctacagagaatccactggatcagtaaaattcgaatggactttgggtggaatataattccttgaatgctgctgggtcatgtgcaccagtgtggttttgacaaccctgatgcatgagcactactttcagaattgattctaactttggcacttactaccatccttaggcaaaggaccagagaccttgtatgcagggcagaagctcaatgacaacgagtggcacaccgttcgggtggtgcggagaggaaaaagccttaagttaaccgtggatgatgatgtggctgagggtgagtatgactatggtgaaattcgtctgtcttttctctcagtcctctcagtcactgagtgagcaaacagtgttttgcaaaaccttttattttgcatagtagaagtcacaaatcatgttttctgttgacaaactcaggcaaggctaagaaggtcttcctctgtattttacaataccttttcatcaatgtgcgttatggaaattacctactaactataactacatatttatgggtctctctccttaggcgtagagtatgtgtctggagaacagatgtagggttctacagatccttttattattcaatcattcaaaaatcacatgtcaatcatcctcccatatgccagttccttccatcagtgagtgaatcactctctagtagaagagatgggcaaaccagaaattcagaacattacaggtaaaagtaagtactaaaacagtgcatgatacttagaaggtgctgaataaggtttggtttaattaattacttatttaatcattattaattatctattctgcactacacaccattttacaaggcactgataatacagtggtgaacaaacaagcaaatctttggcctggtgggatttacatttagaatgtggaaagaaacattcagagctccacacaatcaataagtatttcctaagagtctgttctatgtcagcagtatgctagaattgcagaagataaaatggaaacagatgagattacctgtttcctcaaataatgaaccaattaagcagatcagataggactctggtatttgaaaacaggaccaaaatatataatgagattctaattttgatgggtgagattacaatttgtcaatcagaagagagaattacccatttgggctggagaaatcaggagtggtttataaacgtagatcttcagactgaatttgatggtggatgtaatttatgaaggctgaggtacaagaaagagggtatcatcaagtgccattttacatgctatatcttttttttctttctttcttttttttttttttaagacagtcttgctctgtcgcccaggctggagtgcagtggcgcgatcttggctcactgcaagctctgcctcccgggttcacgccattctcctgcctcagcctcccgagtagctgggactacaggtgcctgccaccacgcctggctaattttttgtatttttagtagagatggcgtttcaccgtgttagccaggatggtctccatctcctgacctcctgatccacccgcctcggcctcccaaagtgctgggattacaggcgtgagccatcgcgccaggccttacatgctatatcttataagtcttccctctctgatattctagagcaggacacatctatgaagcagaattcttatccatatgggaaagaagatttggggcagcatggggtattacatgaaacactgttgccatcagatctgggccctgacgttaacttgcaggacgttaggaaagttaacattcctgggccttgtcaaatgcagtcagtggcctaagccatctccatggtttcttctgtgaataagacagtcagtagccctgggggtctaatataatcattgccactaaaatattttatgcctttgagatagatatactaaacctctttttcctaatttcctcatttttaaaattgatattctattatttctatggcctttccagcatgaatattctgtaatttggggtcttataatttaattttatattcatgagcctgagtttctatacttctggaatcaggaaatatagtaagatatgtacgtgcatgtacaggtgtgtgtgtgtagagaaggatagcctgtggattaaggaagagcgtctaggcacatatccagtgcccagtaggcattagaaactgttagctgtgttaagcatatcagctcctttaatcttctatcattcactatagcctttaaaggtaagtgttcttaatgccatttaaaggaagcataaaactttgagagcgttgtataattaagctccaaatccatgtcagtgtgattccacaaaatcattctgcttgctgtacttcaaaatccatcataagaaaataatttatcttacaatatgggaaaaatataatggaatgggttggagtgaggtagggaatgcattagcttattaaagtctcctaagaaacttacaggaggtaggccacaacacttgacctctccctcacaaaaacaaagacaaacagaaccaccacaacaattacccaaaacacttcgattacacatagacataactcagaagcgggaggtgaagttcctggtctacgtgcctggagcataaatttgcattctgaaatgaacattttaaaagagatgtacaaatggttacactatttagcgcccgcagccaacctgaattaattattcaagaactgtatgaactgttggtgcatctggatcctgcaaaggataagtcacacatctgttgctcactcctctgggcttgtctctgaagggtgatgggattcacagccgcttctgaaaagcagccactagatggcgacctcaccctgatctctcctgacagtgagttcgtttcattttccctggaaaataaatgctccaaaagtatagtcataaagaactacagagctgagggtactataatgtgtctctctcagtcattattcttttatgaaaactttggaataaagctatttgtaaattgcactttcttttaccactaataattaaaaagcagggccaagtcacgaaatgccattatccagtaatttgattttttgaaattaatgaaacgctttcattttcagacgtgtccccccaaccccccgaacttcactgctgatggaagaaagcagccagaaggataaagaaatttgagaggggaaaagtgctgttttgcttatgagttacaatcttgggttgctttttatagtgataaggggttgggaaattttaattttagttcacagaagtcataaaatcaggcaatgaaactaaaatacccacagtcctcaagttattaagtagtatctcattggcttatttagtaatccctttaatgttctttaaggcccccctagtgtgtccaatttcagctagtttatagaaatgatgtaaagaataggtctggctcacaagaaatcaaaagcaaggatagaaatattcctcaaccttgtgtttatcatttattgtaatgtgattgtgttcttggaaaagcattaagttcgggtgacagttaataataattgattgatctatgtttctattattaagaatacattactataccaagcataacttgagttatactcctcagaattggggcctaatgctgcatgaactgcctcctctgcctagaacttcttgctagtacaaaaacttgcccttgctagtagaaaaatttgactacactggttcttgttgacttttcctgtccttacctacatagcatgtatagcaccaagctgtaaaaagtcattttgcaaaattttccatttaaaatgtatttctcatagtaatttttaaaaacttgacaaaataggattgaggagtgtgcggtcaaacaaaatgaaatggagttctttattgccaggcttattaggagactttaataagctaatgtacattgcaaatcattgataagtatgcagtatttgctaattttttttttttttttttggttccagaaactttttttactgaagtattttataccacatacttacacacttttaaaaaatgctgacattatggagaaaaggatttgggaccagtagagctagggaattatgggcaaaatatgaagattcttgactggtactctgtaagccttcgttttcttaacttctctccccacgtctaagggccatgaaaggtcaatttgcttcctctcagcgtttcccattattattcttttttgctgagctcttagttttgaccaggaacctcatgtgtggaaatggtgaggacccaaaccttgaccccaaagcaaatgtctcaaatacaagcccctccccccagaagttaggaatgctggctgtgctcagacccctctggtagccactgggggacatatagaagacacaagaggtggcctctacttaaaaagagcccacattctcacacaaaaaaagagaaaaacagtaagtgaaatgaccacaacatgattcaatcatttcggaggaagggagagaaatgaatgcagcataattagtaatagcgcacggtttaagccataggcactctattaaaaactttacgtgtgttgatacgtttaaccctgctaacttcatatccgttttacagatggggatctgaggcatagaaaaattcagtaactcccccaaggtaacccagtgaagaagtcttggaagcagaatgcaaagtcaggcagtacagccctggactctccatgctcatccactatatgctattgcttcataggaataggaagctacagcttgaacctggccagaattttccataactatatgtccttcgtcactctaagagctggtttgtagactgcttgttggccatcagtgcaatatggaagtgaatgtgtgacaaggaggcaaggcaacaatgctgctttagggagggtgctggatatattacccatgaattagatggagtgacattctgatactgggccatagggaagaagtacaaactccttagaacagcttctacatggaaatttcaccagttaaattctacctactgcttttcttgggcaatgatgtgaggaataagtaaaaccttttttccaaagacagttcattgtactagtaaagatatgggctttggaattagcacacctgagttcaatgtaggggtctaccatttaccacctgcatgaatcttgatcaaactgcttaacctctgcaagctaaatgtcctaacctctaaagcaagagaaagatacttctctacaattttattgtgataatgacatttcatagtgattatgcagtatttagcacagtgcttgccttatatggaattttcagtagtcttggttttggcttgttatctttctccccagttacttctctttcccctgaagtttgaaagaagcggctgtgaggtatgaatatatttgccccttaagtagaaaggaggttcagtttgcagacagcattcagaggagatgagtgaaaggtttccatcactactattgattaaatgacacatagattaaaaaaaaaatatttggttggtttggcacaggtttcaaactttcagcatctctcatgctttgcacaggtgcaataatatacttattttttgaagtcttcatcaacaaaggagtaaattcgtttagcacacagtgaagccaattctttttctttcctttttctttctttctttttttttgagacggactcttgctttgtcacccaggctggagtgcggtggcatgatgtcgactcactgcagcctctgcctcctgggttcaagcagttcttctgcctcagcctcccaagtagctgggactacaggcgtgtgccaccacgccaggctaatttttgtatttttagtaaagacgggttttcaccatgttagccaggatggtctcgatctcctgacctcgtgatccacccacctcgacctcccaagccaattccttttctaatttgatctcacatggccttctccccctcccctcaccaacttttagttgaggctcctgtgtgagtcatcctgaactcccagtttgtgttcctgggctaagctcctaaatccactattaacttcacttcttgtacttatccacatccacgctcagtctctctgctatctcaataaacacttttttttttgctatgaaaaattaattttctagtgagcagaatatcccaacccctcaatcctggagatcaattcatccagaatttctctgaaagttctcaacttgactttaaaattgtttcttcagattccttttggaacctcaatcttcaccagagattccccattctgacttcttagttctcatcttagattttttctttgtaaaataagaattagcatgactagcagcatcatcatagttcagtttctctgtttctgtggatattgactatgactccccctccccatcattttccagcccagctccccttcctggtaggagtagctatagccaatttgacagtagatgtttctttcagtcactttattaatttagagcatgcaaatttagattatgttgctttgtattttcacagcctgtctgatttttaacactaagcaattttatttcctagttatttgttagcagatttatgttgcattttgatttttatatttaagttaaccaacatctttttttcttatactaagagagtgatttgtcactagttgtcaaaacactgcatagaagctcataacatgtaaatctaatttttgtgcttatagggaatataagaaattttatttttatttttttagagacagcatctcgctgtgttacctaggctggagtgcagcctcaaactcctgggctccagtgatcctcctaccttagcctcctgaatagttagcactataggtacatacctctatgcctggctaatattttttttttaatttgtagagactgggtcttgctatattgcccaggctggtcttgaactcctagcctcaagtaatctttctgtctcggcctcccaaagtgctgggattacaggcatgagccactgtctccagccaattctttaaattaggtctgagttttttcccaaagagataaaaccaatattgagcacttaagggtatgatctggtttagtctcccagatactgaagtttaagagacctaagaaaatacaatcctccctttttttgtcactgtaattctgagccaatagagaaaatattgcaatgaggatggaaggcaaatatcattttaattagtaataacacacaataatattgcttacacccactgaacttcagaattagacagaactgcccacttgaatagtagttcagaactgggcagacatcctttgtggaagcaaggcttgctcctgtaacacccattctatggatgcatgcagtagaatggacatttctgaaggcagcttgctccagcaaagagaaacaggaggtgttaggggctgagctaagcatacacagcttctctttgcagatcatccttaatatttctgattatgtcacttcttcaggaaagttgttaaagaggaaataaagagatgctatcagtcttgctaatggagttttttcaatgtagaaggtaacaagagaggacaggaagaaagaattccccctctaatgcttggcagtagaacatggtttgttatgttttaacatgatttttctatataaatgttgaggaagccaatttctactctggccacattaatgatgtttttctttattttgttattaaaatttccagtctctttgtatttttttttcaagccctccttatcccctctgccctagtcactcaccacttctaggtaaaataggtaatacaagttctaaatagttcatttgtaacagctgaagatatttccgttgtgaatgtcagaaacccaactcaaacgctttaagcatgaaagggagtctattgccacacagtttgaaaaagccgggaggtgcctggcttgatccagagtctcaaaggacagcacagatgattctcttcatttggtaattgtcttctgggttgctagtcctctgatccctctgattttcttatagcctctagggactcaaagctttcttcttacccctccagcagtccttgcttgcaaagaatcctctttcctaagtgtaccagcaagagctctggaactgagtgtggccgggatggcttgggttgttgccagttctaagggtggtccctaaatcagccacaagagcatcactgtgaaacttgttagaaatgcagattctcaggcctcaccccagacttttgaattctaaactctgagggcctaagccccccaggtgattctgatacaccctaaagtgtaatgaccgctttttaagtctgtagtccaaagtctgtgacagttaggggggtaaagtacattgagtggtctaggctgagtagcttgattagggtcaactttatccagtccaggtggttgaaaggtcaagaggggtgggtagcttcctaaagaaaaattacgtgttattataagataaagtaacagttgctgggcaggtaaactcaactgataagtctataatagaatccttcccacgagtactaagtggagagttattacgagaaaaaatacttggtagtgatgcccaagacttgtgtgttgtgtctttacaagggtcagagcaacaaaggcctttcttcttatagtgtgtattagtgtccagtgattctcctgaatggagaatatcaatagttttatcctttagcctgggttactcatgacctcatatttccccttatatgatgagccgtgctgagcagctgcgtgacagcatgtaatttgggcaatgcctgattgaggccaagtaaggtatctaccatattgaatatttggttttcttgaactcacccaagaaagctgaatattctgtgtggaaacaggttacacccaaaaaatatacttgagggtgctgtgataaatgatggtaacttttctgtttgtacctcatttacaattttcacaggtacaatggtgggagaccatacccgtttggagttccacaacattgaaacgggaatcatgactgagaaacgctacatctccgttgtcccctccagctttattggccatctgcagagcctcatgtttaatggccttctctacattgacttgtgcaaaaatggtgacattgattattgtgagctgaaggctcgttttggactgaggaacatcatcgctgaccctgtcacctttaagaccaagagcagctacctgagccttgccactcttcaggcttacacctccatgcacctcttcttccagttcaagaccacctcaccagatggcttcattctcttcaatagtggtgatggcaatgacttcattgcagtcgagcttgtcaaggggtaagtagaagggatcacgacttatgttggacacctttaatctactgaagctctacgtaaaatatggacataaaaataacttgtctattctactccctaccctccattcctgacacattctcgcatcttccttgattaaatggatccataaaattattaggtctggaaaggagagaggctcatgatttaatttaaaggtcttccactaactcaacactaacagactttttcctatgaaatgtagccctttaaaactattgaagaaaagcttatttttgcaaaagagggctatgatttgtattgcatctaattcttgagtattactaactacaaccacccaatttataccaaaagatgaaacataaatattttaaatcctaccattagcccatatatgcaagtttttagaagctgccctttcctcaagacattttactaccatgtattagaaaatagtcaaaacaaaaaaccaaaacaaaaaccaaaacagattaatggttgatgatgaatttaaaagtcacccccttatgttttgtagtgtacaacctgtgctactttgactctggagagtattagtaggtagtgttaatgaagtggactcgatgagtatggaattatagtgaagcatgatagaataaaatctgactattcttgtaacctcatatcaagatttaaattattcctgcattatgccagtttagcatgggggatttgaagcccactatgtcagttacacacatatagccattaaaccacttcggggattttccaattattgtttttttttttttttcttcctaggtatatacactacgtttttgacctcggaaacggtcccaatgtgatcaaaggcaacagtgaccgccccctgaatgacaaccagtggcacaatgtcgtcatcactcgggacaatagtaacactcatagcctgaaagtggacaccaaagtggtcactcaggttatcaatggtgccaaaaatctggatttgaaaggtaaaccttgtaaagaaatttagtttttaatagagcttttcttacaatagatagactatttccagaggcaaaccacaggttcagagtgccatgcatttttgatacatcatccatatcctgttttaacaatgttgaattatcctgtaatgcaattttttccgtttttacttagactactcatcaagaaatggttcattttctctgataacctcgggaatgtcatgctgtgggggctgagagatgacaggatgagtgtcaaagtgtgggaagggccgtaatacagaggaaggaatataggctttggaatttcagctgaatcatttaatgtctggtgtcatcagtaaactgtcttagccttgttcagcttacatttacttttctttgcaaaatgaggataataattgttagtttctgtataggtcgtgagaagttttgatggcatgtctgtatatccctcagcatattattggtaacaagcacataaaaagcactcaataaatgcttgctttgttgacaatattgttaatctttactccatctatgatgaataaatttttgagatggtatatataaaatgaatgacacataataaatattggtttcctttttttgcagggtagaaactcaggtgcttatctcatttatgctgtcccccccccccccccccagctatcttattccttatctgatgaattatctcaagtgtatcaaactagttgacatggtcaccacatcctttactcattctcttttgctaattactttcctttccaggtgatctctatatggctggtctggcccaaggcatgtacagcaacctcccaaagctcgtggcctctcgagatggctttcagggctgtctagcatcagtggacttgaatggacgcctgccagacctcatcaatgatgctcttcatcggagcggacagatcgagcgtggctgtgaaggtacaacctatttttttcttgttaagctacagccttgttgcaagcaccaagcctctttgctgcctctgccactgcctccttcctcagttgaccagtcctgtctcattctcatttgccacgtgacattgcatcaccatcagtgttctcttgtcactggtttagtatgtcaagacatgtgccacaggctccaggaatgtatgttggcagatgttttctgagtatcacatacttgccaataaaaataaaataaaataaaaaacttccctggcattgacatcaggcttctttcaatgtgtaccttggcttccagaatggctgaaacagcactggagacttttatttatactttaatacatgatgaggggaaaaccagagattttatgtagatgtcactaattaataaaatgtttcttattttggctgatagtgactgcattatttaatgcaaatctagcaggcaataggaaaacgatgtccaaatgccatgatgatggaagggaactaacatttactaagtacttactaattatcaggcattgctaggcagttctttagtgtggtatattggaacattatgggctttgatattagaaatacctggattcagctccaggtagtagctcttgttagctatgtgacatttggaaggtgatgtaacttctgtaagctatatctttcttacctataaaacagggcaataaaacttaccttgaatgtaaggagatcagaaatacacataaaatgcctggtatgtagtaggtactcgataaatggtaggcttattgtttacaaatattattttatgtcaaacatctaataatactgcatgtctacccatgcagcacaacaaaccatgctcagcctgttcctgtagatgatccactgtctcttgagatactaaatgaattttacaggtcttcctgaatccaacaattctttgcagtgtaaacaatctagttttaaccagcagatggcagaagtgaacacattcagccttccctagtagtcttgggttggctgaaaacgtgactgttacctaacttgaaaggcaaagaagttgcctgaccaaggatctatgtaattatttcctttttttctttttgagccttttggttgagccttatggtcctgtgtttgcgcaatatattgtgtttccttgtatcagttgttaatttaccacatcaaatctgttcattccacttctgtgttcaacttcatgtatcgcttctgttcttaaacagcttccatctgggttagctcatcatcgtaaagcacacatttataaaagcttcctgtcagcttatcaggctgacttggagttatggaaattgtttccctttgcctaagagttatttttgtattttgcactagtaataggaatgttcattcctataacccactccatttttcctttatccagaaatatttcttaaattgtcttggccaaatatggtgtttgtactatgtagtgtgtgtgtgtgtgtgtgtgtgtgtgtgtgtgtgtgtgtgtataaagggacaggaggttgggaatcactaagcccttaaagcagccactttgctcctagaaatgaacaatttcattcaatcagggatttttgtctccttggcttgcttttagttcttttgtgtattaaagggcaatcctggaatagacgtagcatttggaattaaattgtatatagtgtttagaagattgtagaatggcagtaattccatttatcctggaataattaatcatatgaagtcaaatcacaatataagagcacatattagaaagcgtaagatactggtcaaatgttacagaatttttattatgccatcagttcttcagatttaaaagttaacaggaatcatccattaactctatgtcagtgttttccaatagatatatgtaacacatgcaattataaatttcctagtagctacattttaaaaaggtataaagtaacaggtcaaatttattttaattttgtattttattcaatttaactaaatatacccaaaatattatttcagaatgtaatagagataaaattatcaatattttgcactttttttcacattaagcctctaaacttgagtttgtattttatacttgcagcacacctcaacccaggggctacatgcatttaaagtgctcaatacacatgtcaatggctactgtattggtagtacaggtatacagaatacaaaaattaaggtgtaaataaataaagctatagtattggattaaaaggaggtctaagctttataaaagggtactaaaatgtataatataaagggagaatgacctcacttaagagagttttaagagaagcagtaagagcatcagcaaaaagaaattacataacgagttggggaaaatgtccctatccctatctacagctctatgtgcagtttggcattactcatcacatgcattacagagagctccgaccttcctctgagtatggttgattgttcaaagccggatattgtggcttgatggctccaccatctgaatctatggtgagtcccatgagcctaatagcactgcactctattgccatggagataattacaacggttacccactgagcattatgcctaccccgctgggtgggatgaagtggagggtgagtgctgagggaagaaagtccttgttgattgtacacaaatgacttggataattagcctaagtggccaggaaaaatggcccaaaatgggttaaggcataaattactgtcattggaagtttgtaccactgtgaataagcccttgcaagagatcccaggagcattttagggttctgtgtaagatggtggggaggtaaagggagagcaaaaaacactggagacactgcaaaaaggcatcatttttattctgaatctcttgtgtagagcatgagacccccaagaaggcctttgagcattaggtagtatgaggaccacaggaaacagaacaaatttcttaatttatcatttcttttacatagaacagtaaacaagtaggggatgaggttttataactaagaactaagaccagaatctcttcaagatatgttttattctagcaaatctagaatacacagataaacatatatatatatatatacacacacacacacagatagataagtatctgtatctatctacatttaatatatgtttccatcaaagtcattgacaatgacactttaagatccctaggtagtaaatgtgttaccttccctattatatcagacccatgacagcaggtaaaataaaaggcaaaagagtccaaaattatttttatttattttattgattgagtgagtgagtgagtgagacggagtttcgctcttgttgcccaggctggagtgcagtggcgtgatctcggctcactgcaacctccacctcccagcttcaagcgaatctgctgcctcagcctcccaagtagctgggattacaggtgcccaccaccatacctggctaatttttgtgtttttagtagagatggggttttaccatgttggccaggctggtctcgacctcttgatctcaggtgatccacccacctcggcctcccaaagtggtagcaaaattatttaaaaacttgctaatttagtactcttcagctctcaagtatgagtagcaaaaaagaaaaaaatcttgaaactagtatttgattttatgtctctgatagatgcaaagtgtataatttagatattaagtgcaatttctgggcaactcctagtcaacatttagttgtaacttgatacctctcaatttaagctagggttttaaaaaaaatcatacctgatttaatatgtggctggtaaatgtatcttcctatattgaggccagctttgctgcagaggccaaggcatgatcagctagaaatgtggtttcacaattgcagatgataaacatctgaaagaaatacacgtgctttgttttgaaactggcacgaataaataaaaatgacattagtctggtgcccttttgcctgcaactatttgggtttggatatatttttaaaattaaacaaattgagctttttggtgttcccaaatcaccgtgatccaaatgtctaattccagtgccaaattcctgggtggcatttgcaagagggcacaaggggtgcactcgagtgactctttcatgctgaactcctaatgtttagaagtatttctatgggctccatctgattgcacacacgtgtctttcagtctgaccgtgcactccctgaggttggctgtgtggatgtgagaaagctcttgttgcccttgttgcccgttgcctgtgctttgtcaagtctgatgcgcccctgccctgctctgctgacttggctctgaggaggccggctctgtccctggtctgcgcgtccccctctgccctactccccaaccccatctttgctgtctctggtgaacctgtagagcatttcaattgtctgtctgagtgatggttatgcagattgcgttttcatttctgtaatgttatcctggtttattctacctcttactaacctctggttattgttttcgctttttctgttcttttgctaacaaagttgcgttgaccaaagctgacctgcaaggtagagaaggttcttgttcccattaccactttggactgaaagatgccctgtgtaacccttggtatcttttctttagagatcttcaagctgtcacacctcttggacagcagcaattgtggggaggtggctgaaccctgtgttcttctgaaagggtgacagataacccagatcaatgcatgaaaaatagctatcaagaggagacctcatgggggaagaaacatgattccattttggggggtaccaaagaggtttgacagcatcccataccgtgactatacataaacatattaatttactctggaaatgataaatacctctccaagtagttgccatggaggggttggctcctcttaatttattcaccatacatagaaaaaagaacttggaaggaaaaaaaaggccaaggccagcccttatgccttaagttattattttctggatcagggaggtcatttcctggagcaggacatttaagtacttgggctttatgaaagagaatgtcattttctcttaactagttttaaagttttaaatatttctgggcatttgggagacactaatgtcattaaaatgtttcagagatttatattttctattggggattttggttgagcactttaatttcctgttttgtgatcgcaggaaaaaagtactcttgaggaagaagatgatctgtcattttaatcctgaataccctataaaataccacatgtgagatgttagtgaatatctattgcagaaactacttcatccactattcaaagaggcatcttacaaagtcagtaatggcccactgatcctatggtgccatgctgctatgtctcagaataacaagggaggaacaagcattttaggtgtcttttggctgattgtcaagcaggagactgagcctcatgacctctgctgagtttgcagtcagtccaaattgttagaagtagttaaggcaaaggtaacgttcaaaaaattacttttcatctaaaaagatcattgactttgctgtgactttcttgttatatgccatgtagctaaccagtacaagcgcctatctatccagaatacatccaccaatgaagactctgtcactattttaccataactttgtttttctttatcgcctcttagcagattcacatatattttaatatatatttaaattaaataaaagaatatacactagttaggacttaaagtcagaggaagctttacaatagctttcagtttcaaagtatagagggcccttgtggcaatactgttgttttagacattatgtttaattgtcaagaaagatccactatgtatttctctgtaaatggaagagagagagaagggggcaggactcaatctgaatgcaagacaatccaaggagattgaagctccttaggactggatttagcggattaaactagacaactacatctcttccctgactttactatcacgcagggtaagaactatatggattttgaattcccagagcttagcatattctctcacctagaaaatctggacatggcaaaataatctgaaagttctcatccaaaggaataatggtttgtagggagaagtgagtcattgatttctatgcctaaagtaaattgtttaccaaagcgtagatacagatttagggacatagtggtttggaatatattgatgtttccttttatggaagctgtctaggcatcaatatggttttaacattattactttattggcacgaactttcctccattcttgtaatgacttgacagtctctttgtttgtggcaggagctgctttttttttcgattatttggggccgtcttactctttccctgttttataggaaaagcttttagttttttgtttcctaacattggggtgtggactattactcacaagctggctttttcagctacaacctgtgagtatagatagtactaattaccatgaagtatgaagggtagtgaagatatatgacaaggaaatgaggcagttggaagcctagacaaaaatgtattcagaaggaaatataacaatgaggtgtaagaagtgacgtaatgagtctagatgagtcaacagcttaagtcctcttgttattgtgtggttggggtagtgttttattttttatttaaaaatttttaacttctccagtgaatgtgttgttgaatttaacaggaagttagtgtcagctatgcctgtgtatcagggactaggtactggggatgctaggatactgcagatgagatgcagtctctaacttcaaagaattccacagatgatcagccaataattacaatgcaaagtgaaaactcctatcctagagacatgcgtcctgccatgtgagcatgaaggaacacactggatcgtgtagggtcatggtggtcatggggagtgctcaggggatatcttctcagacagagtttgagctgagtctgaaggacaagtatgttttagatggatgaacgatggaagcacattcgagagcttggcttaattgggaatctacaagaagctcaatgtggctgaaataatgtgtgtggggggatatgatagcacatgaaatgggagtggtaggatagagacaggtaatgacagacttttcctgtaaggagttggactttatcccaaggatgctgtgaggaggacagagatttgggttggattttcattttatcaggatcactctgacactagaatggagaaaggatgatgcagacagaaactagaaacagagagcagattcaggagtgaagcagcatattccaagacagagggaagagacatgcccccagtgcctgttacttgacttggtcaaggaggtaaacaagtttccctttcacatgaaacctcaaagagcaagaaagaaagtgaactctttctcctgtttgctgcacacaccctctccactgctacactgttattctggttagtagcacatgtattttcacattatgacaaaagatatcaagaaagaagtttaccgactttcctggtttcaggccagaatctacatctctctaggtcaacacaggagacaggagctctccacggtactcctgtgatccacgggagggaggttgccttgctgagcagtgcagtctttgtatcagtgtaccttggacagaatgacagcttctacagaacattcagaagtaactttctaattcctttttgtttttaagaagggtattagtggaaaggaagagatttcctaaaagcctattcatggaagaaaggagctgcagaactataaaagaaatattaagattgacctgtttggtgtgaggcagatgacataaattatgagaaataaaagaataactcttttttgtattaggtgattaattagaatcttcctattccatctttaattataacttctcttagcaggttttatttctgatgtttaatgactttttttctagaaatgtaaggtgtccctctgcccagatggtgaacacgtggtcaggggatccaggatccattggatctgggtgctaagtgctggctattttgagaaagtcaatcaatgtattgggttcagatgccttggaaatctcaagattctttaaaggcattttagaacagagttagaattagtcaaacacctttagttaggtaaaggaaattttaattccccaactgtctttactatgatgaatattgtcctccacctcattttctccgaaactgaagattgtatcacattctccattgtattttttgttataaaatatagtacttgacctactataagttcctcaaaatgctttctattgtggaaaataataagagagacataaattgcagtgaacttcccattattgttcttgtgtccttttcctccacattatacgagagaggcgtacaacacaactgtgtcagtgtggcacactaccaaaatgcatcttgtttctggactcctcatcaactgtacacccaacttaagtgggaggaggaaacctgattattgtcctttctagcagaattgctgatgatctttattgagagtctccttgatgaaggcatacactaaggacttggcaggttgtatctccattgtgactacaaccttagctgatagatactgttgtctgtttcataggtgactttataggtcttgcatatgttctttcatttaatcttcacaccatatgatgcagtagaaatacatatctcccttatacagatggggacactgaggtttagagtttaatatcaccagcccaaggtcacattactagtaagtgattaaactggattttaaagcccatgacctttcgcctattatgccgtatggtgtgagtctgggtttgcttatttccaaagcagaaagagtacatagatgaccagagagtatctgagagtgtcctccatgctgactttatggtagatggttttcatatcaacaccatttcgaaaagttctagataatatttgcacaatgttagagcaaagtattttaaattacctctttttttgttgttgttgagactgggctttgaaactccttctctctctcttttaaagtatattccactgccccagcagacccctacatcagtgcctagaaaacaaggaaaagcagacagactcctcagtttacattttctaaagaatcattgacttatgagggattgtgtatcactttgaaaagagttatttgacctttgtgacccaggcatcccatgaaaatagggtgggttgaggaagaaggcttcatgctaccagccatcctctcactcttacaaataccctacctgcagcaagtatcaactcccacctctctactgtcatggaaggtgctgtgggtaaatcactttactcttaagctgtaattattctttttagatcattgaccatcaagagcagtgctgtgctagagctggcactggcacaggaatttctaggaattttgtaagccagtttacatgaggcaacatgttatggcttgaaattggctatgaggggagtactaataaaaccaacacatgttacaaatcagttttattttccttttcctggggtgctggttgttaaacatttactagtgatatatcaccaataaaaggccactggggataaagataccatgaagccatctcagtcaaccaattcccatccatggccataaccaattttatacccaacgtattatgagagggttgaagtggttgaagagaaaagggtgttagtgaaactgctccaaatgttagattttattctttgtctttttcactgatcactctaatcatgtgacctttttaaaacctctgtttgagaagaggaagccataagcatctgaacatgcttgagaagagtggttttgatgccttgcttagctttggtaaggcataggtcctgacttcaagacaaaaagcatgatcttgggaatacagccacccttaggtctctctgacaatgagattttataataagatttaggaccctattctctggcattgccttatgttctataaaatgtgacctagagtattcgcgtctcagtggattcacttgacatttttaagtgatcattgctttcttattttaaagctaaatataagtgaatttggcttcctccagttaaaatgaatagatcttatgttgtctgtaaatgactctcttcagaaaagccaaggggactcaacactgtaaatttagaaatactctgaaagctatggaagtagctttgctgaagggtccaagacatatattcagctaagtaaataggctatccttattatcaggaataccctctgtattagttagggttctccagagaggtatcatatatatcatatataggatatatgcatcttatatataatatataaaatatatattatttagatatatacatcttatatataatatattatataaaatatatattatttatatacatatgtataaaaataggaattggctcacatgattatggaggccaagaaactccacagtccgctgtctgtatgctggagaataaaacagttggattctaaagccctgggaatgggggtggcaggggcagaagtggcatgatagtgtaagttctgctctgattcgaaaagcccaagaaccaggagcacaagtgtccaatgtctgagggctagagaatatggctatctcacctcaagcaaagaaagcgaattcctccttcctctgcctttttcttctattcagaataggaccacaacagattggatgatgcctactcacactggggaccatctgctttattctcttcaccagttaaaatgctaatctcatttgtaaataccctcaaagacatacctggaaataatatttcattattattatatataatgaccaggtatctgggcatcccttacctcagtcattttgacacataaaattaaccatcacattctcctgaagactctcaactctttaatttttatattttagcagtcgagactatagattgctcaggtaggcagtaagagtctttcataatccatttgcattttcaaaaatttccctgtagggtttctatagacttatttatatgagacttatataaatacacacacatatacataaatctatgtatattcatcttttttctgtacttttttccttccacccaactactgttcactcatttttttcctataaaacaatgtaaattttaaaatgtgaaagtagaaagattaggcacttaccaggggtagaaaattaaactaaagttggaagatctctttagacagttcatggcatgtattattctgttctcatgctgctaataaaaatatacccaagactgagtaatttataaagaaaaagagacttaatgtactcatagttccatgtggctgggcaggcctcacaatcatggcagaaggcaaacgaggagcaaagtcacgtcttacatggaggcaggcaagagagaacttgtgtaggggaactcccctttataaacccatcagatctcatgagacttattcactatcgtgagaacagcatgggaaagacctacccccatgattcaattacctcccaccgggcccctcccacaacatgtgggaattaagggagctacaattcaagatgagatttgggtggggacacagccaacaatatcagcaactcttataatgctccttcccatggaagctgtggtttgttgggacaggcaaaccctttggttaacacggaattctactatgataacttcacatttaggttacaccgatagagtctaagccctttgacttaagcccttcactccttgtgattaaagttagtgaatgttgatagatcagcctcacctggtccccactcctgggtcaccagccttggccctctaaaggaatggacattgagaagacaaacttgatatggcctccaggcctgtcacttctccttttctcccttaccctctgcctgctgcaccctacatttctccacccacttcttgtctggctagaaccaggtggtgctgctttagcactatttatgaatttcaaattggggtgtttgagacataggtttggttaagtcttatttgggcaataacagagggaaagtgcattctgatactagtgttgtgagctttaggaagaaagtctatttcaaggacctacaaacaataaaaaatactctatcaactttggttttctaggccatgaagaggaattgactaaatcagtgtacacgtgctgtaagggtggattagagcagtaacaggcataaaatggttgtatcagacaattcttaatgagaagaacaatcccaccatcaagaaaaatgataggaaattttggcagccatcagaattatctgataaataaaatgataagggaatgagatgcaatttcatgttttccagcaaaccaaaagcagggctggaaattagaaaccaaagtactaacaccattgacatcttattcagtctttccagacacatttctgttgtcttgtcactttctgtagtatacaaagaaagtcaccatcttttctcaaagggatatgtgactattttcgtgagagttattcacatatcaagagcaaaaataacttataccattcctatacaggaacttcctaaggcctttggatgttttaagatattaataattaataatgacaatgataaaaaaagacttcataaatatgtaattaaacaaatttgtgctgtcttagaatgtctggaattttatgttggtttggaagagtgttttatgaaaaattatgattattaagtccccagaattgtctgtcatgcttataaacgtaacatttgatacagatttctgttcataaaattggacaaaatgagatcttcctgtttaactgaattgaaatggtatttgaaagttttccttgtaaaaaacaaaaacaaatccttacatcaagacgtcatcttttcccagttgtaggtcagaaataccttaagttactcttattaatccaatgacaccacacatgcacattccccactctggcttacacacatccgtgagaggttaggtgagtgggctgcacaattagcaagcttgggtttgagacctcaccctctcacttgccacctatggattttggggaaaattatgcaacttttctgtgtctcagtttacttttctgaagtctttgccttttgattcaatcaacattttaaaaattacttaaatttgaaattatggagatctcctatgagaaaataatttgtttctctgattctttactacttttaattatatttgcttcatcatgtgcttatgaagattaattgaattaatatcttaaaagcatttagtatagtgtctggctcataataagcactaggtaagctgtgtctattgttatatcctctttctgatttgtacaagattattttatatcaatagatgtttagtgggaagcactgttgaagcttttggtttttctcccccaagacatgtttttctaatttctttgacacactgctatgtgaaatgcatacattaaatacattgacataaaataggctctgtttaggaaaggatgtacttaaacaggttgaagtaagaataggagctcacaaaatgatcatctagaaattgttctagagtctagcccagactctcattcattcaatagttattacatactgtacttgggcttgggaataccaaagagttcttgtcagcatctggtgagtctgaaatcaaaggacacacggccaattaaataccaccaccccacccaccctaagaaaaaaatgtaaataaaaacagtttcaagtaagagattacttatgtgagctcttattggtaaattctagggataaatttttacaagaaccattttgctttaaattctaaatgaatggctttatttctttattttttctttgttatttagttctttcttttattcaataatattttgaatattttgaatagaaccctcacgctataccaaatacaatatcagaaattagagatgtaaaggtgaccaagacagacaaggcttctgcccttgagaggcttacggtccagtaggatttgaaagacagtgaggaacttaatagttctgacaaaaaacggatgcactgaccagtggaacaggatagagacccccaaaataaacttatgcattatggttaactgattttttttttaacaaaggtgccacaagtatgcaatggagaaaggatggtctcttcaataaatgatattggacaaaatggatatttacacgcagaaaaataaaattgtaccctttttataccatatacaaacatcatctcaaaacatattaaagattcaaatgttagacctgaaactataaaactactagaagaaaacgtacaggaagtgctccattgcattgtttctgggcaaggatttcttggatgtgacttcaaaaccacaggcaacataaacaaatgagattgcatgaagccaaaaaggttctgcacatcaagaaaacaattaatagagtgaagaagtaacccatagattgggagaaaatatttgtgaagtgtatatctgataaggcactattatccaaaatatataagaaacacaaacaactcaaaataagaaaacaaataccccaatcaaaaaatgagcaaagaatctaactagacacttcttaaaagaagatatgcagatggccaacatatatatgaaaaaaatgctcaacatcactcatctttgggaaaatgcaaactgaaaccatgatgagatatcaccttgcacctattaaaatagctactatcaaaaagacaaaaacaacaacaacaacaagtattggcaaaggcttggagaaaagggaacacttgtgcatttttggtgggaatgtaaattaatataaccattatggaaaacagaatggaggttcctcagaaaactaaaaatagaattaccatatgattcagcaatcctgcttctgggtttcagtccaaaataattgaaggcagtacgccaaagagatatctgcattcccatgttcattgcagcattaatcacaatagctaaaaattagaagaaacctgggtgttcatcctcagatgaatggataaagaaaatgtggtatatgtacacgatgcaatacatttgctcattttttgattggggtatttgttttcttactattgagttgtttgagtttcttacatattttagataatagtcccttaacagattgttttattcagccttaaaaaaaagtgggaaggctgggtgtggtggctcatgcctgtaatcccagcactttgggaggccgaggcaggtagatcacgaggtcaagagactgagaccatcctggccaacatggtgaaaccctatctctactaaaaatacaaaaattagccaggcatggtggtgtgtgcctgtagtaccagctacttgggaggctgaggcaggagaattgcttgaacccaggatgcagaggttgcagtgagccgagatcatgccactgcactccagcctggtgacagagcaagattccatttaaaaaaaaaaaaaaaaaagaaaaaaaaagaaaaaaaggctggaaattctcttatttgcaacaacatggatgaacccggaggatattatgccaagtgaaataagccaggcacagaaagacagataccacatgatctcacttatatgtggaatctaagaaatttgaactcatagaaatagagaatagaatagtggctataggaggcggggggaggggatggatggaaaaataagagatgttgatcaatgggtacaaagtttcaattagacaagaggaataggctttggtaatctattgcatagaatggtgactacagcaaataatagcgtattttaaatttcaaatcattagaagaatagatgttaaatgtttttaccacaaaaaagtgctaagtatgtgaggtgattgatttgttaattagcctgatttaccattccgtgttgtaagcatatattaaaacataacattgtatcccataaatataaacaactattatctttcaatttaaaagaaattaatttaattacagtccacgtaattgttattagttaagtaaataggaagacatgatgaagagtaaaagttctgctaatgggggcttccttaagtaggatagtttggagaaagctcattttgagctgaaactcaaagaataaaaatgaaacagtcatttgaatctggagaaagcacagttaaggccaagggtccagcaggaagcgcaaaggaactcgaagataggggtgggcatgaagtattaaggcagtggtccaggaatatgagcaggcatctgaaccacctggagggcttgttacaactcagattcctcaattctgcccccagtcagtaggtctgggtacagccttaaagtgtttttctcataagcttccaggagatgcagatgctgctggtttaggagcaacactctgggaatcattgtgttaggaactaaaaacaggagagggctgtagcactgtgagctagggacatatggtaagaaatgagactggagaaggaggcaggggctcctaggagctcaatcttgaaaggaggttcaaggttagttccagattgttgagaagttgaaagttctattaagtccttagtgacaatactgttgttcttggatgcttacaatgtagtcagtcttccggtactatctgattctacatggcctttgccccttaatgcaagtgaagcaaattcagtggaattgataaataacctataatccccgccctgtatttggtccctgatgaacttctgacaaatggaaaagattgcatactttgcagagtgcagacatgctcctacactcaggttttggaagcatgatatagcaaatcaagggtggttacaattcagatcaccctaacatttactggaacactttctgcatcttcacaatagacttagtgccacaaggacctaaccagagaatattacctgatttctaatagcaagcagctttcaaacttttgatgataaaatagtaaaaacataaagcaattagaggattatatgaggagaagacagtgcaatgcgtaataaagtgctaaactgaatattatatgcaaaaattaatgacgcagataataattgctatggccacaacaaagcgggagaattattgtttgaagttattgactaatgtttcatttgaagaaggcattcaggctggtccttagaaaaatggttaaaatttggcagttagagggaaggcgaaagatatggaaaaggcttcgtctttagattcaatcaacattcaaagaattattgtgttttcccagagtttttgctgttttactgccttttacagtaaaactttccataaaccttccatgtgtttctgattattgagtacaattgaattactagccaattgtatggtgagagctgtttggccagggagcccctgtggacttctcagaagcttttatcctttgaaagaagctgtcctgatttaccattgttaatgaaacttgtataacacaatgcttgagtttaagacccactgagaacatgaccacatacctcctttcatctctacatgggggaaccacatggccaataggagctgcagaaagccagcagcagtactgtaaccccagtgttagtaattgttttgaactttcttatgtcatatcctcatagcattgtcttatgagtgatggcctgtcctgcttccacccttcatgaataaatacaaaatgccttgccacccagaagacgaaccctttgtagtcgtgcatctcttttgaacatgcgtctttaggaccctgtgttctttcatttcagtattcttgcttttgtgaggcttacgttagaaactgtgaaatatgctgttattgcaatggtaatatgttttaccctgtcaagtgcttttatgcattagttcctgactaatacatttggtgagtcaaagggctcatctcgtttgctgagattctctgggaaattcatggagttatactgaatattaagatatttcctgtgagctcagataatcctaaatgtatagatttatctttaatcccaaagttaaggcagaaaatgtcagtaaaagagagagaatggttgaagagaagtgccaggcggaccgaaagagtttaatggcaatctgtaagagagagatcatcaaaaaaattttaatgcccccacatgtcagtaaaagatttggagaatgccttcaaaataggtaaatttacttgtaagttatatacatgtactattattcttatatattaacatatgaaagacacacagaaatagaaataatttagaattaattaaaagaaacacaatttctaatattttctttctatagcacaaatgattctcttttgcatgctccagcgcatgcacactccatttaagagaatccatttttagcttggtgcagtggttcacacctgtaatcccagcactttgggaggctgaggtgggcagatcacgaggtcaggagatcgagacgatcttggccaacatggtgaaaccctgtctctactaaaaatacaaaaaaattagctgagtgtagtggcgtgtgcctgtaatcccaactactcgggaggctgaggcaggagaattgcttgaagctgggaggtggagattgcagtgagccaagatcgtgccactgcactccagtctagcaacagagcgagactgtctcaaaaaaaaaaaaaaaaaaaaaaaagaattcatttttagaatacctagagcagcagtgtgctgtagtgcaacggctttcaaacttcagactgcatttgaatgtcctggaagcttgtaaaaacagatgtgtgcctccctgcaaaagtttctaattcaatgggtctggggtgagctccaagcgtttgcattcctgacacattcccaggttgtggtcgtctgagaactacacattgagaaccactggtatagtccacagcatgcgttttagagttactttacctaagttggacatcagcatccttcaattaccaaatgtgtgaccttgagtaaattactgtgtcttcccgagctcagtttcttaaaatctgtaaagtggaggtaatcataattacttacctcttagagtacctggagagctcagcaagataatgtaaatacattgtttagtacccagtactcgccccctaaaaaacatcaatacatgttggctgctaaatcctccttcttctccttctcttccttctcttcatcattatcaatatcattaaacatctttttttatgtcacgaagtagatatagggactgttggtttcaggattaaaaaaacactgtgccttaatttataagaatcatgggaatgattttttttttctgagttagcattctacattaaaaaaagctataatccaaatgagatatctttctagttgaaaggtagagatgaagctattttgcaaagtcaacccgaaggagaacagtgtgttcagccctctcccttctgtgtataactgttgatagtttgtggctaagtgtgtatttccgtcatcttttgtatatactgagttcttgttgcatgagattgagttgacaattttggtggtgtgtcttcaaatgtttgggggcatgagaatggtaaattcaggtgatttccttgaatctaatttttaacatttcttctctctctcctttttctttttttcccctcttcttgtgcattactaggacccagtaccacctgccaggaagattcatgtgccaaccagggggtctgcatgcaacaatgggagggcttcacctgtgattgttctatgacctcttattctggaaaccagtgcaatgatcgtaagtacaacaacctttcatactggaactttgtgaagatgtttggagatttggagaatcttaaaggacaatatgtaaaaggatggctcttctgaaagattcataagtaattctctcctccagaaacttgggaaataaatgactagtgctcttatgagaagagtgaagagatgtgtcttgcttaacaacactaaatattctcccacttgctcactccctgtgttttttctttagattagaatagcgactgagaaacaataaccacagcagcaaaccatttcaggcaatatttttgttgtaagggcttcagttcttcatgaattaaatcaccttatcttattgaatttaactccaaattggttaataattttgagactctccccttttgcattgcctagaattttgaggctatttaaagggtatagctgttttctcaaaaagtttgagttctctgaatttcttaggccttacaaatgacaaagacattcaagagtttattttttacaattagcaaagcttaaagcgttcttgggtatctttcagatatagggtagaaattctctctgactaaatttattggtatctggtttatatacacatagctattctgtatgtatgtgtgtatatatatgtgtgtgtgtgtgtatatatatgtatgtatgtattttctattttgtgagtatattttatatgtatatattatgtatttggtttttattggaagagagtcttgtgattgttaattgtgtccactagtgatgcttctggctcgtgggtttagttctgacttcatgaaggtgcttctagcactgatggtggagacacctcaatgctgtgggcatctataacctgtgtctccacttctttctcatgttattttcttgatgtgaccatagtaaagatgagcacacacttgaaatttctgaataaccgtggcaaagagatttgttgaaaatccctgactctgtgggtcctgctaaccttctgactttctaaatgcagcctttgttttataatccagactcatttgacctcttggttttagaaaaatgatgcatgatgttatctgagaaaatagtaaagtcacattatggtgtgaccacatgggagcagacaccaattacaatgctatgccccccagatctatgtggtttttttgattctttatttctcagctttttatctgtgtgcagctgtctgttgttgttctttttcccgttttttctcagtagttttggtcccatatgctctttcattctcttaaggtacactgaggagaaacaagtggagaagttggcaatatagagagaaaattatgtaatacgcattcatctaattacataagcatatgtctctgtatctgtcatgtgaaggatacgatgtctggagaaagttttggtataagactgctcttaccaagtcttttggtattattgaaagtcatgttgccatatttatgatgtggaaatactgtttcactctgaaacaggtagttataaacccagccagccagagaacctgaggaattatactatatgctctttctttttcctccaatttgtcagtatagcactcactaggaaggcttttttctctaaatggtggcataatgcttctttatcctcacaagtttatttcttgtcgcatatacgtccctttctgggtagaaaatggtcaggaagagactctccacacagaacaggtataaaggtaagttatcgtaacgtggtgagcacgcacaattttcagaaggtaggtatgtctttttctgtctttgacaagttcctgtctgtcacccaatgccaggcattattttctggtaaaaatcaggaaggattctttctagcattctgtgactgtttctggttttatcaagagcagattgtgtctcattctgggatgtggagtatcacactgtctgacttggggaatttgttgggatataatgaagcactagaacttacattgggaaaatgtcagctttcctttgtggcaacagcttatcacagttcaaaaacatttctagtaaatctaggtttagggcaatacattttgaattttattctgtaacaatgcagctaaatcttttcattatagcagacttgggaaactgcctctctaacaggagctacttgcctagtcccccacctggagattggaccacggcttctgtgattggatagatacatagatacatgcaaatgatgaagttcacatctatttttttttttttttttttttttttgagacggagtctcattctgctattgcccgggctggagtgcagtggcacaatctcggctcactgcaacctccacctcccaggttcaagcgattctcctgcctcagcctcctgagtagctgggattacaggtgcctgccactacgctcagctaattttttgtatttttagtagagacagggtttcatcatgttggccaggctggtcttgaactcctgacctcgtgatccgccctcctcagcctcccaaagtgctgggattacagggaagtacacatcttagttgtggagtgtgataagtatatagaattgagacatataggatgtgactgtgaagtttgaatataaacttttaatgaaatccaaccaaatatagcagaatggtagattgtttaaaattattacattggacgtttctgtttccaataattggtattcaagttatctggaagaccttctgttttggaactagcagcaaagccagtttgttctacctagaaaaagcagtctcactatatcatagaccattattttctatagcagccttgacccttagagttataattggctatttcatctcacaaacatcttcaaaatgaagttacctgcatgatattctatatgcttacctttgttgataaatttttggtggcgtagcctgtatcaggactcaagtgttaaccttcatcatcaccggcagacttgaataggctcatgcttatcatcagcaaaaagtggtgggggaaattgcaaagaaagataagctcatggaggaggaagaataatgatgaaaaggaatatagagaaaatcagaaagtgggtcttatatggaagagcacagaggtcatcagcaattgctttggtaacatgcctgccacaagtggcctgcctttgacctaaataacagaaatgggtcacagcattaaaagtcgagtgccatcaaggaaacctggcttttacctaattaattcctgcaaagagagtgttctatagaatgttgcatatagctcaaacaaattgtatccatttaaatgctatcataggaccatgcaaataggttagagatgaaatttaattgtaaaaagcattttgtgggggaaaaatggttatggatatctcattttccagaagctgtttctcagggcaacagattgatcctcaattaatgaacatgaaaacacttcagtttattactacatatccaaaaactgaaacttactcaacagggaaatagctaggtcttatattttccaaaataaggtactaaatccatcatgtgtaaaaaagttaatcatatgtaggcatgacttgtaaggctctaaaaatgtctgcattttagggtattcctttttcctagcattggttcttttatgacctttgtgtttttcttgcctgtttaccaaatatgattgcctgacaatgttaatgtgctgttacatagatgttgcctctatgagtacagcgtacattttaaaacttagtctcatttagtgtgagttggccaagcctggatgttttcactttatttctttattctttgtgtgaccctggtgggttgatggaggcagtgggatgaatttcagtttcactcttataaacatagctgtgcaaagctgatattctttagagctgattgtcttgtataagagtgactcccttgtatggggttaggaaacaaaaatcctctgattggaaatccaagtgtaattgatttgctaattgtcttacatagttttagatatgaccttccacaatgttatgtaatggtaaagtcatggggagtttcttttgggttgacttttagggctgttttgattctgcaatctaatcatcccagaagaaatgttgagttaatgtagaagtcagtatgatctgtggaagaaaacataagtaacattctccaagataatcttcagttctcgtgaaacatttaaaattgagggagctggctattcagagggtgagcaccacctgaaaatcaacttaatgaaagctgtcttgggctacattttaagaacaacaaaagaaatggaaccttacaaaggttcttgataggcatattcttttttgatattgggttcttattagtattttaaatcaggactgagaacctgggaaattctagcatgttgtagccatggcagcaccaggcaaatccagaatctccttcctgtattttgtggtaatattgtcactgtcagcctgctgttgagtttttctttccttcaaacatcgaaaaatgttgtgtagaatagaaccctcctgcatgcacccacacatgtgcaaaagggttgtcatttttatggactttgtgaaaatagcagttttaaacatttcatacctatccttaacaacattgttggcttttaccatgtacatgacaactgttttgagtggcatacaatttgggggtttggttattgcttctggtgccctggagaagcacatataggacagtctttggcacatgagtccttaacacacatcaagttcctgactttatgaggtgggtgctcatcatggctttgtggggtgaagtaaagggaatgaacgtgggtcctcagcccacccttaggagctggccaccctgtgctacattgctggtcacacactgcaggatgcctgttggagaaattcctaggttcacactggcatgtggtaatagatgttctttgcttgcaacaaatcaatagcaagcagctgtggatagtgcagatagtggagtgtaaagcgtctttttcagacagttttctgcaggagtggctattaagctgcagtgttggctattgattggccttttgctttttatttattgtgtgggtttatttatttttttaatgtaggttggtgtattgattaaatctgttaaaaacacatttcccattcaagcttcagaaaatacaagcaatgtatgcattactcagtgtgcaaagaaggggacagatatgtgtatactgattctgtctcttgggtccatataggtacatagacattatgttaaaaacctatgttgttatgaacctatgttgttccagacctattggtatagcagtaatttttaaggatatcatagtatagtacatccatgtttttggttatgtgttcattccccgccattgttttcagactctacctgcccagcgaataggccatatgtaagaagttcacttgtaaaacaattgtttgttgcttagaatgcactttatcatgtattgattcattcactcaccaaacatttcttatttgcagatataatcatgaataagagagttttgttctcaaagaccttctagtctaatggggaaagacacatatgaaggtgcttcagtagaaacatgaacagtgtatagcgaggagtcataaggtggagtaatggcagctgtccccagggttgagactctatgaagagcagctgcttttaggatggttttcattgaagatgagccttgaaatttttttttttttttttttttttttttttttttgagacagaatctctctctgttgcccaggctggattgcagtggtgcgatctcagttcactgcaacctccgcctcttgggttcaagtgattctcttgcctcagtctcctgagtagctgggattacaggtgtgtgccacacaccacgtccagctaatttttgtatttttttagtagagacggggtttcaccttgttggccaggctggtctcgaattcctgaccttgtgatccgcctgcctcggcctcccaaagtgctgggattacaggtgtgagccactgcgcctggctgccttgaaaatttacaagtaggttcaaagcaaacatggtatggaagagggctggaaaggaaaggtagcgtgccagcaggcaagcagggaaaatatatgctgcagtcactgttaacattctgcatgtttccttccggtcttcattttaagcattagcatggttcagatcacattctgtttgacatttttgccctgctttgtttggtttaacactataggctatgcatttttcaagatataaaaaaaaattagatttcccaacttctttcaatagaatgcatgttatggtgcccaactcttggggagaaactcccctatgttgaaatcattgctgagtcctaaatgtaggcctcatagggctcaaatctggatttatttcattgagtcgttggtggagatcgatcttgaaaatttatttataaagaatccaatttttaaaagtttgatttgtaatgtgtataacttattaaatgataaaagaaatcaaagcatagtcattaatttaattggctctagaatcaaactgctttaaatgccagtcctgagtctttctatctgtgaagttgaattgttcacttagcttcctgaaactttggtgtaacataaggagtgtaataggtacttggtaaataggattagtggtagtttttattgtagctaattataatatttgacaactgttaagtccttatcatggtcctgacactctactaggacctttataaggatatcattcttttaatcatccccaaattcttaagaaaatattatagtacgatactcctgattttaattatgacaaaactgagatcacactgttagaatatagctgattgagggtttggtcccaggtttgtctgacataaaagttcacattcttattcgatttgctgccacttagtcattattagaaataacagtttaacatctgtactgatattagactaggatgcttaattccatgtgggcaagtcttcacagacaatcaaactgcataaaaacatagaactgggaaagggaaattgtgttcttgatgattatttgcatcatattgtggaattcagaacatttcaggtcttccttcttaacactcagatgaggccatttagaattaaaatgtctttagccattatagaattagagtatcttgcccatactccaaactatttatattttcattctctgttgacctagatcttctgatttttatgtgtttgctttatttcaattccaacatatgtcatacagcacggtggacgagaccactaatgtgtaatggggtggcctgtgttcaaatcatgactctgtcccttaatatctatgttaccttggacatgataattacagtgcttctaaagtgcagatattttgtaggtcctatcttgtaagaataaattttacaaacataaattgaataataataaattgaatgtgtagtggtgaagtttaggagatatggcacatgatggccctgccggctactcttcgatattactttcaaaaagttaaaaacatgactcatacaaatataattattataaagttaaaaacaaaacactcatgcaaatatagaatgaatgtgtgtcaaatttatttaactccataatgagagaaacaagatggtaacagtgtaaacaagatgacaaaagactatttgaagaactggatatttataggccttaagaatattaaaatacaaattttagatttaaaagtggtaaatgtcctacaaagcaaaaatctcttaacctttggtgttatcttttctatggaacatctgtgctgaacaaaaatctacaggttcagagggcatcttctgtactctgggcccccgctaacaataaatgtcagtgccagtcacaggttcttctcccatagagctaaatgtttctcgggtgggcctgttaaacagtgtccttttataacattagaaagacacatgatttttttcccctaacttttgccctatgttttggataatttttattaatttatattcagtttcatttttcttttttaccttgaatacctctttcatacacaattacgttttttaaccgcttaacagtgtgccccaatgtgctgaattcattgtcatttaaaccccacggcaaccctaaaagtagatactattgtgataccagtttcatagatgagagaactgagacagaaaagtcaagtgatttgctcaaggtgacaaaactattaggttgaggaacaaagattcagagttatgttagtctgactgcaaagtctgggctctggactgccaatatcttcttaatgcctcagggaaagtttcctgatgagaattcatctgaattcataggggtttagattcacattagccacagagcttaacgacttttgttagcatcaattatactgtaatttctagtgtctgtgttattcttttgggggggatgctattttattttattcactttaaatgagggcatttaaagtaggactgatttgctcggggaacaagatcagaatttccatcaaataagtgccattttgcaggtttggtacatctaagcagggaggaggctgagtcctgagaagtcagtgaggctgagaggggcagcatagctccatgataaccaggtcccagaaggcgagacagatgcaaaagaaacgtcaggagtggcagcaccaaaggttatttctctgcatctgtttttattctcgggcccacagatattccatggagccaaagggaagtcagaagataacaatgaaacccagggtcttctaagagcagaatgaagctagcggtactcttaggaacagttctatagatgtgggttgtagcttgttgcccatgggaatcacacttgcttttaagttccatcaatattaagaagggatgatttggagtattctcaagctttatcagggctaatattaatatgtgtgcaatactaaaccgattcagcaagagccaggactgcgtgcagctttgtttttcacaaccctccctgaaaataagctgggactcataggtgacacattggtttctacaaaccccagtagacacttggtcctatggttcaagaaaaaatagtctccataattcaaaggcatatagcttatcatggattatcataagctgttggagtttgtggcctcaataatttcatttccaccatcttccacatgctatatttgtagaccattttcattgctgtgtttaattatagcccattcatttctggtgtccttggctagttacttacttaaggtgacggcaataatccacttagagcctattgcttcacggaagacaatttttgtattaccatgttagtcacatacaggtgcaattccaacatatttttcaacatggacataatttcctatagttatttccacatctaaaggcacaagaaagatctaaattactttactttgtcttgtaaaatagaaataataaatataattttgttcttttcatttatttttctcctctactttctttttagggaaggaagagatcattttttgaaggtggtaaaatttacatccagcaaaatgcatagatcttacatgcattatcacaaatgcttatacccaagtaaccaacaccagttaagataaaggatagtttcatcttctcagaaacttttcttgttccctttccggttagttcttctctttaaggtcattgctgtttgaatttgtatcagcatttgttatttttgtctcttctggagtatatataaatggaatcatacaatatgtgatcttttaggtctgttttctccagctccatgtcagctctgcattctagccagctgagagtctcttctgagtcttagctccatctatataactgcaggagttggctggattccagctggaaccttcctgcctgctccatgatgcagaaattctctccaggcagtaagctggagcagtcttaaatctcacagtttatcttctctatttcagaaaccactgctcttctttgcctgatgtctcatgtctcatgagccattgtttcatgtgttgtcattttcccggttatatcaggtcagttgtagttccagtctttgttactccatttaggttgaaaattgatgccaacctattcttttttacctgacttcacctttgcactgtgagattagggtgaaggtagcaggagaagacataacatgtaatgggctgtgcttcaagccgcaaattctaagggttttctgaggctttacatcagtcccagagtgatctggcagtatgtaatattctacaactgttttatttattcatttattttagggaaaagccttcaactccagtgataatccctctgtagtcaaagaaccttcttggccaaagaaaacgttgcaagaagctgcgcaaagctagttaaagacttgccaatgtgtctctatcaagtatttattaatttgagtgtttctgttaggagggctacattaaatttttttttttttttttgagaaggaatcttgctctgtcacccagactggagtacagtggtgccatctcggctcactgcaacatccgcctaccaggttcaagcaattctcctgcctcagcctcctgaataactgagattacaggcaccagccaccatgcccagcttttttttttttttttttttcagtagagacggggtttcaccatgttggccaggctggtcttgaactcctgtcctgaagtgatcctcccacctctgcctcccaaagtgctgggattacaggcgtacattactttttacttccactccctctgaaaacacttgattaagctcagtgattgcaggcattgatttgacttgaaaagctagtggttcttattattttcttcacttagaattatagtttattttctcaacctacccttttcttgtggatctttgaccactgattcatgtccctttgccaagtgaaattaacaaatgttttcaaacaaagaatttggagacttcagaaaagtggagttgtttctataccttgtagtgttttggccattgactgtccttattttgatcaccaggcactggtttgcatttatgattttgctacatgcctacggaagaaatgaaggaaccttgcattattggtacctttgatttaactgagtttttttggatatggaaattataaaagctcactgctgaaaatgtggaaaacacataaaagtatgaggcagtaggaaaaaaacatgcttaatttcatcaactattaatatgaccttgtttcagaatatgcatgatgtcaggcacataacagatactcaaaatatatttgttggttgaatgactgagtcttgcatattttcagcatctgagttgtgcaaagatcttagctttcttttcatgaaaagaacactaacagttttactaggactaggtgttttcttgccagaagaaatgcttttaggcatatgggaattataataagtatcccaatatgaaatttccttcttcagataaaaaatgaaaatgtcaagatggttccatttcttttcaatcttgcccttctcctttctcaaagaaagccttgctgtttctgaacagtcattcatacatacatctatataaaagggaaatggttttacagcggatcatggttggagggaaaacaccgctataacataatatgggaaaagagcctcttggtcccagtttcttctgtggcactcacttccaaagtgatgttgtggtttatttcacaagatgagatttcttgtaacagtctagtactctagtgatcgagtgagatagtagaactttatcgtcaatcatcaaatcccacagttttatgttgaccaaaatcagtactacatgattgaagaagttggatgcattatatactgaaaatgtaaaacacaaaattcccctgatttttttcacaccctggattgcaaatttttatttccctgtaggagaattcagtcaaaccttgtaaactgtaacaactctcaggagcattggtaagaaacaatatcatctaacttcaggcattatttcctggtaaattaactacatgctctttgaaatcagccctttactaaatctaaaactgcagttttactcagatattcttatgtgagtgaaatcaaatgcatgtatgtgcatacatatgtaatataaataaatataagttttctttaggagttttcccaattcttctgagatgatttttctatccaaatacctttgtttctatgtcttaaggagttatagctttcggttgcatcttagtccattggcaagacttgtatttctgtaatttctgtaaaggtaaggtatctacttgggccacagatcaggtatctgtctgcctttgtggatgtttggcataaagcccctttattccacctaaattctcgatatttggggtatgattttatttctgtaaaaaaggatttaggcagggaggtgtcatctggattttatctgcccttaagagtaagtgttctttctcctctccctatctaaaatttccatgtgattccctcacactggcactaaagtgtgtcatctggttagagctcacatcagtgccctgctgctggtggaggttgcgggaggtgagctttagaaaagggcctgcagctcaacatacatgtcatggacacaatcgtattgtccccaactcatgaaaattcctgagaacagagcaaatcaaaaataatatgttaaaacaagaaagtttagtgaaacaaactctcggtattgttagaggctttattctaatccctacaacacagcacatgtattctcaacatctaacatatttaatttgcatttggattcctttagcatattgtcctattatataaagtttaatgaacaataaacacagctataaccaaatttcacagctatttctcagtgtggggtaagattttgcatttagttatatttggtttcctaggtaatatttgattgtggctctatttcctgaagctgcatctcttgtcacatggaatcttttggtggcggattctgccgaccgaggggaagccaggaaggagtaagttgctttgaaaccactgaagccatgatagtgaagaagacttcacagtccttgacagtctttgagctctccattgttgttctccaggcttgtatttctgaaatctactgtatgtactagttccagatcagtcttgcccaaataccatttttatcctgtcattcctctgctcgtgaaccttcaatgacctcttctcaatgtagtccaaaccctacacttggctttcaaggtcttccagaatctgtttttcaaaagctgtccctcgaaccacattttcttgaatattcatggctttctatattctaataaggtcaggtttctcgctgtcactagcacattctgtcgtcattatgctccatgcccttgcagctgtacttctttctccctggaaggcgctcttctctggatctatacccctttggggttcagcccaagtctcacctattttcccgagtcttctttggtcagttaaatccatactcatgccttatcccaaatcccactgcatttatattcagtgctgagagacactctggcttggcatctaaagggaattagcgtggacctgagagtaaaaggtcagttcaagttctggcttcttttctttctaatttttgtggcatttgtcaattaatagaaggtgatcttactatggaagtctcacaacagtctcagctttgttaacaaagattataaataatgggggcaaagcagagtattgggcctgggaaagagtttttgtaaagcttcaggtagaaccttatgttagaaatgtaaaacctcctctaaagaaaaatgttaccaataaataaagcaagtaggattttgagtagattatcatttttgttgtgtattcaccctgtttcctagagaatcaactttcctactttgtgcttactatagtttcctctagagtaggggctaactgtgtagaagaggttgtgtgtgggtcgtagggttactgggattagactattcaaatagcacaaatattctgtgtattctgatttcaaatgtaaacatattcctgattggaaatgtgtatatgtattttttatttttagttctggggtacatgtgcaggatgtacaggtttgttacataggtaaacatatactacggtggtttgctgcactatcagcctatcacctaggtattaagcccagcatccattaggtatttttcctaatgctctccctcctctgatcctatcccctgacaggccccagtgtgtgttgttcctctccctgtgtccacgtgttctctttgttcagctcccacttatgagtgagaatatgcagtgtttggtttactgttcctgggttagtttgctgagaataatggcttccagcttcatctacgtccctgcaaaggacatgatctcattcctttttatggctgcatagtattccgtggtgtatatgtatcacattttctttatccagtctctcgttgatgggcatgtgggttgattccctgtatttgctaatgtgaatagtgctgcaatgaacatacgcatgcatgtatctttgtaatagaatgacttatagtcctttgggtatatacccagtagtgggattgctgggtcaaacggtatttctggttctagatctttgaggaattgccacaccgtcttccacaatggttacacaatttacattcccaccaacagtgtaaacgtgttcctgtttctccacaaccttgccagcatctgttgtgttttgataagtccgtataatttaattagaaacctaagtaggttttggaggacctactacctttacttaaacatcctgaattttatttatttgtttattttagaattggggtcttgctctgtcaccaagactggagtgcagtggctattcacagctgtaatcatagtgtattacagcctcaagcttctgggctcaagcgatccttctgcctcagcctcccaagtagcttgaactacaggaacccatcacagtacccagtatatcctgaatttttaaggcagcctctccaagaacattctgaggtgttctggtgtctttagtaatcttatctcctaattttggttcttgcctggaatgaagaaaattactggtctgtgaatctttggctcttgtcattgtaagacttagggaacaatgctgcaatttttgcagcctctgtaatgaccagaactttcaatacacaatcttaactttgtagatattaacttatttttaaatctgctcatttaaagccataaaatgtaatctaatttagtctttacaatgaaatatttacagtagataatttcacagtcactgctccctaattcaaaacgctttgagcctgaagctctaaggccaggccagcttgagtctgatactgatgtgctttaacatgaaacgtgagaccaggaagtggaagacccgtagccaaactctcatccttattcacagtaaatttcttgacagaagaaaccagggaactatggggtttctggtttattatctgagtggtctaatgcaggaattattgcctgccatggggagatgattgcagatcactctccggtggagtttgactgaacaagaagccacatcccaggtctcaggaataatgttattccacaccctccctgttactcaggggtgctctatgatgggctcagctgccgaacattaggggattcgaccaaaaccttaatcatggcgattttgataatcagttccaatgagcagaatcctgtgggctctgtgaaacccgtgaagctgatagtattgaaggaaatgaaatgtgataagtgtgattgcttgacatgccagaagggggttggtggagaaagaattcaaaaaagaaaatttagctatcttaaaaactggcacttctgagaataattatgtagggaatttgcactttcatactctaggtgtttctgagaacaaacacatcttaagaatttagttagaatatgtagataataaagatttaaactgattgccaagggtcctcacacaggaatgatttttcttttatagttaatttattaatttgagtaaaatgtgattcatttacttctgagcctttgcatggtgttcatataaatagtgttgataatttctttctttctttttttttagactgtatctcactttatcatgcagtggcttgatctcggctcactgcaaactccacctcctgggctcaagtgatcctctcacctcagcctcccgagtagctgggactacaggcacatgccaccatgtccagctactttggcatttttggtagagatgagtttcaccatattgcccaggcaggtctcaaactcttggatgcaagtgatgtgcctgccttggcctcccaaagtgctgggattacaggtgtgagctactccacccagccaatagtgtttgtaatttctgatgacaaatatttcatgctaaataagtagccgaccaggaatgaacaagtaattaccaacagtggggcacactgttgtttgatggtatatgttttcctaacatgaacaaactcccttacaacttcaacatctgtgccttaactaaaatctggacatgctgcattgagagagcatctcttggaagtctcctttagtgaaggatgcttttttcctaatgttttaaattcctggagtcagaccttgattctacaatcattcttcagtgatgtttcttcttttaaggtcacgtattttttatatgctgtcgccccgtcctcatcattagcatttattgaccttcaggatgtaaaaaatactctgagttcttcccttgtagccttcttctcactccatcctttgcattgtccttggtgacttaagttttcatgttgtattttttcctaataacctgatttcctcaaatacctggccacgtagcaaagggagtttctattgctggtactgcttcctaagttttcagttctcccataccttaaacctcctgacactactttctgtgtcaataatctcaaatgtttcactagcctccatgtggcagttggagtttctagtctagaatacaaatggtattcccactaatacgcaggagctcttgcctcatgacttgatacactatccaaattccaaagacattcccttgctcggtttcttggcccctgccttacagctagaaaaagtcatgtacttggcaattacttcctgtaaatccatatcctcttaccttagcaatgccctcagtatgttcttttttgtggccatctaagctttgtccctaaattgtgaccattttcttttctactcaataatatctcattttctacgttggtagttagtacttactcagtagaagttatctgatgagagtctttcttcatatttctttgtgtcaaaatgcatttttatgtttaaacatctcaaacctccctggcaattaagacattttgggacttttctccaaacataacattccatttaagtctgggactcactttcataaacccatgcacctgtgggaaaactctcttccccaacgtgccctaaactttattgatttgggcttaccttccttaccttgttcatctagatatgttcaatgggccttgtactgaatatttgtgtggtgtttacatgtttatacatgtttacctgtgtgtgactttttttttctaatttgaaccaggactatgtgattattttacttgtacatttcttagaacagtgtcggtcctcaaaaaaaacgagtgggtttcttactctctttcctttctttcactaaatatttcatcattgtagcactgatcttacacatatttgttaatttttctggctcattgtcaactgtgagttctacagggtaggtacaatgcctcgtttatttttatattcccggtctctgtatcaaacctacataggatttgcaggaaatgagccactgggagtttttgagcaagtgtgtgatatgcccaaagatatgccttagaaagattcctcctggcagagtgtgagaagcaggttgagagaaaatagtaagctttgttgagagaagattgtaagcctttctgagagcagacaacacgtggctgcataaacagaccctagtgcaatgtctgatatatagtgcagattcaatgaatattttggggaagaatgagcaaaatcaagaaagctattaggaggctcttgaaaataggtgtggtaaatggcaaaaaacaaacaaacaaacaaacaaacaaaaaccccaaaagcatgaactaaagtgtcagtactggtaattttagggttagcctcaactttaaaaatagaatataagctgctacatacacatgggcacagccaattatagtagtcaaagtatagtagtcaaagaactggtgaaatggcaaacatttaagaaatttactccatttttaactttataagatttgattattattcctttatagccttagctttttttttgtttttacaattaaagatgtttttaagttaaaataatccacttatattagagcctctttttctattatccagacagcacatattattctatccattaaaaaatgtgaccattaaaaatggctagaatagcttaataatataatatcatatttattctatgatttccagtggaatgaactgttatggtctccctgattgattataattttaataaacttggttgtgtgtggctaggaacaagttcattccaagttcattttttccctgatgtagataaaattccatcagctaagttctgctactgtgccccatctccagacttctagctaaatgaagtactacagggctctgattcttgctcaaactcactactgctaaactgaaatgcttgaggtattcaaaactgttattttctgcgtcaatttgatatatgtgcagcatttcttttttaaaaggacatgttctgaatgtttagagtgtgtagataaccactcccaccccccaacacactcacgtaacagaagaaactttggatacttttattgtgtaaacttacagaatttgtgtcaaagaagttcatgtggcaaagacatcaggtgtatcaaatattttggtggttttgtttaaattcagagtgagaattaaccaagcatctacaatacgtacacctgctctgtattctaacccttttgttcatggcatgcacattaaaacacgtagctccacttcgctgcattgttgattgcagttgatgatgagggttgtcgtttctgtcaacttttagtattgaagagaagcctcatgtgtagtgatgttagggacagttcagccatgttacatacctagaattgtctctgaaaaaaaaaagtcatgaactttttttttttaaaggcaatagaaagcaatcaaccaaccaaacaaacaaacaaaaaaaaacaaaaagtctgggcgtggtggctcacacctgcaattccagcactttgggaggccaaggcaggcagatcacacggtcaggagatcgagaccatcctggctaacacggtgaaaccccgtctctactaaaaaataaagaaaattagccaggtgtggtggtgggcatctatagtcccagctacttgggaggctgaggcagaagaatggcgtgaacccgggaggcagagcttgcagtgagccgagatcatgccactgctctccagcctggatgacagagctagactccatctcaaaaaaaaaaaaaaaaaaaaaaagcagaaaaatgtgttgattacagagttaagggggagaaacttataaatcatggttatttaccacccctgagaaggtaggtacaaggttgactactacttacctcttaatcctatgattttctggttctgtggcttagaaggtttaagctctgtcaagtggctcaagcaggacagcccaaggtgactccaattctctgtgactttgttttcccatgtgggaagtaaaccctaccgctgtgttgtaaactgtttagatatccacataagaaggggttattcggtattttgggggggcttaagataaaagctatctccatttgagaaattagaaaaccatttctacaaatcaactctgttaaaccttgtcgccccaaatcaatttaggacaaaaagcagcagcacattacttttttaaaagcccaattcaattttaaagttttgaaaaatttcaagcaaacataaaggacagaaaatgttaaacatccttgtactcaccactcttaacaagcgtcaacattttgccacatttgctgaatactataacttacttttttgctttttaaagtttttattattgaacacagacaagtactatatgttaatatgtgcaatgtacaagaataatgaaatagtcatatgtctactacccaacttaagagttatagatttattttttaaagaaaaagtataattactttgagcttgccagcgtaagtttcctcctactctctccctgcaaaaaaaatagttgtgtacaaaataaaattcctggggttgacattcagatgaccccaatgaatctgattttttttcttttctttttttctctttgctttttttttttttttttgacagagtttcgctcttttgcctaggcaggagtgaagtgatgtaatctcagcttcctgcaacctccaccccttgggttaaactgattctcctgcctcagcctcccgagtagctgggattataggcgcccaccaccacacctggctaatttttgtatttttagtagagatggggtttcaccatcttggccaggctggtcttgaactcctgacctcatgatccacccgccttggcctcccaaagtgctaggattaaagacgtgagccaccacgcctggcctgaattttttttctgttgctcttcaagttagatggtttaagtaatgatgtttgccgggaagagatttgaggacctaaccgtgagatagtcctgccctgttcaggtctcccgtgtttcctcattagaccttccagcttattactggaaaagcattcttttctccatgttttaaacacctattgagtatgaatgttttaagtgcttattaaatactggttcataactctttgtaagagttaggggagaatcatcaatatctggaacaacaccattcttcatgatattggttttgagagccacgtgggcagagaaataaattctagaaaaaaagaaatggtaatctgacatgcagacttggattataaatatggtcaaaggtgtacttaaaaacaagatattttgcttcttggttagctttactgagaatccagggatcaagtaaaatcattgccattggtactgacggttgagagtcagtgcgatgctaaaccacaggaactccttacttctatgcatgattaaatccagttgtcaggtttgggcagaagagagccctccttttcctcaagtctatagggaggtgctgtgggggagttttctcattttccagaatatacagagcaaggatcatccatcataatcagacaggggtatttcatatcatccatttccagtgagaactgtggtaaaattctgtcctttttcccatttttggctgctgtgattgaaacccgtcttataaacagaaaagggtagtttgagttattttaaaaaataagaatccttcagtctctgttgcccattttctcctctatgaataatttctgcagacaggtgaccagttcaaccatctctctcggttacaaatgcctgtggttggtccacttccttcagccttggagtaaaataaaggcttcttttgcaagatcacgaaataattcagcaaatactgtgggactataaggtattcctgtgttgtcaccttttcttttgaagaatatagagaatatgcttttcttcctctaattcaaatacatagattccttatgcttgtataatgaaagaataagggctctgatacatacatatcattgaacaactattatcagtattaggcaatttagaaaacaaaaaataagacttcagaatttatatcagctccttcaatacttcatttagctggatccatttaaatatttcattttttagcctatgttgtagtagattgcttgattggtccaaggtagtctctaaatccaattagagaaaatgaaattcaggaagcacatcactgtagattttggtacagtgacttgagtatataattgccatctctttctatgttagctcaggggtgggttttgtgccataaaccaaccatccaaccaccagtctacccacctacccacccaactaaccatcatttgggctatatctatctgcatatcatacataatatccttgcaggaattaatccagcatccatatgagtgtaactcatacctaggctgataacaaaatctgaaaggtttttcactgaaatatatcaggtgactaaagaatttcacaacccaaaagaggagggtatatcgatcctagtggaattctatttcatggattttgttctgcctttattgacacagttagacattaaagagaataagtataataacaaaatttataagaaatgcttatggaatattttctaattttagctacaatgatgggttgtttatattctgtggtttgatttttatatcaatctttatgcagctattatcattacccaaacaagtagatattattgcccctttaataacagtgaaggaaactggaatgtaagaattgaggtaactggcccacacaccacaaagcgaggaagtaggaagctggaattcacatccaggtttgtctgttagaagcccatccccttgacctttctgccatattatctttccttatgctgtggcacaaaaaaagaattgtgaccataccatcttcccagagagggattagacaaagtccagagaacgtctagatggtcaggaactctagtcatggcgatgctagttactataagaggatacttggcaaacagcattgcacccagatggtgcgcaacccacacgtctctatttacgtagaggtctcaagtgtttgtattaacaggtttggaggataataaaaggagttgttgtttgttctttctttgtacgtctgaaattaatttttagcataaatttaaaaggggagtttgtaaattcactagacactgagagactggagatccaagcaaacatttgtctgttgagtttaaaaagatctggtgtaaaagtgattgttttctattttgcccactaggtggcgctttggtctcacaggttccttttaatgggctggatttccccgcccccccacctccccccaacccacctccccccaaccccaccccatacctagatgttggtccaggaaaaaaaaaaaaaaaaaacaattcaagactgattaagaggactatgtcagttgagtttgttcagtttgggttttctctatcattatccatgttgataacaaagataattaaacttatttgaaaattttggacactcctttttcaaccttcttgcaataaactgtattcacttattttggaaaaaagcatcaataaatggaactagtgagttatcttctcagcatgtctccacaggctacacttacaacagtctttcctcctacagagcggggcaagtcataggaagtgactaaaaccatgtcatttgggtgttcatattaagcacactggctatgagatcgccccggaatgtatacacagcccaacatgtcattttcttaacaccttaacatcagtgtggacaaaaacaataaggaacaatgttttaaacatgtttacatcaaagaggactggggtcataaggaagcagttcgatgggagaataaataacattattccaaattcaataaaactgatcagtcattctacaaatgtacactgatttgactcattccattaccatgcaagaattttatttgttgactgttgtgaagacattcctgtcatcaagaaggaattttctaaaattataacctgagatagtagtaagtgatagaaaaattcactaaatggcttttccatgaaataatatttatttatacctacttctgaatacctactatgtgctgagcaggtgcagggtgatgtgaaacatatattaaatcccttaaggagcctacagacaaagattaagagatggctgaaagatagtgtatccaaggtcacgttggcacagattactgaagtgagtggggtggcctggaagaacattaagtggacatttaagatggaacagctaataagacaaaggtaaaatgagtctagaagaatgactagactgagaagagaggaaaggaaagaggcagaaatagtagaatgtagaaaagctttaggcccatggtgattatggagaattgcagaagtccagtaatctagagcataataatgcatatgtggaaagagtgggaaattggggccataggtagaagccagaatcagggactttgagtactaaattgagcatgatctattttctagaaggtataggagagactttgaagaaggctgtcacttgctccccacgtaaccctctaagaaggcatgccattcacttccactttccagaagacacaggtgtgtttccccagaagaccatctggatccagaatctgtgcagactgaccatctatcatggtctttccttgtgggaattttaagtcttgactttccttctggagctttccatgcgaccgaggaagtgattatacaatagcagatgagatccttggtataattaaggattgcttgtcactttcaacatttccccccatcaaaccgtggacagagaggccttggaagggtttagttctgctaccatactcatttaaccctgctaagcatattttcttcagcattttgcaagcagaaatttatagtaatgttttttgacactaactctgagtcctgcattctctgcctgacttgctgtatttgaaggtggtagcgaaacacatggtgtatgtgtatgtatgaagtaggaggcatggtggtacagatttagctatgggacttttcagctttgcctgtatgaaattcatttactaagtatatgtaagtgaaattccagcaattcagaaagggttctggaattgcttaaagcccatcactgcttgtgaattcttcccacattaaaatgttatcttacagaaggtcaaaatgtctttcctgcatgaatataataatgacttacaccttagactgtaaccattgtgaatttattctatgtgtatctatctctggttttctttgttggagtggcaagatttaaagcaggccaattttatgcctcattctatgtgcaccaaaactacttacatgatattggttttcagtgcctgctacaacaaaaacaatatcccagtaacagcccactttactttctgtgggtagacaatgccctcacaggggttattaacttctcccagagaagcttttgtctttgcaatcctgaatgcatttctcttcatattagattttaccagtcaccttgttgattatgaaatgctaagtcagggtctttattagactgactttgctttccctttaataattcaggtaattattatatttacagaatttgcctattttttgaaatcaacactttgttaatcaccagacccatgacaatctataagtagccactttacgtggcttatagatctaaagtgaatgttggttttcacacattcattcataactattatttttactgatatattaggcaaaatataagattcatttatgagtttgttcatcagctagttataaaattcctgttgcatggtaagtgctgtctgtattgggcaacagagataaaatgggaaacaaaacaaaaatcttccctactgtcatggggtttacaacacctggacttctcaaaggacactgaatcaaaggttcttctctaagactttgtatgaagtcttagtcagaatcaaagatggttggcaccatcattcactaaagtggcctgagaagtaaaaaacctctgtatggcaaggagcagtgggacctctctttttttaaacttttattttaggttcaggggtacatgtgcaggtttcttacttaggtaaattgcgtgtcacagggatttggcatacagattattttgttagccagataataaacatagtacccaatagcttttcaatcctcaccctcctcccaacctccaccctcaagaaagccatagttcctgtcattcccttctttgtatctctatgtactcaatgcttagctcccattttttaagtgagaacatgcagtattgggttttcttttcttgtgttagttcacttagcataatagcctctaactccattcatgttgctgcagacatgatctcattctttttatggctgcgtagtattccatggcatatatgtatcacattttctttatccagtctactattgatgggcatttaggttgattccatgtctttgctattgtgaatagtgctgcaatgaatgtatgtgtgcatgtgtcttcatggtagaataatttatatttctttcagtatatatccaataatgggattgctggctggaatagtaattctgttttaagttctttgagaaactgccacaaccattggtggggagctagtgcagttgtttggaggtaagaaaatactctggcttgttgagtttccagagttcttgtgaaggttctttctcatttgtgtaggtggatgttccttcaatctttgaagttgctgtcccttggatggatttttgttgctttcatcttctttgatgcccttgggggcttgattgtggtataaggtaggttcagtcaactcatttaagttcgcttttccaggagtcactggggaccaggaatgagtcctggtgcatggtaatcccatgcagagttcccagccatccctctgtcagcccagcacctgtgtcttcccacatccactgtcaatgccttccctctgagatttgctcagagtgcgcctgtcttcgcaatgtccccatctcttggtgacagatgttcctcttggctgcatctagtcagccatcttgaatcaatctctggacctctacttaatatccctgagaatctccttctctgttgtcaccggtgcaccaactgccaaagacaccatttttgcagtgtttggtggggggtttgtttacctctacaattgcgtaactgaatgaccctgagcaaacggtttaacctttctataattaacaggatttcttcttacatccaagccctccctgctgctctgacccagctgtgggtgatagatcattttcaattctgcaaaccacggctgagaaagatggcagtgtgtaaggctcctctgatagattaggaatcatggaaggaagggacattggctgctagctatggctgctcagacagacaacccatgggtcttggttctctctagtggatctctacagggcttccttaaagtcagaggctggctttgccttaagattcttgagcatgagtagaactcccaacccaaagtaaagagagcaaaatccagagaaggacttttctccattctaaggcccgcctcccaagtccttaatttctgttttaaggtctggctcatctcaagaagaatgacacttgaaattatgacacagaaagaccctgtcttctacccaaaggggtgtggcattgtctggtgatgtgggctgcttaagcacgtttaaacacagtagtccaacaccagtaaatgataccctacagcagggagatgtttccttatggttctgttgaattctctggcagaatgtgaattctatccaacctcaagatttgttgcttatctagtacgattggctgccttgtccacaacatcctaaaggccctctgctcttttctcttaaagggcactctaaagtgccttcccagtgtgtaggaacaggactgaaagggccgtttttcttggctgctggtgactttccaaagcaagtgtctttcccttctcaccttgtccatggccccttgtgccctttatttgctctttctgcctgatgtagcagccacaagctgagagggctttctgtgaagtggcaggacctgacataagcagctttgtgcagtgggaaggaaatgtttatgttattatacacctgggacctctaagtccacaaggttcactttttattgtacacctgggccatccttttctacacttctggctcaatttgtttttggtttggtttagaaggttttcttctccctaaaatctcccttaagtcttaggccctttttatgcagaaatgcctgatctccaggctcaaaaaaagcatcttgtgcaagggaaatcgttttagatttaggaaacctcttacacagtaaatttgaattttcaaggtgactgaaaacttaaattcaacaaatatttttatccacctagtttatactcaaagtgtgctagatgcaagggatagcacggtggtaacgatagacatggtcccagctctagtagagcctgtgatctggtggagaaacaggcactaaatcaatagctacaagagtgatgaatgttacaaaagaagagattccagatgctacaggtacatagagcaggaggatttaacctaatctaggggatttggggagttttcatttaactctgctgttgtctaactgaatgaccctgagcaaatgttttaacctttctataattaatagcatttcttcttactcgccaagctctccctgctccagccaaggctcctgggtctatgaactgtaacgtcaagagagaatactgtcaacaacagtaagcctgactgcagagagtaaacacaaggagaaaatggccttggaaccacagagtagactccagagtatcaggaccatttggaggagagaatggggaaaaggctcgtgggcagacagcagtaaaccctgtgatagacattccatctgtccattagtataaacctggcacttagcccagtgatcctcaaatatttgtggaatgaatgaaatgcaaagcaatgtcaatttctgtccacagctgcttgactcttaaggttagtgttgatccctttggggaatataggcgagcagatgaccccatacattggctaactatgaattgagtggatccaatgaccactgccctccttgtgcagatcgccccacggatcactggctgtgtgtgcccatctacccctttctacaagaacttttctagccctgccaagcaactggttctgttcatgatgctgtggggttaccacaaaatacgtaatagctccattcacttagaaagactcatcctagataagaattatcctgcctcatctacccctccctcatagtttttcatctcatccattccctcctcctccccatgccgttatcaactttatacattggaccccatcctgggactcatactctgctaatcctgttcttggagttagggaggttattcaagtggcttggagaggagatggggaaagtcactctagacaagaaacattcagactctacctaggactaaggtcaatcacaatactccaagcattactggagcaaattataaccgtagtcgggtcagcttgcacattctatgctatatatataatgagggagatatagttttcatggcaggttctctgttaacaatgggcaaagactttggggattgatgtctgcagggaaaggatagaaggaactgaaacttctctccacagaagcacctgaaacccagtctgtgggcctttcgtgtcagaatctagtgaaatgattttgacaccacacacggcaaatctgtgcatgtttttctgtaacaaagaactgagaaaatcaggagtccttatcaaagggaacctttgatgaccctctggtggtcaccttttatagtgaaaatgtttggtaaatagagaaaaaggggccaggcatggtggctcatgactgtaatcctcgcactttgggaggctgaggcgggaggatcacctgaggtcaggagttcaagaccagcctggctaacatggtgaaaccccatctctactaaaaatacaaaaattagctgtgcatggtggtaggcacctgaaatcccagctactcgggaggctgaggcagaacagttgcttgaacctgggagacgaaggttgtagtgagccaagatcatgccacggcactccagcctgggtgacaagagcaaaactctgtctcaaaaaaaaaaaaaaaaaaaaaaaaaaaaaaaaaaaagagagagagcaagaagagtgaaagttataaatgaaaacaataaaaaaaaatccaagaaactcaaggaacctttgatgggaaaactgggtttttctctgacctcactactttcccttaaccatcatagccctgccacttctacatgcattggaggaagtgatttctccactttctgagatcctagaggacttaatttgcatctctatgataagaattttaccattatgatctttttattctcatctgttttattgctacaggattatgggctcctctggacagtgttttattcatcttcctctctcactctcctttacagagtaggcccctaataaatatatgcagaatgaataagcaaaatcaataattaatagatagcaaatacattcatgctgacttctatgattctttttctcttttctgtcttaggtttttaaaagtagtacaataaacctattgctagtgtctcaatatttgcctccaagagaataaattgtccttttaagaaacaaaactatctttatctaaatcaaggctgaaaaagatatctaggtacttccaagttactgagcacccctgccctggctttcaggaattacagctgctgattaaacatctgtttccctgccttttctctacttattatccttctctacttattcatccttcaagactacttgaatttttatcttcttactcagtaaaggctttctctgtctaccaaagctggaaacgtttttttcttttctgatatctagcatgactcattactattcccattcattcagtacagatgatgtagggacaagcactttggagacagtaccttggttcaagtcctactgtgctactcagtgatggtcagtgaccctttgatcttgagtttcctcgtgatgttgataaactcctgtgttgggatgactggtctagagggtgagatgaggatatgcatagaagatgcctattccaacacctggtgcttattgagggctccattaaaggcaactgctcttattatttgcatatatcttatgccatgctctagattgtaaattcaagtattatgtatctttccaaataacagcatctgacttcttgctttcagtgagagagatagtcaataaataaacatattatatcatgaaagatagtgataagggctatgaagacaaataaagcagggtaaggagagaaagaaaagggccagggataatgtaattgaggaagacttctgggagaaaggtgcacttgaatagagattgaatgaagtgaggaaaagaattatgtccgtgctcgggtggaagcaatgcacttgataggtacaggaaaggaaactccaaaaggtgtagaagaattacagcatcctagtgacacagaggcccatggagtggagttttgcaaggaggaaagtaatcctcagtttcaaatgcagttgagagggctgggagggcaactgcagagaacacttcctggattgagtaagtaagagagcaagaccaatgacagtggattggtgagaacagcagacttggggatgccctgagtaatccaatgagggaaaccaagacaggactgtaaccagagagagaaatggattgaaaggggagttagactttcatctgaaagacttggttatgtgtctggtagagaaaaaaagaaaagttaaaaatttaggagagagataataactgacagcatggtcttgaagaaggcaggaactgatggtttggtcttaagaaaagaagtgataccaccacatgcagggtaaagagggaaatactggatatggataaggctagggatggcttcaaggttgctttcttttcctttcccttcccttcccttcccttcccttcccttcccttcccttcccttcccttcccttcccttcccttccctcccctcccctcccctcccctcccctcccctcccctcccctcccctcccctcccctcccctcccctcccctccccttcccttcccttctagatggatttccgctcttgttgcctaggctggagtgcaatggctcgatcttgtctcaccgcaacctccgcttcccaggttcaagcgattctcctgcctcagcctcccaagtagctgggattacaggcatgtgccaccacgcctggctatttttttttttttaatagagatggggtttctccttgttggtcaggctggtcttgaattctcaacctcaggtgatccacctgcctctgcctcccaaagtgctgggattacaggtgtgagccaccacgcctggccgacttcaaggtttctaattaaatatatggcagagtttgcagctgagactgcgggtcagggtggtgagcttgattagaggggtggaagtttaagctagaatgaataagaaaagaaacccatcaaggaacatttaaaaaacaaagtttgttctctttgatcttggggaaagtaagtcatgtactccatttagtacaaataacaacccctaaccacattgtccatattgcagggtttcctaagttcacaccaatgaaccaatctctgtttatgaaatgcgctctgcctgtgcttgcattttacacacacacacacacacacacacacacacacaccactctacatctttgccaattcataaccaatcacctcaattatggagggtgatagtcttttctttctttaattaatgagtttccagtttagatgtgtgatctttacacagtactatttaatactgtgcagtttagattcaggtaataccacagtggcagttatttctagcagcaggtgtggttggttacttttatagacatatgctcactgtgatccagggactatgttggacacttgatacctatgttatcatattgaaaatccttacaaccatactgtaagctgactgatggggaaactgaaatgtattgatattaaggaatttgctcagggtcgcctggcttgttaaggtaaactttgaggttgcaggtgcgggtctgggaccttaaacatcatcatgtcacctagctacagcaagagccagcagaacaatactcttcagcctggttttgatatggaagatgctcttcagcttcatgctggcttgaatttcctttgcagtgaagggagaggagaaagtgcattttaataagcttcaattaaattaatttcattttacttcttttgatgtatggtctcttcaaaaaatccaattctactgatgtttattaagtgcctctacttacttggagagtgccaggcacttcaggggatctatggatgagtgtgattcagccctgcttcaagagctcacaatctagtggagaggatgggagtgtgcaatttgctctaatactagattgaatgtaataagtaccatcagaagtggcccaaactgtggttttttaattctgaaatgcaaggttatgtgactaattagaaaattggcttggcagtgcctaaacaccggaagcatcacacaatagaactcttataaagggtctttatttcaaacatgattatgcatttgttcaaatctatggcatacaatgagtgaagaatgtattgatggtggtgacatcatctgccaggctgtgaaggtcaacagtgccagcccaagttgtggcatagtgttgggtgatttaaaactcaggggcaagacagtaaactcacaacaatcccagtggtggtgcatgacctgcagctgttcttggttctttgtgtgttttggcaagcaacagctgttcaagacattgaactgcaattgcacaaaaatatatgttatgtgaagttgttggtttttcttcttttattactatagggtgcttttttgaagttaacttcggaaatattgtgaactcagaataggtcaagtcctatatattccagctaaacaattgtttaatacatttttaaggagatttaaaagtagggcagtagatactgccataaaattcttttccaggtttactgcaagcttttggaagaaagaaataggagctagagaacatgagctagtacaatgtaccatgtgcaaataggaatttaataaatgcttcccaattcttttttttaaattggtctcctaggtgtgttaggttctgtaatagtcacttccaaaatacacagctgaaaaaagcattgcttttgtcttctaaggttttatatctaaatagaaaggctggggaaatggtccactgacaggtcaaaagcaagatttctagtgtcatattattgggaacacacacgaagccagaaaatccatcatttcataacttttgtagcacttcacactattctaccaccacatagatgtttgcttccatatttgtctgaacatccttgcattttctttgccacactcccctgctgcaatcagtccatgcctccctgatggattggttgcagcagcatttggtgttgcttggatgaggtgatggatgcttctctctcttcttcagctacttggagccaaaatacaaaagtgctggttaaaaggtgattaatcttccctaatggttttgtgcattgcaaacaggactgcagccaccatgtcttcattagccttaatcagggcccacattacctcagatcaggtaatcggttatttattatagaacagcaggcaaaggccttttgagcaagtgtcaactgtataaagtctatttggaaaggaaaaatagtggggttccagttgccaagcatccatagggaaggaattaaagctggagtgtatttctgggcacctctcctgctaagcactttggttgatggagggcagcgggtggctttgaggtcatcaggatggacactcagtaacagccctttgccttttttttttttttttaacttcttttttgcttccagggtgacattatctgggtctagggactgaaacagtttgggaaatgttgtcttctgaaaatggaagatggatttttagtatctttgggggtttggtgtacttcttaaaatatgagtttagaacttgctgtatgcccagtaatattcagggtactggggatacagagatgagcacaacagaccaagctccaagcttttgaagcttacattgaatggaaaagacaggtaataagcaagtaaacacatgcaatagaataaaatattagcactttctgaaaaaaagcaaagcaggtaaggaaagaaagagtggggcagggactgatcagggaagtcttccctgaggaaaaaacatttgtgttgggattaagtgaagggaggtgtattagtccattctcacactgctataaagaaatacctgggactgggtactttaaaaagaaaagaggtttaattgactcacagttctgcattgctgggaaagcctcaggaaacttacaatcatggtggaaggtgaaggggaagaaaggcatcttcttcacaaggcgacaggaaggagaagtgccgagcaaaggggaaaggccccttagaaaaccatcagatctcaagagaactcactgtcacaagaacagcatggggtaactggccccatgattcagttacctcccatcaggttcctcccacaacacatggggattagggaactacaattcaaaatgagatttggatggggatgcagccaaaccattatcaggaggggtgcccagcattgtaagaagggccttctgtgcagagggaacagccagtgcagaattcattcttcaagtggctatgttccttttatttattttatattttgcacttcctaagaatcattccatggaatcaatccattccatcccttccataaagtacaagcaaagttaaacgagctgaagtaggtgaatcactagaacggtgtctggcatatcattcatgttcaaaaaaaatgtgagctgcttcctttcaatgtgcaactcaagaaaatgacttgccatccattcttacatacagagggtggctaccatttgccactgaaacaccatattctataacttcaggccatcaatgggaagcatcttccttttgcttccctctctcctttctctctttttttcttctcacctgtgtgctgaaacacaagtgcctcaaattcaggtttttaaataaataaaattcaataaaatcaaattcaggtttttaaataaataaaataaatgtaatctgcagatcacagagtgaacagctgatgactctgtgataacatcatatcacatccacatattccataccatgatccttaaagaatacatgcacacacagaacagtgggaacagctgaattaggtattaaagtggagtataaatagaaatgggtaagttttgtgggtagctgagaatttagagcatttaggagttcagaacatcattttagtgcaggaatgttggtctttcttgctaggatctgtagagacacatgataatgatggcctttcagggcttggtaaaacattgtaatctgtataatattgtgattatctccaaagctatccttaaaatgtttggggccctaacatcagtgttcaaaatcccaaaatattattctcatcagcaaaatattgctcctacacacaaggtacctcttctccttttttcacttgctaataataatagcaagtattaatataaggtatttgttgagcaattattaaatatgtcatctctaacacaacagtccaaaaagacaggcctaagttcttctactttatagatattgagactcatagaggcataaagtcctacagtataaatgagaagctgggatggccctggatgtgactgcctgtaaagccagttcttcactcatactatttgttatttttcaaaacattcaaccattctcttccctttgagagtttatcatttttctccctaagtcctggagaatctttcttggcaatgtcctgatattctattcattattttcctaccctagttctttcttttcatagtctttatcctttcaaatctagactgctgttcttttctgttggtcctccagactccaaataccttccagtatcagctagtcttatgcactgtgattggatagttaaatactactttgacacaaggctgccatcttactgttggaactctccactgttcttatagtaatcatcaggctctgaacactggcttcccagccctgtataatctcccccactttatttatccaaacttatttcagcagcatggctgaagtcactatccatggaactcactgcgtgtgttcccccgataccttgtctcaaactgtatgccctactaaaagggcctccaccttttctttacattctaaaaggtccagatcaatttttccctctaccgtgaaatttattttcccttctcctggcatattgatctttccctgtgaacactttctgtaaacttgaaaggtctataaaatggtcctttttatatagtctttcaatagaaacattttatcttacaaaagatgccccttactgaaaatggattattttctttggcgatgggtgactgttcagctgaaactaacagaaaacacaacaaatgttgacttaaccagttagaggttgaagacattaagtaagaaaaagttgagaagtatgctcgccagggtgaggcagctgtttaacgatgccatttgggagccactctcttctatctttctgtttcatcatccttgatgtatatgctttcagcctccagtttgttgcctcttagtcacagtatagttgctgcacctccaggcaagaggaatggaacagcagaagtccaggtatgtctcatcggtcagcattggtcagaattacataacatgttacccctagctgcaagggaagctaggaaattgagttttgagcttttaagcttgtatagagaaagtaggactggaaaaatgtgctcaagaactgatcttaagtaaataagcctatagtataaggcgcagcaaagcttaatgaatagatttttatattcatataatgctccattcttttatgatgggaaagatattagagtgaagaaaatggaatactggagtcagattcaattgttactgaatattggcactgtcctcttgtagtcttgagtaagtgactgttctttctgagacagatttcctcatctaaacatttggcttaataataacactgcctcttagagttactgtgatgattaaaagaggcgatgcctgcagcctatgatgtggcacatgtcaattctttttccctcttccatttgaggccctggtaggtgtggagaaaatcctaaaaacaataaaacaaaccaacaaacaaaccagaaaaattgaatcaatgaagacaatatctgccaccagctagtcccataaactcatttcaataaggaaaaaatatcaccccagtaacggaactgcaggagtgttttagatttatttatcttgtaattgagtggaaaggaaatctctgaatgtttgtgaaggtgttgacccatggatactaaggtatgtgaaaataactcacacatctcaggtgtttaatgaggatcaataacaatttgtgggcccatcagctctacagtcctatcacctcaaatcacacacaggaaccctgcttctgaaaagtggcacttgggagagagaatggcagagtgaaatccaattagcaagatctgcaaaagaggcacatgtgccagaatcatgcgtgatcccagaaaaaaaagtatatatatatataactattataattttatatatatatatatatatatatatatatatatatatatatatatatatatatatcatagcacattcttagcctacccacctcccactaccccaaaaagcaggacaacattttccatatattctattgaagttttttttttttttaaaacttgttggcacagaagcctatatctgtagatattttaaaaactttacttatatctatttgaaatgtgttaaaaagccatatattctttttttttcttttgataaaaggaaaagcaacaccctaccagatgttgggaggaatagtaagcaagtgattcaatcagatttctcctatggggacatagactctctcggtcaatgtcacagaatgaaatagtctcagattcacccagcagtgagttattccatctggttgtggcaattaggagctgaagatgacgggaagttaaatgactatctttatgaaacaaagcaaaatagaaaagggaacagctgggggactggatggcttggggatgcagaattggatctagaataaagaatctgttacttcgagttgctagttataatgccagtgcaggttaatacaaattgaaggttgctgctgtgtgctagcagttagctgtcgcttgcctgaaatatgaccataacatttacagtactgtctggattgaggtctctagaatgtaatgtcctttttacttaagggccaagccaccagattaactacatagacagggagtcattgaacttcagctctggaaaggatgttgttaccaagttcagtttgtgaattgccaggaatgttatgtgtcttttctttgcatgtgttatagtctaaaaagatgcatagcttttatcaaatccaaaggaaagaatgtgaatccaccagtccttttctaccctcttcccctcttcccccacaaaatgtgaagaacttgctttagaccttgtctttggagttgggtagtctagaacataagcttttggcttactgcttactagctgtgtggccttgggcaagttatttaatctctactagatttattttttctaatttatacaatggggatgataatattgtttatcctattccataatgttttatgaggaaaatttgaaataatatatgtaaatcgttttactgtaacatgtacgaaggatccaataaatattggctcttattattatgttgaggtatgctgaaagttagtggcagaaacaggaccagaacattgatacccaactcactactctggcctttggaaaacatggtgagcctatctctcttcttatttgtcacacccttcatgttttggcaggactcaagagctaacataaggtactgaaatcaaataattacttctaccattacagcgctaagtggtctacttctgcattttgagctctttttcagaattctttaaacatcttatctgcactgcagtctggaaagggaaatcacagagagaagggaaatcatactttggctttccaacaccctctacccaagttgcccaagacaaaactgtgagcaaggttaaacgtctgactcattagtaagaggaagtctttttaggcagttcctctgttgaatagataaagtggatcaaacaaaagagatgacagattagaaactgtctggtggctaatgtactgtttactgcagtataaatgactggtgtttgggaaatgacagatgagagagaatacaaatgtggacgtaaataatttccaggtttctacagtggaggagagtcatggttggttaggatgttgacagggaagggggaagtcattggttggagtttcagggaaatgagaagagcatggagaggacttttgaattaatccattgatccacgagttaccatagcctccgtgctgcatacagaaggtaccatgaaggggtatagttcttttgctcttttctcactgcctgatccattctaaatgtaactcttgttccagaccaagtgcagaaatctttacagagagaaagcattgggatggggatgaggctatgctcagccagtctgggagatctctaggggaaaatgtcataggaaaaaatagtgataaatatgcttaaaagaaggcaaggaagaaagcaaggaaggaagaaataaagaaaaagagagagaggaagaaagagagaatgaaaagaagggggttgggagggaggaaataaaagaaaaaagaatggaaaggaagaaaggaaagagagaggaaatatggtatatcagttattctgcatgatatgtttgagttgagtttgtggtggttacttgccccagggtatcaaaagaagtctccaattaatttgtagccagtgtaaccatatagcatctatttgcttagttttcaataataataatactggttctgattaaataaagcatattgtcaaacttattatttgcaaacatattactgttgtaactggtaattgctcagatctctttcggttcctgccccgacacccaaaagtcaagagggtggaaggtgaccctttctaagactttgacatggaaattctttattctgtttcaggaatggcaaattccagtttacagatggatggaaaagatttcttccttgtgataatagaatgcaggacagtatttctcaatagccatgccaatgacattttttgactggttaattctttgaggggattgtactatgcattataggatatttaacagcatccctagcctctacacagtagctgccagtagtagcctccccaacactaattgtcacaataaaaatatctccagatgttgccaaataccccttgtagaggcccaaaaatgccccttggagagggctataattgacatttttgaccggataattctttggggcaattgtatggtgcattatggtttgtttgtttgtttgtttatttatttatttataaaacagggactcatttttttcacccaggcctgagtgcattggcatgatctcagttcactgcaacctctgcctctgaggcttaattgatcctactgtcttagcccccccaagtagctgggactacaggcatgaccactgtgcccgtctaattttttttcttctttttttttttctttctttctttctttttttttttttgtagaaacagggtttcaccatgttgctcaagctggtcttgaactcctgagctcaagcgacccacctgcctcagcctcccaaagaatagaattgcaggtgtgagccaccacgcctggcccattatagaacatttagcagcattcttagcctctacatagtagatgccagtagtagcccccccaacataattgtcacaataaaaaaatctctaaacattgccaaatgtcttttggagagggccacaattgttcccagttgagaatcacttcttcaggatagactgttgttaaaccattgattcagattcccagggaaagactggacactcagcagccgagcatcctgctgacccccagaaccctgccttgacacctgctcacaaacccctcctctccaccctcaagggcaaggtgtaatttagctgcagccttttcccaaatgcctgtagcttctacaattcaatcttttttatttgtaagtatctttgcagttttctactttcaaaagactcttagtgatttctaatacctcaaattgtacaggtacatggctttttgtctctttctctgtgtctttttttttttttttttttttttagcttttcattgtagaggttcctactttttattttttctttccatgtttattgcttttgtgtctctgtcttcctgatttcattttggtgtggaaactgtctttctctgctattatcaatatcttactacctagatctcaatttcattttatggtttagccttttggtgtttatctccccagtcgctatcatccttttaatgactatttgtgtttctgggtcttttttcgtgtggcagcttgtcttttggactgcctctctctgtttgtatctttccagctattttttatagtctcctcctacttttggagaatagcgatatgttgttatgacatttctatttgtgactgcctttttcctctattgacttcccttcccctttctgcctttcttttgaaaatggcccatctggattaagtttctatcaagatctctttctataagcaggatttttctcaggtatgtaatggaaaccttttacttctgttgaatggtaatcctaaggggaggtcagggaatggacttttcagttaactgctcagaggcaattgtttgttttactttatataatcgaacttttataaaacttagaatattaaatccagcaaggttaaatatttagccttttgttaactttgtaaaataaaaatagaacttaaatgattcattataaagcaattatcttagaaaatgaataggtaacacattattagaatcaatttgttctcaaagctatgagaaataaaatcaataatttttagagatagataaagtgttttaggtaatgtttgggaataagaaactataagagtaggatttggctatttgcaaagtacctgacttttcccttggttcctaaagaatttcgaaacaaaatgagggcactataaggttcacaaggactgaaaactatttgatcttctcatttttggaagaaagtgagaatcgtaatatacttgcgaaacagattggattccatctggtgtagccaaattaatccttctttaatgattgtttatattgtgtatccaaaatcaaactcagtatcaagagttaattacaatttataatcattttggctcaacaaaacaagagggaattgtaaacagtaaagtttattttatagtataaacatgttaaaaacatggatcttcattggaccatatgtaaattaatcaaattatctccagtttttgttgttgttgtctgtttgtttaaacgtggtgcaggaaaaagcaatggctgctgagactgcagaggtttgtgaagaagtctgttaggttttctgaacattcctcccctccgaccaaaaaaataacccaaccggactaagacaaaaaactgagaaaaccaggatggaaatttgacagaggtgtaggaactaaacaaggaaagggaatgtttctcttctctctagtgcaggataaatttcatcagttccctgtctgaacctcattaaccttaataatacactatcaaaaagtcaactctatgcaattagtatttaaaggtacttgatattttaggtgggaaatttattttctctgaaaaatcacacatgcctccaacaacttgaagcttgctaaaatttatagcaataacattgaattcaattacattcaatcaaattccaggcatcaagtcgttattaaacatttacctctatggtcattgtgctatggttgggaataagaataatactaaggcaagatcttctcctttacaaagctctcagctgattaggaatctcataaattgtcaaatgtcactgtttcagctaacaatgtttctaccataaacagaactgactcaaaggggcaaaaagtaaataaagtacatgacatgggagcatactctcacctgagccttagagaggaaactgacatctgtcaattcacttgttctgttaattccactttgatatttcttaaatatatccactcactagggctaagccacaccataactgacttctaggcattcatctttcttccacttaaattcattctccaccttgcagctatttagttagttcttctagcaatacattggttaaaactagtcaatgacttttcatttctttcaggataaaatgcagtatagtatgcagtggtaggaaattaagcactagaatttgtgtttaaatcctaatttcctctcttatctatctctttgccctggagcaagtaattttactgctctatggttcagttattttatctgtgaaacagggataataacatcacttacttcatagggttactagtaggaaaaattagttaataccagttaagatgatttgtagagaaatggcaccttcaattaatgttaactgttactattgttgccacctctagacactcatcccttcgcactgcccttttctcatttttccctggattgttttgagtttcttagaacgtgtacatgctgttccctttgtccccatcactagactgactcctacttgactttcaggacttctgactttttcttcctccaggaatcatcttctaccactcctctgcatggcaggttagatgcccctcttaaatgcagggttaacctctatcgtacatttcacaccttgtatttacttgtttgcttccctattcttccttctacaatgcatacactttgagggcagaaactcagctctgtttgtctttgcagctctgtcacctggcacagtacctggttcattctctgcagaatgaggaaacctcaagcatccactgaagggaacagtgtagcatagctcatattaccaaatatctgcatgttagaggcttatgtgtttatgagtaggcaggtgtcttcatggaactctggtatcttccagatgttcataggtatatctggaacgatgagtatctggccaagtaatatatggaatcaggaatatgtctctcctaaagagttatattttgatcaacctcactcttactgcagtgggcaagcaggtacaacctagagttttccaaaccgttcagattatgaaacctgtcgttagtaatatattggaaaactcaattatagtgccctaaagagctataataagaaacacagtttggaaaatacaagtctgagttagtaaccaagatgtctttttttcctcttgattctaggattatttcaggaggttgtgagagacacaatgaggccttcagctctgggtagactagtttcagccggagctcttaatgggcatcaaccatcacaagttgaagccattcagggatgagaattcttttagctattagaacctgtctccatataaatatttctacctttctcctccagtggtattctctgagcagaggagatgggttgcatagtggccttaaaaggcacagccccaaatttcactggttatgtggacataatatgactttaggatttcttatcacccacttcaaaaaccccagggtcacttaattaaaatgactgattcctggagcctcaacatgtgccttctaaatcagacagtctatgaatgtgagactaaagccaaagtttgtactgagttctcctgtgactcttatgctccctcatgtttaagattctaccctgagtagaggccacttcaaaaatagaaactttttaatagttctctgtttacaaggtcaattctgttaagccataaaccatcccatttggaattagtactataattatggttcttatttcttacacacacacacacacacacacacacacaggttttttggaaaaaaaacatgttaagagaagacatttaaaagtttaaagaacttagatgttttattttgtgagaagaacaattttggggcaagtcgcttaactgtctgagccccgttgtaccatctgggaaataggaaaagtggcatctgcccttgctccgcacttgggatgggagagtcaaatgagaaagactgaaagcaggtgtaaaatctaaagtactaggaaaaacaaggtgttatgatgtcttgataaacatttggtaagataggagtcttgttacacataataacatttttctgagtaatctagtttggtttatttttctgtggggtttaagagtacattttgataactgagagtttaaaacaataatttcagatgtattaaaaattgtacgtgattattagaagtgacgaaaacttctgggattatataaaattgagttttatacaacattctctttgactctaacaagagttaaatgttaggaatcattgatgtaaactattcttaaatgattccacattccaagcaaatgctctggagaacaaataggagaatcatctgtgagattaactttttactgatgccatgtggagtaagattatcgaagcatcttacatttaagaattttacctcagacttaaatagcacgttaaataaaacaggcagaactaacaaatcctgatatcaactttaatttcaactttagctcttttacacttttataaggccctttcctcttataaatgtaaacctattttttaaatggaagctaatttgttaagtccattctatcagaggtaaattgaaaaatgccagcaggcaagataaatttgacagaaaataggtaaaatcaaagttttattcatgtacagtggttaagaatgaagatattaagataaattattttaagtgaggactgtccttttaataggcctcactctatagccttgtctcatttttcattttcacaaggttcttgatgtattcttttcattatataaaacgtgccatatttggtcttttcatgaaatgtatctgatattctcctttgacagccattcacgtgaaaagaaaaggtcctatttctgtccatcacctacatgcacatattcatagaaatcatagatttttggtaaaatatgctatatacttatacagcatcttaatctcagaaacccaaagggtttagatccataactgtaccatatttcctttctgtatgttgagagatacacatggtcaaatttcctaaaacctgaatctaactcaatctaaattatatgatttccgtttctacacagtggaacaagtgtgtgtgaaataaaatcaccagcccagaggcattcacccaaataaatcttggagattttctgcaacatttcatccctctacttctatatctaagtattgctacttctagttggatgtaaaatgcatccttctcaatttatttttgtttgtgggggatggatggaactaactgttcccccactactttataaacaaatataaaatgtggatgtgtaggtattttaaatgctaacagtagaattttagtatctagttaataaccctattggttggaatttaaatcttttcaggaggaaaaattaatcatccattatatcattcatcttgatgctgtcactttcttcttgaaatcagaaaaacatcgtagtttttacatggtagtttttccttgttggaggacagttgcattttactccacactgttaaatgcattaggccatgtaagagaaatataattctgtaattattcagaactcagttggttgtttatatggtattcagcaagatacttcccccccacctccaacttcttataacacaatttcaaagcaccaatcgtcttcctcttttaaagtaacaccatgactgattgccttaaatttatatatgatcttgttctaatgtcctttctaaaaataagaaaaaaatattccacaagtaaaacgagagtatgatagatacttcaccatggtgctggtgtatgtagacttgcgtgagggggaggacatggaatggtatgttctccattcatctctagttttatttcctagatgagttatgggtgaatactgtgacaaaaacaaaacaacaactaaaatggaaaagtcccaggagtgaacagaaaccaggacttaaactgcttcatcattattttattgtattgttttcgttttgggtttttttttttttttttttttttttttttttttaaggaagttacaacaaggagcagctaaggacagataaattggtagcagattgtggtttatgataacgacagtcccgaaggaacttggctttcttggtgacgttgaagtaaattgcattactcaagatgtatactaagaaggatagataatgaggtgtatgggggaaaggcatgatgactatttttatagtattgttgactaccaaaatgaatggaagggaaggcgggaccaggtggagttccttgggttaatttcgatgtaccttataaatgacaaaatttccacccacttctcttagagggataaaaatatttgaaagtgtctgaaacaattgccgaccactatttcaattccttttcctaacttctagtacctttgatttactctgaattcctaatttcttgttaaatgggaccatatttgtttataattcacctgggttaaaaataatgttttcttctgagaagaggaaagaggaagggagtgctctagcttcttcatccagaaacagactcttatgtaaaacccccaggagattctataagatatcagggaagattcacctaaagattaggaccctttgagcctgacaaatctcctgttgaatgccttgctttcaaccaaagctgagataaaaagtgcgcgcatgtgcacacatgctcaaatacacaggcagaaagctctcagctacaagacctgcttccgtagtttacagagcacctgtagcccatttcccctgtgttttttaggcaaatctttgttatcatggtgtatgacagccacatataatctgagtaccacttcctcccttcttaattttccaccatttatgccaattagaagcaaaataaaagggatgatttctggtcacttaaaatcggggtgaagcaaggatggaggttgtcctgcaaaggcattttaattctaaagaaaaaggagattagtggcctctacccatcttagagaatagagtgtcctgacaccttcccttcctccttgctcagtattctccctctccctagtgccacattgagaggagattcactcctaaaagagtgtgtcattttaagttgactttcttggagctgagctaagagccattgccaaggccagtgggcgtaaattcagtccgcctgacgggagatgaagggttgtgggatttatgacttatttgagttctcatatatcaccctctgtgtcgctcgcttatgatggccctgccaaaagataaagaagtgtaggacgctggtacgggctgtggtgacaggccagggacaaatgtctctgttgggtaaattgatttgaatgactctagtgaaatatcaggttaggctgaaaatatgattgggtttaatgatcctgctgactttgtagactgttgggattccaaatcctggacaagttaattaaggcattctatgaagggggtgtgtatgaatatttgtaaatccatgtaattattaatgtcaataaataccaccatgtaaaaactcagacctgttctttcacataatatattgaatgtccattgaatacagggaacattacttacaatttatagagtatttatctgggaaaaactgttgagaacgttattttttctccacatcccagagtcaacaagcagagaccgaaaggcataaaaatgtggaatgaaaagatagagaagagataagcagtttattctctcctggcaaaatttagtagccttacccttaatagtggagaagaaatttttatgtgaaattggggttgttttaggccactaacccaaagatcaaatggattgctttttcaattacaaaaacacatatattgttaccttattttttgaatgtggctattcagttaaaaataatagagtttagatttctttgtaggaccaaaattttttcagcaggtttctgtttttccacttaaaattgcttccaaatttctgagtttacttctaataatgggtatgctctccttgctatttttatctctaggtaattgttgactgcttgtagttttttcttgttgggcatgaatgactggcttcatcttccaaaagtgttacaaaacaccagttatttctttgagctttagacttttcctttgcagaaaggagccttatttacatccaaatgaattcccaggagagttttccactgatgccgactggttaacagaagtacaggcgagcaggaatccctcgctacctggcctttcgttccctggttccatctggatctctgggaaaattttccatctttatttgccataaagtatgatttatttatttcaacgagtggctaagagccctggaatgccatctttaatgagtgtagggaggatggtaaattgggtttagagaagaatattgttaaatatgttcaacttttagaacccaaacaaaaacacaaccagtgtcagtgtttgagagtgctgtactcatctgtgaacgtaacagagaggaaaggtgtctccgaaagaactcttcattcttaggagaggccccagaataatcacaaaacttggaactgtatctatggaatatagaggtttccttgtcttggagtggattcttagagtaaaacatgcctatatccttctgttcttttatcaacttcaactgactgtgaatgatgtactcactgagaaaaatccatttgctcaggtctaattttaggtaatttctctttctgtatgttaatggaacccataactgttttgcctactggtttccaactgaggattaatataacagtttccactcaacaattgtattgcttttttatcccccttatttccttttctttcttcatatgagaatattgagaataagagagattaggaaatttacactgcttctgagggacaaggcagcttttggacccaattatgcatgcctctgaaacacatgttctgcaccacaccattttttctgttatgtttgagagataaaaagttgtccgtctgtctacctctccaggctaatgtctcaccacattcaatcaaacttctccttccccaggccaggattcatgcagtccctacctgtaatgtgctttttcatattcttttttattttaaatagagacagggtcttgctctgttgcccaggctagagtgcggtggtgcagtcatacttcactttaatctcaaactagactcctgggctcaagcaatcctctcatttcggccttccaagtagctaggactataggtgcatgccaccatatctggctaaatatatattttgtgtgtgtactttttgtagagacaggatcttgctaggttgcccaggctggtctcaaactactgacctcaaatgatcttcctgcctcagcctcccaaagtgctatgattataggcctgagccatcttttcattatctttcttcagatctcaaattatttgtcactcactggaagtgtacagctaatctgaagtggccttccacagttcccatctcgctcattacctggataatttcctttatagcaatgaccacattttggtattgttttggatattggttaccttgttaaatgcctgtctgtcttatctcctccaaccaaaagtaaactctctaagatcaggaatcctgcctaagtttttggcctgcatatcatcagtgtcctgcatatagcaggcccaatagttgttctaaaaattaatgtatacctgaatgaataaaagctcttagagtgacagaaatgtaaacaaatacttctaacgctaagaaaagtttgttacatgttctaacaaagatttaaccaaaatgttgtggctacaaagaaaaagatgggtgaagaagaatggacaaacactaggggaacatgagaaagttcctggaagaatattgtcatatatgaattgagactggtgcatggtacaatttcatatataaagatagtggggaaagcattcttggaaaagtctcttgttgtgaggcattacccagagttctttgtcttaaaaccaagagaattaaggagcatggacagaaagggtgaggttggagtgaaagtttaataagtgaagaaagaaagctttccaccacagagaggggtcccggaagagggttgccatttttacagttgaatgcaaaagaaactgatgagggctgggtgtctcatgtgcataaggtgtgaatttctggtagctccaccttgtcctcctaatgcgcatgtgggctcttagcttgagttactccatattgctttgttccccttactgcacatgtgttgaggtggaatttttcattgcaggcatgtctgggcaagtcacctgtttagcctttcttatctgtgtggctgtgggcatgtcctagttaggcaagtcccattttccaagttcccttatctgtgcctgcaggctgttctttcctttgagagaattcagccaaggacccaccctaactgcctgcctgaccactttcttcctttctcctctctcataatgatgtaacagtaaaaatacctgagttcaaatcctgatttttccttttaatagctgttgactttgggctatgtgcttaaaaaacattttttgcagagctttctcaatacttggcacattattgtcactgtttctccctggatcttagttttttgggttgctaagtgagcataataatccatagttcagaaatttttgtgaaataatgtatgtcaaagagcatggtttttagcaggtactttcattcatagagatagtagctgagtttaggtgacccgttaaatttgggaaaggattatttaaagtcaaggagcagatccattatgacaccataattagaatggataaccacatccgcagaaagtgcgctgcactatgagtaaatgtaattttgttcgtaaagtgctgggcctagggttaggggagataagttcttaatatgtcttaatatagccttgggttctgggatatgctaaaaaattattcaactcattagtgtctcagtatccttgtgcttaaaattattattataaaaatacctgaatgtgaacttaacctcttcttgagagtttcagtaaggaaagtgaggctcacttctttctggaacattaaacttaagcaggaaggtgccacatgaagtattatatcataatggaagcaatgtaaaaagaagagtgagtcacttcatcaacttcacaatgcaaaggtgctaccataagtcataattctaatacaaagatttatataaataatgattctgggattagccagatctcctaatgttctagggtttgtcatcatgaattgtggtatcacttagtaagtacatacttaaagagaagaataggaggggagggaatgttagaagaatagtgaacaactaaaaaaatgtgagagatagcctggagagaaaagcaaaaggacaaggcaacacaggaaaaagcaaagtggagaaacagatatgcctagcaagaggaaaccaaagttagcccggtagggtattgttgcaaaaggaaagccggccttgtcatttatctaaccaaacattccactcctcagtgatggggtagctgctctttgaaagacaagcaactgtgatggggacctgtcagtcttccttacatgcagctggttctctaaatattccaacgattcctatcattttctgtaggagtacctgcaaaactggaaggctaggctgatggctttttctccattaagcagtaaacacgttaagcaagcttgagccaggttctggaggaggtcatcttgcaaggataaaaaacattgcatttattggatgaatacttaatgcacggtttgccttatccctaccttagagatgagaaaactgaggctaagactagctaagtaatttacccatgtttgcatggcttgctgatgatggatccggatttgaattccattttgtctgactccataaatcatactcatgctagtacactgccctggcctggatgggccattttacattgtgtttttcttttatagacattaatatgtgtaataaatagaatgggagtatgtattattaaatgttaattttgaaatataagattgttttcagatggaatatccttttcattctttatgatccttaatgctgatttgaaaattagaataggaaaggtatggcaagtgtgtatttgtgatgggagtagctaacactgctcactttaacagtaaagctctgccatctgggttattgcaaattcttgtaaattggtatggcctgtcctgctgtcctggaaagggagcaactagcacaagagaaaccaatcaaaatgcagcaaaaggattttttttttttggtaagattttgcttaattatcactgcagtagaatggctagccaaagtcagaaatcttttatttctgctcagtgagcagcccaataaagcttcagaacatacagcacaaacaaatgccatttcatttttctttacttcttaaaaaaagttaatcaggaatttgttagaataatcctgtgttaaatcaagcagccagacaatgaaataggaattaaagaaaatgaaagtggtgggaattatagaaatattaaattatttcaaaaaccctaccaagtgaattggttaataagcatgtacaatttattgccctatgggtcctctttttacaggcatctttatggttcatcagtttgctcccatctacaccacctgcctataattcttgacaaaagtctgttttagatactgaaagtatccactagatttgagaacaaagcaaccctgtagcgtgagcccagagtccagaaggatgtgggtggaggcggatcaggatccaagattttagcaaaagatggcttgcttaagtgaagcagtttgcactctgcctctttattcagttaggcctggtgtcccttccagcaagaaaagcaactggaggtcctgaaattgcacactcacccaatttccccaaattctttacttctgaggactattgaatcacagagatacagcagtagacttcatgaagttcatctagcacctaggatcttgggatctatggcccgggacagctcctgctgtacaggtcttgggtaggctgccatcctctaggtggtggcggcagtgtggcttgtggttctttttgagtgtacactggctgccttacttgcgagaatctagttctatcaagtgtcagttaaaggccgtttttgtctctgattgcataacagggtatgtttgagagagacatcgctgagagaaattcaaagctaccatgtgaagatcctttcctgaatatagtgtggctacctcagatcaggattctcaagcttggcagttttgacattttggactggattcttttttgatgtggggaaactacctgtgcactgaaggatgctttgcagcatctgaggatgacccactagatattagtagcacctttctcccatggtaacaaacaaaaatgtctccagacatttccacatgtcttctgtagggcaaaatcccactggctaaaagccagtgatggagtttgtactctttgaaataagaccactgactttttgtcttccacctaattacgctcagtaagataaggccttcttttgaggtagactttcaacatctatctctgattctttttgagaaaacacgttgcattttaatcttttagtgaccgattgtccccaaatgtaaaatagaaagttgagggaggcagtagttatatgcacatattttttgagccagagttccctgagtttgagttaaggtgtcctgagttttgagttaaagttccctgagtttgctaccaattagctatgaaacctgggccgagttaaaagttagacctttacagtcttaagtctccctttttcatgtgtaagacaagggagaataatgattgtacctttttcataggttttgatgatggttaaatgagttgaagtagtgaaagctcatagcacaatggctggcccatgttgaatgcctaatgaatgtttgctataattactactgttgatgataatacttttgaaaacatagttgacttgttataattaagccagtgtttacatctgctttaccaaatacttcccatggtttttatctcagaaaatagactcaaaagtgaacacacacacacacacacacacacatatataccacacatatgtacaacctgcatcgtctaataagctcagtggttccatatactatatctttggccaaatccggggctttctgattagcacctctagttttttttttttttttcttcccactcctgctataaccattctcagcattttcttccagttttttccttctagaactactgccaggtgaactacaaattattttcttgatttgcagcccatgcaccaatgagaaaatgcctatggtgtcttttgattttatggttcattgcttaggccttgtcataaaaaccatggcgtctcttaaaagaaaatataaaacaaaaacaactttctcttggccagagtttatcaaacctatgcccataatggcatagaaatataggaaatgagacaatcctactcccccaatccccgttttctgtttatttgtttgattcctgccaaagcaaagtgaccttgagggggcaccggctcagtgtttgctttttctggcgctacccacacccctccttcttcatctcctactgctccccattcagctcctcaacaatcggcaatcactctgcccttctgctccaaatttatgaccgggagcaagccataaacagagaaggccaatcctgatcctaggcactgcaccttcctgtttgccagaggtatgacagcttgatgggactgtaaagaataagcctgcatccccacaagccgcatgaatcatgtcctaggataatgactagcaaaggctgctgcagagactgcaggtgactcagagccctgaggcagggctttccctaaaccacctagaacaaagggttcccatggatgttctctctgtggcgtcatctcacaaatgagaagacctcacccactctctgatctataaaagcagcctttttattctgtgatccatgtgaaatggcaaagatcactccagcttattgatgctcagagaattatgaaggtgccacctgaatgatactcctataggaaatatttggtgaacaagataacgttttttcatggatactatttgcctcctccagttgccgcttggtgtgtatattattcgccagtgattgataatgcctcgggaccacctagtgatcttgttcagtttctaatttagttgatctgaggtggggcctgagaatttgcatattttaaaaactcccaagtgatgctgatgcaaaacagctagaagagaataataattcaaataaatgttcctggtgtaaaggaaagataaatatttcaggtgatggatatcctaattaccctgatgtgattgtatgaatgtatcaaattattccaggtaccctgaaaatatgtatatctaatgggtaccaaaaacaataaataaataataaaaatctgctttcaccaactgatctaggtttaagcaatggagtaacatgacaccagtataacaccttttgcatttctgaaagcttccttcccctcctctttcccctcccctcctctcctttcctttccttctagatctgacagtagtagctgcagcttatgctttagatttgagatacacagttgggatctatgatggtccctgagaaaggacaatgagtagaagaagcaaggtgcagagaggatctaacaatttttgcatggacatgagatttggagcaaggtctagaagctcatatcagcaaggagtaagtatgcttgtggcttaaagattatggtcttcaagacttgctcctggactggaaatattcccctaattttttgcctaaatgaaatgtgctacaggcctgagtatacctaaatcagcttcatttttctgtcaaatccctccctgtatgcttcttccagtgatatgtcatgcagatgtccacaggggacataggatcttgtagtgcaaaaaacatgagactttcatcagacaatcagtcttgactctcagactcactgttgattctatgacctagctcaagctacttaactctctaaggttaaatatcctcctctataaaaacctgatagtatgtactaaagagggtatttttgaaaattacatgagataaaacagcctagaatgctatctgatgcaatagtcatccagtaaattttaatatcattctactttgaaccaggttgtttatattaaatttaacagaattaagcaacatacagtagcgatttattctgtgggctctggagtctgcctgtaagggtttgagctctagctcagcgacttctttactgtgtgaacattgatatgtttactttaatctctctaggccttagttttctggattttgaggcttaaatgagttattacttgtaaaacacttaggagagtctctgctatgtaataagtgttcccaatatatagattttatttcatctagttgaatttagagagtagcaagccactcccttcccgccccacccccgaaaaaaaaaaaaaacacaccaccaccaacaacccacttttagtgtggcaccatatctaagaaggtattctccaagacttctttatgtgaagtagttcagccttggcagagttaaaagttttcagttataatcttgacaaaaattaattgggatgtatcatcaatctagacaatagctaaaattataaagcttctaggagaaaacatgggaaaatatctttgaaagtgtgaaataggcaacaatattttagaatacaaaagcactaagtatataaaagaaagtatcaatagattcaacttaatgaaaacaaaaattcagctcatcaaaatatatacctaagaaaattaaagggtaaattttaaaatttttgttccccagacatagactgggagaaaatattttcaggatatatatctaaaaaaggacctgtattcacaacatatgaggatctcctgcaaatcaaaaataaacacaaacaataaaaataggcactttataaaaaagatacgtgaatggtcaatagtcccatgcaaagatattccacatctttagtaatcaagaaattgtatattaaaatcacagtgatgtatcattttataccaactaaaatagttaaaatttaaaagacggacaacaccaaatattggtgagcattagaactactgaaattgtcatactttgcacatgggaatgtaagatgataaaaccactttggaaaaattgcagtttttaatatagttaaacataaatctaaactaagacttcgtaagtttacttttacatatttatccaaaagaaatggaaacatatatacacaatgacataaaaatgttcacattagctctttaatagtctcaaaatgaaaacaagacaggtatccatcaagagtatggataaacaaaacacagtatattcctatgatggaatactaatattcaataaaaataataaactacaagtaaatgcaacaacatgtatgcatctcaaatacagtatatttttgtggagagaaagacaccaaagagtacatactatataatttcatttatatgaagttcaaaactaggcaaaattaacctgtgttattacagaaaacaatactaattgcctatgagtattggcaggaaggggcatgagagagctttgtgggatggcagaaatgctctacattctgatgggagtgttggtttcaggggtacattgatttgttaaaactcatccagttgtatataggcattccttggagatattacaagtttggctccagaccccataataaagaaaatatctcaataaattgattgacaccgattggcacacagctttatttcccagtgcatataaaagttatgttgacactattctgtagtcttttaagtgtgcaatagcattaagtctaaaaaagcaacatgcacaccttaatttaaaagtactttattgctaaaaaatgcgaatgattatctgaggcttcagtgagtctttttttttttttattttttgctggtggagggagggtcttgcttggatgttcacagctgctgactgatcagggtggtggctgctgaaggttggggtggctatggcaatttcttaaaataggccgggcgcggtggctcacgcctggaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaaaaaaaaaaaaaaaaaaaaaaaaaaataataataataataataataatatgatggggtgtgctgcattgactgattcttctgtttacaaagaaagatttatctgtactatgtgatgctgtttgatagcattttacccaaagcaaaattttcaaaattggagctaatcctgttaagcccagcagctgcttcatcaactaactttatataatattctaaattatttgttgttatttctagaatgttcacagaatcttcaccaggaataaattccatctcaagaaaccactttctttgcttatcatacgaagcaactcctcattcattcatgttgtatcatgagattacagtaattcagtcacattttctcctgtacttctgttctagttctcttgctatttccaccacatctgcagttacttcctatgccaaagtcttgaaccccataaagccatctacgggggttgacatcaacttcttccaaactcccgtgaatgttgatattctgaccttctcccatgtatcatgaatgctcttaatggcatttaaaatgatgaatccttttcagaaggtttttaatttactttgcccatatccaacagaggaatcactacctatattagctatagccttacaaaatgtatttcttcaataagacttgaaaggtgaaattactcctcgatcccttcaatttgtaaaaaatacaatatatataaagcacgatgaaatgaagtgcaataagatgagatatacctatacctaaaatcatgggctccactctgtataaattgtaccacaatttaaaaatgtatatcatatatatatttaaatattataataaaactaattttgaattattcttgattctaggcagtctctctgcaggagtctcactctgtttgttagactcttttcttccaccagaatttctgtcctgcagctcaccattatctagaaaactgagaaacaggaatatcataacagtaaacaaaagtcacttagttgattacatgcatctctcaaaagcctgtaccttctgctatgattagattattccagaagcctcttctggaggaatctcttacatttgcccttcatctatgggattctgcactttcgcctttctgtttctgtgttgtcctgagatatctcatgtagaaatgaattgatggccctttatactgcggttggactcttcattcagattttttcaaagcacattataaactctaattcattaacgtcatcataaatggtaatgtcctgtgaaaaagagaggtggtggcaccaattaaaataatcttcttgtagtcacacatcaaatcaatgtcagtgcaaacacttgaaccaccagttaatgcagccccatttctttttatattgacaacagcacagtggttgaagctgaaatagaacctcagttcatacttatagaatatgccatgctgcacttaacacatggatctacagggagaaggaaacagaagtgaacatggactagatgagaatctgatggacgatatgtaccacgtgctttgaaatagccataaggatgtctgcacaagaatatccatgcattcgttcttagaatttcagggccggttgtagctcagtcattttgccattgacttaattgaaatccaaatcaatgcagacacttgctcaaggtcacatagcttgttctctcccagctcccctgactgccggcctcaagcccctgcctccacagactgtgggctacagattccccaagagatttccttattccctggattctcctaagtttgcataacagaagtacttaaatgcatcacttcatttgggtatgggattttaaataaataatatgatacaaattctctcacactgcagagagtctaataatagcttacagtaatagaatgaacactctgtgcccagaactcctttgaatattttacataacattaacttaatcttcacaatatcctatgaggggatactattgttatcctcattttattgctgtggatgctgacacatagggaggtttaaaaccctgccccacataatgcagtttgctagtgatagagccagaatcagaatgttgaaggttggttctagcagccacacagtaattgctctgacctatctcctttctacaggaaatggggtagaggagattcgtttcctctgaaaaaaaaatagctaaaacctcaatgatgaaaacctatgagtgactaatgagtatgacagctaatactaaatggacaattgtcactgtgctaagtggtttatttcatttgaattatcacaactcaacaaaaaaaagttattttcatctttctcttatacataaagaaactgaggcaggcggtgttaaaggaacatgcctttagccgcacaggtggaaaagagcatgaacccagacaggctggctccagggactgcggcaatgttgtaataaaatggcatttgttcagtccagttttaattgatgagatactaaacagagtcggcactaaagaaaatttccttggagaaacatttatgcttagctatttcagagctggaaagtccctttggtttgatataaacggccttcatttttatggagctggcatcaaactgattttagaaagaactggcctttctccaagttagccctggtcagaggaacctaacacatttctcagtttaaactagtaattctcaaggaagggcaaggtttggagagagagcagtgcaccgctaagggaggtatcagtacctggaagaggggaagcaaatacatgttctgaaaacaaaacattgctggaagacggatatcgaacttgacctaagattttcttttccatctcccctggctaagatgaacaagtttgcattgggcaagtagagtcagcatttacactggtatcttgtgcttggagtgaaaagcaaaatgaaacaaaaagaggtttctttttctaaaattgttttggttttgatttgcgtttagtcataattcttaatttatgtaatttttaacatttcataagacagcatgaggattttgtttttgaggaacatccattttaagtttgaagaaaatccatttaaatgcagttgggcagagctgccacatgcctatcccatccctgttctgatggtggccctaagacgtttcgaagagcttggattctacttatccaaaactaattctgtacatttacgggatcatcagaatcatgaaaaatgtttctagggattctaggtttttagtagagagagaaaatgatttctaggataaaattcagataagccttgagctaggaaactcatagttcatgttgttacaaagaactaaagctgatttttcagagtaccagcttctcagaggacctgagacttgcggatctcatttacagattccaaaacccctcgcagttacactggactgatttttggcttggaaagagcagtgggatacatcctgcactagcccttgtcctgatggattgagacacaaagcttggcctgagcctctgtgtcaccagtgttagagatgatctttgtttctcctgcagggagctttctcactgccaaatggcgtggggctttcctagctttaagatgaaacaaagagaatgcattctcccatagtcttgtctcatagactcccatctcatgaggaattatctcaagtaagtatcactttctaaacaggttgcaaaaatccattagacaggtaggattcacctcgcctgcccattagggatcagaggctgcctgctgagagcccatatctgcagtgttttctgggtttccttttttgcaatggctctcataccctgatgtcacttgtttggtgtgcatgattgtgcttagccaaaaagaatgtgcagtagtcacttggcctttaagtagcaggtagtgaaagacagcagggagagtgtaacgaatcttattctttcagaaaatactaagattattttatttcatgtttcactctcatcaactatttaattacattcattcattcattgatttaaaactcatcatgttgccactatttgcctgttctatgctagcactggagatctatggatgaagaagacaaacaaggatgctattctcatgtgcattacatttaattgtggataggaaattaaagcaactaaactcactgagaatcagagctaacatttgcccagcacttagtacatggcaggtgcagttttacagcttgatgtatgttaactcatttaattcttctaataagcctataaggcataagctattatctgcttttagagataagaaaatgaaggactagagactttagttaactttcctagggtcacacaggtaggaagtgacagagctgggatttgatccagggctccctggctccaaagctcttgcttttagccatgatactataatgcattgaataatgggcgatatctacctttccttgatggtcaggaagaaaggtcaaaagaaaggttgttagagctaaaatctgaaagaggagaaaagtttttcagataaagagagtgtgcgtgtgtattttgtatgtgagtattgtgcgtgttctatgtgtgctgtatgccgtgtgtgtgtgttgtgtgtgtgtgtattgtgttgggatagagcagcaacacaacagtgtccctagcggaagaagtaatgtctgtgatggtaagggaaaagagggtgaaagtgagaaaagagtgagagagaggctcggacaacttaaacaactggaaggccagcaggataatggttatggtagaggtggagagaaatatgaagttggaatgggatgggatcagggacacatcatgccaagtcttctatgccacattgggaatggaaagtcatgaaaagattttaagctggagagttacctaatttatcatagattttaaaaagattcctcttgcagctgggtcttaagaattagtggctcttcattgatgagttcatgtcctttgtagtgacatggatgaagctggaaaccatcattctcagcaaactatcgcaaggacaaaaaaccaaacaccgcatgttctcactcataggtaggaattgaacaatgaaaacacatggacacaggaaggggaacatcacacaccggggcctgttgtggggtggggggaggggagagggatagcattaggagatatatctaatgttaaatgatgagttaatgggtgcagcacaccaacatgccacatgtatacatatgtaagaaacctgcacgttatgcacatgtaccctaaaacttaaagtatataaaagaaaaaaagaattagtggctcttgcagttgttcaggcaagagatgaaggaggcttgcccttggatgaatggcaagattctgtgtgtggtatgaaagtctagagcttccttgatgaccatctcctaccccatgcatttacagctttctctccttagaaaaggatttttgacataagcaaaaacttttcacaaaaatttgtgtgaaatcttatttggggatttgctctctgtgcaaggagtcctactccagcaggtttcccagtcaaaatatgcctttgggaatgcagagaactgaaggccctggctgagcaaaccccagctggagagacagactggggattctatctgtgtatagcatgaagaatttattctaaacacttggatatagagccaatgccacttacaagctttcctttaagaatcctaggccagttgttaacagtttttaatctccttaatttctttatccatagatacctgacaggaacagtttggactgtggaaagacaataatggtccctttctgaaacagtctcctacttgctgaaggctactggaatagaagagaaaatatagtattttctgaaaatgtaaacagatgttagtttaccatttgtgagctgcagggttcagttaaagtggatgttgtatgtaaatacagtggtagcttgggagctgcagatgtctctaataagcattcccaagtgcactgtgttccattagtatgtgggattccactaccctaatcccactactgtggcttactctgggctccttctgtttctattcctgcaggacacataaagacaccttaggcgttagctgtctctatgtttccattccaccaaatcggaacttcatgactttttcaccttctctctcagtcataagaagacggctttttaaaggatgccaagacaggtggatcatggtaatagtatactccattatagcagttgttattcattgaacacctactgtttgtcaggattgggcaagtggcagtatacatcatcttatttagtctgcacagcaggtttaaagggagataatattactccgactgtacaggtgaataaatggaagttaaaataatctcggcttggtagtgatggaatcaaatgatgtaattgcctcattgtgaccagctaagggcaattctgttaggatctgtgtaacacattttaagagaaacattggcaaatgaagaaaggttagaggaaaacatctaaggtcatttaagtatacctatatacatttctctcatatgatatgacaggcttgaaaaattacacagctcattacgagcaagagagcagtatatatatattaacattctaatcttaataggaaaaactaaaggatgctgtgggaataaatggaaggatcatcatacctagccaagaaaatgataacttaggtcctggataaataaattttaagtagggaaaggtgggctggagttaggagcattctaaactcaatgaacaacatgcacatgcacttggagacagtgcaggtcaatttaggagctcacaggccatttagagtgacagaagcagagtgtgcaggtcaggcagtaataagacatgaggctggagaaatgagtaggaagcagatcaaaggccttgaaatgtcaagaactttgtaccttatgggtactgaagaagtgaaatgtttaaagaagccgaattatatgatttcttttgacttcaaaatggaaaatacatgtcgatattgggggagaaattaggaggttcttgccataatacaggtggcaaatgatggtagtcttcaggtaatggcagtaggaatgcatagaagaacacagatatgaaagattcttagtctggcagacacctggaagcaagggtgcataggaatagctaacagttaaaaaagtatttggagagctatcatgtgaaacagagagatgatttattttttctgttcatttactgagggcatagtaaggactaattggagaaagtcatagggaaacatattttaatttcaataaaatctgatgctccaaaaattgaaaacataacttaccattcatctctgaatgtatccgtgcattttttttttcattcaagttacatttttaaatgatgtgcaagttctatagactgggtaacagtgtacataacacttaacaactaactaaaatcagtgaaacacatatcaatataaacaaagagctatggaaattaatcctgtccggggttcagaggagttattaattaagatggtaaaactagctgaagggataattagagggaagagttgtgtggggtctgcaggatctacaagtggaattgcccacagaacctttagatcttatgaatctagagcttagaaaatagtcagggctggtgaagtatactggggaattttcagtgtaagcaaagaccatcaaagcaaatgtctctgaagaataagcaagtaatacaaataagtgagatggacaaggcataaggcaataagtactgggactatggaaaattggcaagcaggtgccccttccaaatggcaccactgccagtcagctccagtaaattgttgctctgtgctctcagatctccacagtttctaaataaaaacaaaacattggatatttatgtgatgcttctagttaatatgatatctcacagcatgtccttgatctaactatagcccaaaggctgtcagattgccttgtatgttataagatgattgttgaagctgtgagtaagactgaaattttctcaagcgagtagaccactggaatgtatacatgggtaatctttctcaagtgggtaaccaaatgttatttggtatgtaaacttttctatttccacatctgaggattcatgctgctataagtgatgtctgagaaagtcatgcagcacattagccagcaaggcataaaaggcaaagagagagataagaaagatgatgttaatctagagcctaatgaaaatgtgggagttcataaggagtgatcaaatacgtaaggtgataattgtggatatgtttcgatatcagaaaacattgcttttctgtgtgatagtgctttctttataattaatgtggatttagtgtgtgttatttttagccttttaatccctataaatgtgccacttcatattctacgactgaaaatggcactataaacaaaatggtttaggaaccagtgtagagagcaggagccaaagatggaatccagagtcacagcatgagggatgagtaaggaagatgactaaactggtagattttagaatgagctatagcagtatcaccaaaaccaagagtggagagaacttcaagaggaaagacacatttggaccttttaggtaactgaaaaatggcaagtccattgggtttaaaaggtaaaggcttctggtgacctctgagagggcactctaaggggagagttggcaagaatccagtttgcactgcactgggcagtgaacgggaggtcagtgagtggagtgattgccaactgctccttgggcaagtttggcaggaaagggaaggagagatgtggtgccattccaaggatgagacgaggttaaaaaaaaggctttactcattttttttctagtggagtagaatttataatatattaagactaggagtgataattgatgaagcaaggtacggaatgaggcataaaatggagagatcagagttagagcaattgataattatttttctttcagacaggttaaaaatatgaatctttggatgtaaccgagaggaaaattgagggagcttatgcctgatgcctctacattttctctaaagtaggagatgcgggaaggggtcagtagagagttgtgggctggaaaaaaaaagtttggaggagctgctgtagggaatttaacaggggtgattaaaaggattgctgaggttcaaactgaggttggaaaccattaagcagcaatgatcagtacagttgtgagcatttctccaacagtatcaggaagtccaggaacaggaaggggaaaaaagagggtctgtgttgctccaggtttttagaataacaaaccaaattcagcagaagatcaaagtgaaacagacaagcagtatgtaagtggagaaatagacaatggaacacaggcttgagaaggacataaaaggagtcaggagaagactgattttctgagagcaaagagaatccctgagatatatatatatatttttaatattagaatgagagattcttgcactgggtaggactttgacctgagtgaactttgaggttcctcctaattccaagattctttgattctagacatgagaaaacaaagctagtccctatgctgttgtcataactgtcatggtatgtgatatggtttaactctgtgtccccacccaaatctcatctcaaattgaaattcctacatgtcaagggagggacctgtagtccgcaagtgttgagggagggaggtgatcggatcatgagggcggttctctccatgctgttctcatgatagtgagttctcaggagatctgatggttttatgaacgtgtggcatttcccctgcttacacttctctctcctgctaccatgtgagaaggtccaagattgctttccattcaccttacgccgtgattgtaactttcctgaggcttccccagccatgtggatctgtgagtcaattaaacctttttcttttataaattacccagtttcaggtagtatcttcatagcagtgtgaaaatgaactaatacagtatgtaaaaatggaagtcctgtatatacctgtctctctcaggattggcctcaaggaaccttaccaagtagatgacatttctcacttgttcctctcacttgttcctctcacttcctgttgtagtatcatcttctatttattctccttatcaccagcagatcaaaacaatgagggcattgatctatcataagaaggctgccttcaggccctattctttttttttttttttttttttttttgagatggagtctcactctgtcgcccaggctggagtacagtggcaccatctcggctcactgcaagctccgcctcccgggttcatgccattctcctgcctcagcctcccaagtagctgagactacaggcgcccgccaccacacccagctaattttttgtatttttagtagagacggggtttcaccgtgttagccaggatggtctcgatctcctgacctcgtgatcccccagccttgacctcccaaagtgctgggattacaggcatgagccaccgcgcctggcctcaggccctattctaataaaacttccaggtagatgcttgttctccttctctgtgagtccaaacaaggtctctagttattgattctcatgttattgcagcttctacaaatttcaccctcaagtcagctttttggcttttctgactcaagtcacaagataaccatccttttgtttcatttttgtaaattctcataaccccaactggatggtagatgaatatgaggaagaggggaaatcaaaagaatgagagcaatgagcctattactcttgagatgaacagagggagagattcaacaccaaatgcgtccctcttctgaatcccatctctcgaatcagacagcacttctgtgtacttcccaatatccatacaaataccaggaaacttattttacttgcctctggccttggtttgcaggtttggggaaacacaggagtcaaacagaatttttttgggtgaacccacagatttcactctgaggaacagctcccttgctgttgagacagctgggtgcactaagcaacacatttgaaatatgcctcagactttgtggaaccaggtagtctgaaatcttgccaggactttagtgcctcttgggatacttctgaggtagggcaaagtcccattcaatgttctgttggaggagagaatctttagtgaaatctcaagaatgaaagccaagaagccttaagataagagcgagagattcaacagcaagtactatctgtaagaactttgatttcattgcatttaagcttcttttcctagtggactgtttttagttgaatacttcttgaggataagtgttgtgtcttctatacttatatctgcagcttagcacagttcctgccctatggtacatgttccttatatgtacatggaaattagccaaatgtcaggatgccactttttcatctccatctctattcctatgatggatgactggtaaatacttctctgactatgtatgtgtagttcaaatactctagtttttttttagcataaagtgctgtgaaatcccaccatcaaaagagccaaagtaatatgatgaaaagaatttggtttcagaattaaaaagaaagcacacatttttgagttctcgctcaaaaacaattttgtgagggtaagttatttaacttctccgtgtctcagcttcctataaaactagaattatgagatctctcttataggtttgaaataggatgaaaattcctccctctttttttttcttataacctctctcaaaaccttgcctgtgtctctatgagtgtgttgtgttacagttactgctataatttctctactagattagggtggagaagttcccatggctgttcgctctctcagaggaccctgggcaaagttggtgctcactgtgcatcactgattatatcaaatactgtgtggcatgctcaggccttgttggtctctctgtaccagtgtctatcgtgggacataataattcatgatgaacagtcaggcatctacttagtggcttatacgtagaagtggctctcctttcagaagccagaaattaataaatggtctacagtcagaaggagatccttaattgattaattaattcaataagaatttattaagtaccttctatgtgctaaacactggggagacaacagtgcataaagagatcccatctttgttcatatgaaactatattctagaggaagagacacacactaattgaatactctcacaagcaaaagtacttttgtaatggtaattcatgctacaaagctgtagaccttggtgctatctgatacagagatctgatggaatcagaaagttcaggaagagatcgtctgagagttcctggctagagataggaaggaggggcagagttaaccaggaaggggaggcaaaagtatcacagtcacagagaacagtgtgcaaagcacccatggcaagggggaatgtgataagggtgtgtagtgaatgaagccatagtgactggaatataggggacaagattgaaagtaaaacttacaaggacgaccattgcttgggagtttgggttttattagcactgcagtggaatgctgtgaaacaatgaactggcattgtagaagctggcatagcctgcttttttgaggacatccaacacccatgacaaggtctacggcatcaaggattaccttggtttgtctttgctaaccaaactgggttatacacaagttacgagttgtccttgtcccaactcacaccctcaccattggagaagaatgtggagtgcccctccccatcccggcccatcccttatgtcggtggactaacgcagcatgcctaatgccagagtgggcagaaagaataatagctgttgtttcagtttacctgtactaatttatcacaccttacccagagactccagctccactttctgagttttctctgtctggaggtgaaacacacaagcacataaataagtaggaagctgttaggaaatcctctttgtcactactgaagcatgttcatttatttagtaaaacgtccataatttttaaattgctttatttagccactggctatttggtatcttcaaggggtccccattaggagctgtacttccccattacctgcaaaaacaaggcaggcttttgatccctggaattaattacatgcaaagattttcattgcttggagcagcaagcagctggttcctacgggacccaggctgaactctcttgccaatttccctctcatgcttgtccctccctccacacctacaccctttctttctttcattatgctcaatgggttcaatctaatgagggaaattgtaattaaacatttacaaggttccagttttctctatgactgcccttaagactgtgaacattcacagttcactctttttccaaatacagcacaatggcaaagtttccaggaatgtccttactgactcaggccccccagaatggtattaatccatttgaaaacaacttcacttgagttattagagctggggcaaaagcagggagggagagatctactcgttagggatgagggagcaagagcaatgatgactagcttttgtcaggacacaaagtgcgtctctggtgcttgtgcagatcagttgacaatggtttatagcttttctaccttcctccctttcctattaattattcatacttctcctaccaagagaggggtcttgttttccttttaggtgtaattagagtaatcaaagggtttgtaacactcatgtgttttatttctcattctctattcaattttgtttttcatgcaagagaaaaatataaaacacgaaacaaaaaccccaagtctctgggtgttgtgaattcttgcagggaaaattggttttaccatattagcaattggcagcaataattctgaggtgaaaaacctgaaattactcccttaaaggcagtaatttgtatagtatgtattttgagaaagggggggaggagtaggtgataatttaggtgaatgttagcagtttatctttatattttgtgataaacgaggaagccaagtgttggtgtgttcaactgtggacatacatttgcatatggttttgtttctattgaatagattttggtttgaatgacaaattaaactcccagcttccaaacactgaattcttttgttcagactttacacattcttgaaaggaaaggtgcccacatgcacttatcctttaagggtgaggttaggcaagcaaggaattgacagttattttatgtttttttgttttttgtttttgtttttgagatggagtctcgctcttattgcccaggctggagtccaatggcatgatcttggctcactgcaacctctgcctcccgggttcaagctcttcttttgtctcagcttcctgagtagctgggattacaggtgcataccaccatgcccggctaatttttgtatttttagtagagatgaggtttcatcatgttggtcaggctggtctcgaactcctgacctcaggtgatgtacctgccttggcctcccaaagtgctgtattttaccttttatattaacaaaaccttcttcttgcagttcagaacccataggaaatattattggaaaggtatttcaccacatcatcacaggcatttctatggtgacgaagcgatgtgccatgaacaaagttatgccattttttaatacaagccgaggaaagagaaaaaaaccaggagcaagccactgcttcagggattggcaacctctttatgtttgctcaagatagagcgaaaaactcctaaggttttaccattaaagaaccaaataaaattgtttaacatgttggaattgtgggtcctttttgtatattgacttgagaaaaaataaaaatattgatacagaaaaaagagaatgcatatgatctttttatcttagccaatatattatgttttcttgtttttgtatatctacatattcataaaaacaagtatgtgtgaagaagtttacatcacagtgcaagtgtgatccttcatataaaactaaagcaagtgaggatgaattcctaaataattaaacggtaaattacttgtgtttgtatcagctcttgagccatcttaaactactaatcaatttctcataatcatcagtgcttttcatctgtgagcggattatttggtcaaacatggagacaatggcacagccgtgagtagagcccaggtgtttttctccgatttctccacagaactacaatgccagcagaaaggtagagtggagtaataataaaaaccaggtttaagagaacactaagtttttttttcagtgttgttcacggaactgcaagtggtatagaggttcaggaagtcattacagtcttcataggggtgcaatagttctcacttctcctttcaagaagagttgtaatggaaagttgaggaagaacagtagggacacagggacaggtggtgtctccaattggtcatattctccaagttatttttggtctatagttggttccctaaatctcacttcttctcttcctctagctttagggactggactcagcattttggtttcatttcttttttgaaaagtaaaaagaaaatttacaaaactataaaacaagttatatatgtatatataaaactagcatattaacaaatatatatgggtaattatataaaattatttatacatatataattacccatatatatttttcataattacccatatatatgtatatgtatatatatatataattacccatatatatgtatgtgtgtatatatatataattacccatatatatgtgtgtgtgtgtgtgtgtgtatatataattacccagaattaaacacctttaggtgtaattagagtacattaaaatttggcatactttcctttagttcttttctaaattataaaagtaacatatagtatatttttcttctctaaaaatattgaaaagttaaagtttccttatccactttctcctcaaccagagctgcttctcccaaaatcccaagggaatcattattttgagtttgctgtagatacttcaaacgtttaaaatatgtatttacatgcatatatatatatacatctagaaaaatactagcatatgttattttatgtagtttattcagttacttacatagtacagtgtactatgtaagtataattcacatcttgcttttttctttcaacactgcatttttgatgtataggtccctgatacactgggtattcttcagacggataacatttgatttagattctgaaagagggataagattttgccaggtcaagaaaggaaccggtcaggtagaacattagtttacgtattagcacttacttcataaaggcatggaatagactgcggaaaatcaaggttgctggactttagggtggaactggtgagagaagagacaggagactgagtaaatgcagaaagggtggccatgtagcctatggcagatattttgaattttcactgagaggcagggatattataagtgaaggtgaagtgtatcactttgctagagctgctgtgacaaagtgccacaaaccaggtggcttaaacagaaaatgtgttgttctggagactagaagtatgagataaaggtgctggcggggttggtttattctgagaaccataaagaagaacctgccttgttctctctcctcttcttatggtttgccagtaatctctgccattctttatagacaagtcaccccaatctcggccttgatgttttcgtgacattctctctgtgtgcatgcctctgtccaaatttaccttcctttatttttacaatttttattttaagttcaggggtacaggtgcagtatgttcagatttgttacctaggtaaacgtgtgccatggtggtttactgcacaaaccatcccatcatccagatattaagcctggcatccattagctcttctttctgatgctctccctctgcctccccttttgctgtgcagaagctctttagcttaattagatcccatttgtcaatttctgctttggttgcaattgcttttggcgtttttgtcatgaaatttttgcccacgcctaattcctgaatggtattgcctagattttcttctagagtttttatagtttgggattttacattttttaacccatcttgagttaatttttgtatgtggtgtaaagaagaggcccagtttcagttttctgcatatggctagctagttctcccagcacaatttattaattagggaatcctttccccattgcttgtttttgtcagatttgtcaaagatcacatggttgtaggtgtgcggtcttatgtctgagttctctgtgcttttccattgatctatttgtctgttcttataccagtaccatgctgttttggttactgtagccttgtagaatagtttaaagtcaggtagtgtgatgtctccagctttgttctttttgcttaggattgacttggctattcaggctcttttttggttccatataaatttaaattttttttctaattctgtgaagaatgtcaatggtagtttaatgggaatagcattgaatctataaattactttgggcagtatggccattttcatgatattgattctccctagtcgtttatttttatcctctctgatttctcagagcagtggtttgtaattctccttaaagagttccttcacttcccttgttagttgtattcctaggtattgtattctttctgtagtaattgtgaatgggagttcattcatgatttggctctctgcttgccttttattggtgtataggaatgctagcaatttttgcacattgattttatattctgagactttactgaaattgcttatcagcttacgaagcctttgagctgagccgatggggttttctgggtgtaggatcaatgtcatctgcaaacaaagataatttgactccctctctttttattcaaataccttttattttttcctcttgcctggttgccctgactagaacttccaatactatgttgaataagagtggtgaggaaaggcatcgttgtcttgtgccagttttcagggggaatgtttccagcttttgccctgcagtatgatattgactgtgggtttgtcatatatgactcttactattttgagatatgtttctttaatagctagtttattgagaattttaaacatgaagggatgttgaattttttgaagtacttttctgcatctattgagataatcatgtgatttttgtctttagttctgttaatatgatgtatcacatttattgatttgcatatgttgaaccaaacttgcatcccagtgatgaagccaacttgatcgtggtggataagctttttgatgtgctgccgaattcagtttgtcagtattttattgaggatttttgcatcaatatttatcaagtatattggcctgaatttttctttttttgttgtgtctctgccaggttttggtatctggatgatgctggcctcatagaatgagttagggaggagtccctcctcttcaattttttgaatagtttcagtagaaatgtgtactagctcttctttctacctctggtagaattcagctgtgaatctatctggtcctgggcttttttagttggtaggctattctctactgcctcaatttcagaacgtggtctattcagggattcagtatttttcctggttcaaatttacctttcttataaggaaggcaatcatgttggatttgagtccagtctaatgacctcattttaactttgttaccttggtaaagactctaccttcaaataagttcacaatgtctaactgtgagttaggaatttaacacatgaacccattcaacacatgaacctttgggggcaggacttaatttgacccttaacatgaagtgataaaaatattttttagacttgataattgtagctcttgtttgatggctgaagtatcaagaggattatgagaacagacatgaggctatgaatatgttgaaggattggaattttggatcactcaaatgtgatccaaaacctctggacacccttaccctttctagatatattttttccccttaaagaactcaaaggagaacagagacctggaaaaatatctgtggatatctggaagtaagcactgtactagaggttatcttgtatttgtctctagtttttatgttcgattctcagaggcaggtatttcattgtacaaggtgcaataattatggagtatacattttatttaatcacataggaagtggtttattataaaagagaaagaatactttaactttaaacctgttggacaaaagggttaagtataactttctcaattacttaggcaaatatattcttgaaaataaaaagttagaaaagagggaaagactgagaccctcaatgttaaataacattttataatgatcacatgctgagtcaaaggcaaaagcaatttctaagtcgcctacttaattctctagaccatgcctgctatcttatatttatatcttaataaatgtacatatgctgccttgctgttttggggacaatgggaagtataaatttgatctttcttgaattctccacatttaaagtctccacttgtcacttgaattaacatagtattttagcatttaatttcctggggataccagatgttttattttgtgagtttcttttatttatgttatagttgtggtttaaacaactatatgttcatttaaaatgaaactcaaaaaagaggaaagaatggcacaactcaataaatatgtagtttaataatattcagtgaatacgtatgcacagtgaatggaagtctaaataacgtactccagtgaagaattattagatgttgcccgtctcagctggattttcagttatactattcaagctggtgggaggtttcaggggaagaacaggggagaagacaaagcagaaacagccttaggcagtataaattctgaatacctttaatttgattaacttgttaatactagcaggagagttactttgttgtattctagggattataacatggcatcatttgaaatgatatggttcccactgataaggggaggatgaatagaagcatacactgaatttctctccagggcattgagttcctttggcgacagcactgttggctaaatatgaaaggctgtgagatgaaatggcagcaagagaacagcagaggaaaatgtaaggcaaggatgggaaacacatgagaagtttatacctgaccatctcttttctatcattggcttcctatctcctattcttcttctttgtcaatctctgtagcctccacctttgctcaaattggctcagtgatatgattttaatactaagcccacacccagttggtatgaagacattaagtaattaattaattcaataactatttgctgatctgaacaaagtggacaaaaaaccctgtctctgtggaattttcttccaggcatgaggggcttgggaatgggtaacaagtaagtaaattatgtaacttgtttgacagtgctaagtgctacaaagagaaactaggtagataaaagaaatagggacttgggaggttgaaattttataaaaaaaaaaaaaggtcagagaaaataccacttttctgatgagttaaaaagctatgacctgctaatttttatgtatttattctgtgtccattaaaacttccagaaactttctcttgaagtgacatttgagtctcaagatctggccctggtgattatattgtgacacactgtgatcattacaaaaatttttatcatcatgtataactgtgatgctattttgcttgcagcccagacaatgtgatggatttattaaaacattctgataatcataagacagtgattctaggacatgtattatcaggacctcttctgtacctgtgtttggagttgccatagatgaaagtcatatgataagagaaaagcaatatgataatttgtaagtgagctgcttataataagcaggatatgacagtcaacatttttcctttttacctttccttccatctctacctgttttctttgttatagactttgagttttgtatgtgtcaggtttcattcatttgggaaaccaatgtcacatcaaattaggaaggatgttatgaccctctaattggcctttgcattgtacacaagcctcctatgtttgttcgggatagcaccacgcatccttttaaattggtagtttgactgtcagtttccgtaatgcccttgacagtaaaacaaacacaactctatgtgattctattatgaaacattaatcttctgactgtatggtaaaaggaaggggtgagagtttctctccattcccccaaaggaaggaagagtaagaaagaaattaaaaatgtaaaagcactcccaataacaggtcatcaagtcacagcttttcattgtggccactctttgtcagctgtgtgtgtgacaagaaacaaatcacagctccatgatatttgatagccttgagtaattaaagagtcttcaatgctttttggaaaatgttgtccaatattccagccacatgcagtgctcccttaataactcaataactccacatttctctccctgtgtgtgtttgactattgctatcccttttagagatatttgcatgtaatcaagatagagttcaaagatttaccattttccttactattattctatatttgaatatccctcccacttccatttttttcttccgataggggaaataagttaaccaaaattcaaacaaaaatcagttttaaataaatattcctaataagaattattataactactaccacacatacatttatggtaggaaaatttagaatctgtcctggaaaaaaatacgtccagattatttacaaagatttgctttcagaatccctcttgagataaatagacatgttgggggtgattctgggatggagcaaacatgtagtttgggtcgcagtttaacgatgtagccgtagtgtattaaggctatgcatagcaatttctcttgccctggagtagttagtgtcaaactctttttacccattaaacatttgaagtagatttattagctctaaggattcttggttcttcctgaaaaggaattaagaatctttggacagtggacttcttgaaaatcctatcaaatacccctaagtatgtttctggtagcctctcggttgtgctattcagtgatgaataacacagagcttgattgttctaatttagcggaagaaacacattttttttaatgtggtttttgccattttctattatactttaagttctgtgatacatgtgcagaacatgcaggtttgttacataggtatacatgtgccatggtggtttgctgcactcatgaacctgtcatctacattaggtatttctcctaatgctatccctctgctagccccccactacccaacaggccccagcgtgtgaggttcccctccctgtgtccatgtgttctcattgagaaacacattttttaaatacataaataaatatcacccttttgtcatgtatcttcataagcaattgacccaaccaatggatttgcagtcagtgaaaacaactttggatagatgggtggatggatgaatgaatggatctcatttatttgtgggagctaaaaatttaaacaattgaactcatggagagagagagagtagaaggatggttaccagaggctgggaaggttaaggaacttggagggaaaagtggggacggttcattggtaccaaaaaatagttagaaagaataaataagatttaggatttgatagcctatcagggtgactataatcaataatatcttcattgcacatgtcaaaataactaaaaaagcataattggattgcttgtaataggataaatgcttgaggtgatggctaccccatttaccctgatgtgattattacacatttatgcccatatcaaaatataacttatgccccataaatatgtacacctactatgtacctacaaaaattttaaagaatgtgaatggttgaatagataggcagatagataataaagtaattactatttatttttgatttcagaagattttaacagggcccttgattatcattcatctgagatctacccttgtctgtatggcttatttgggttgtaggtaagagtcattcttgaatgagtgggggtttctgattatttttaaacagccattcaagaccaatgcagatacctaggaggaaaatgtttctgatttttatgaatgtgtatgaaaccggtaaatattcataacatagctaccaatatatgcttctgcaagccaatctaaacaaattgccagtatcaaagattctgttgatgaggaatagacagcctgtgtttgcagtcttgttaaggtggttaacagtggtgtcctgattttttccaaaaccttccagatttgggctgctgagtagatgatgctgacttccgatactgcttgttgttgttgtttaaaccattgagcaggttacgaacctctgaacttaaacgaaagaaatcagtggtttcagctggaataaaaaagtaatactatggtatagcataacggagataatacaatttttgtggttttaaaacagagaaaaaagtccctcttttaatgcaaaatcacctgtaaccttgaatgtatcaaccagtgtgacttagctgataatttaggcctatttcatagagctgttatgagaactaagtaaaatcatgcacatacaaatgattagttacttttaaaaactgtaaaatgcttgctgttattgttgctggattgaagagttcattgtgatggtgccattcaatgactatatgactaagatgatcatcctttgtactctgtctccccatctctcctccctcccttgtttttccatgtggtatgtgttttctctctctctctctcttttttttttttttgagacggatagtttcattcctgtcgcccaggctggagtgcagtggtgcaatctcggctcactgcaacctccccctcccagggttcaagtgattttcctgcctcagcttcctgagtagctggaattacaggtgcccaccaccacgcctggctaatttttgtatttttagtacagacagtgtttcaccatcttgaccaggctggtcttgaacttctgacctcaggtgatccactcgcctccgcctcccaaagtgcttggattacaggcatgagccaccgcgcccggcccgtctctaagttattttctaagctaaaagtcatgctactgcaaccaacggatatccccccttttttggagatacttggtaatgtagaaactatttcagagagtcaaaattctacagatagagtttagaatgcacaaaatctagacatggcattgaggcatctagatattgcctttacctatttcctgtaggaacttgctccagattagtatcttaaagacaaattggcatttatttttcttacacacattgcattgtgccatgtaagaaaattacagattaaatcagcattttcctcctgcttgatgtgaataaaatcaatgctgaaatgggagtcctagttaatctatgtgatagaagttactaggaccagtgtttggtggcttaggtccttaaagaaattggaaagctctttgcaatacagtgtgttaacaacagccttttctttttattcccttccctttgcaactgttcccagcccttctttaaaaatctaagtcagaaatatattgaagggctttatttctatccatttttttctatctgcacatggctgttgatattccttcactgtcttggagctatcaactatcagtcttttgtaaagtagcatacatagtaaagtatcaagaaaacattttctcaagccagactgcctgtgctcaaattgcagctctgctacttactggctgagtgaccttggacacgttatttaacctctctgtgcctagtaaccactacataggagggtattttataaggattaaatctctgtaacacacgtagaaaagtacctgccatatggtaggcacaatatacatttttgttaaataaaatgaagcttagtagtttacctgcattgttcacattatctaacacattaccttccacatcgtaggtacacaatgaatattattagtcatgacttatacatgactaaatgtattcttaaattggagtggtacaaaaaacatatgggtccattccacatttctacaaactagctctgcagtcttgcacatcaaattttagtgtctttggagcttccttctcatctttaaaataaaaatatttgcccaatgtatttcaaagggtaattttaatgatcaaaatgataatgtacttccaatgagttgaaaaaattatttctctatatgaaaggtattataacatttttatttctcaaattactaaatcagttctaggggaaatatgctagtaaaatagttaaggcttgacagatataactggtccagaggtcggtagtcatcatgagtactaagacctagatactaggggtctgtgtttgttcttgagaatacagcaaagtgtttcaaggaaggaggcttctcctttacttaccaggcctgttcagctgtatttggctacttcttgttatggaaggaaacctgagcagaccttgggaatccagtgttcctttatcacattcctcagatctgttaggctggacgccaaggacagtagtttgaaggtgtttgtcttgatgctgatggatgttgcagtctgtaatccacgaactgaaacagggcttctcttcattgcagctggcatatcttgttgtgtttatgagtctgacaggcaaacatatctgaagcatatctcatatgctgatctgtgagggagataagccccttgttttgcttgactggaaacaaaataagcaggtggcagaaaaccctgcattgatttctgcttgggctaaaacacccagaataagatcaagtcccccttgggcacactccagcctctgctatttgatcattgatcatttgacttaagtttgcaaattgttgtagggaagtgtaagtttctttctgctttaacaaagctacttttacttattttaattttataagctattagcactattttgtgatagaaaaaactaaaaatcaaatggtgtcagagcttaaaaatctcttacttcatttgccgtgtaatctttatgcatttgatttttgcttcaggatccttacctataaagcatacccatttcatttgaccactagatttttacagaataaaaatagttcctttctgaagaggaactatgaaagtgtatacatgggttaggagatggagctgaggactccaaagtaatcagtccctgataagaacttgagttttgatgcacacattattgcattttagagattttggtctcccagttagattgtaaacttattgaaggcagtaggacattgacaatgcataaatattagttaggaaaatgaaaaataaagtgttgcttaccaattcagagattcagaagaatgtggataggattttttccctctcacctgaaatttcgactttataaactctttttattactgtccttccttttctgatcccttgatgattattaattggttccagtggtgtatatttcagatatttaattaagtcttcctttctgtccaactctctgccaaaacatatttttcatttttatacctgcaatgctcaaacataagttgatgccaaatgcatgctgtttgattacattccatccagatttacttccaagcaggacgaggcctgtagcatttatttcaagtagctttacaaagagccattcttggccctcaatgtgtgtggcaggcggggaggcaggagaggaaaatgaggtagatgtccttcccataccttaactagtttttgagagaaatggaaaatggcagatcagatgccattggccgtttgcccaattaagccatagcagtgttagctaagatgtgatcaatatggaagacttggtctgcagagccttttttagctgtgctcctgtactagtcaagcacctcctgcaactttgtggtaaattcaagcacctcgtgcaactttgtggtaaaaaccatcctcatgagttagagccttgtcttataagaaggaagaggacagcttctgggtgagacacgtgctggccatcatgctgttgcctaatctgtcacctcaactattgattcccagctcttgattctcattgttcattcatggagttgtttctaaataatggtgactagagaggaggaaatggtgttatattagttctctattgctgcataacaaataactccaaaacgtagcagctcaaaaatcaacaaggcattacctcctaatttttgcaggtcaggaatccagatgtggcttagctgggtgcctctggcttagagtccctccataaggctgcaaccgaggtgacagccagggcttcagtcacctcaacttgggagagatctgcttccaagcccttacctatggctggtggcaggccttagtcattgtggactgttggccacagataatacttcattggcacaagagcctttctacaggacagcttacaacttaatagctgtctttgattgagggttggggagaaggtggaagccattgttgttttcaatctaatcttgaaagtgacatcctgtcacctctactgtattctattcatcacttagaagtgagtcaataagtataggacatttaaggggagggaataatcaagggtatgaataccaggaggctgagacagttgggagccaccttatagactgccttacacaggtgtaaaaagcatgaaatagacattagacaaatgcagggtctgctgagatggcgtgtaaaaagttctatcacagggcttgccacagagtagagaagcattgcatttatttcttgccacccccagcacattgcctggtgcattgtgggcactcaagtacctacatgcccatgaaactgtgtctagtttactaaaaacaaagagtctctctgttccaaaagagattaatgtttggtgttatcctttctggacaattttcttcctatgcttcatttctccagttatcgtcaagggaatggatttaagtctgaaataaaatcactcaaaaataaggaatagctgaagcagacctagaattaccttggtggaattaccttcttaagaacaattagaagtttattctttaggtcaggaatgctgttgccaatcttccacagcaggtgataagaattaaattccctcatgaccgaggaaacgttctttctgctaatctggttccacctggaggttcaacaaatagaagatagagcacacggtgtgtttagtcttaaccacatagcccgaggcactggggaagtgtccacacgatgtttgccttctgtgaacctggaaagcaatttttttctagttttcctttttttcctcttcttttcctattcatctgaattcttctgtagttaaattattaatttctctccctacagaatataataaattactatccttgttaattcttttatcaaagatatgtactaggcttctgcttccacatgggccatttgaaaaacagtgcttcatatgatccctgaactttttggcaattataaagagagatcacaaatgagtaaggttgaaaattaaactataactggaatgaaatgtcctataggactaaacctatcagttgtattgcagatcagccccttataattggtgatgtggtatgagacattttatataactataatatataggccataaattattattatatcagtctgtggtataatattgcaccttagggtagaatttgctccatttacattatattcaggcagaaaaaatgaaaacatctgtcagggagagtatagccctattgatcaggtatatataagtaaggtttacttatataaggctgagaaaaggggctttccatttgatttcagttgttttatagacaagtttctagtttgagggagctatttagaaatgtatgtagccttatgtagaaattccaataaagctttcaaaaaataaagctggtatttatattggttgaaatggcaagataatgagtctaaaagattttcccttctgatgttattttttttgttgttcagaatgacacttgaaagatgcctaggatttctactgctgctcttagaatcacaggatctcagggtaaaatcaaactttagaggtcattaatttcaaccagccataaaggtctttttgtcaaacttatgaccattcaagatactttggtgtcaaagtagctcacaagataaaataaatcactcgcatgttaacccataggaggttaaacttttgacagcagatctgtggtggtagataccatgttttctactgtcctattggaaatgagtgttagaggcccatttccactacaaatactgcctagtggctgacttacatggtaaaaatccatccaaccttgctctgcatacattccagaactctaatgcaaaatgatgcctaaaccattttaactctatccatgcatgaggacactaagtaagatgaagcttgttttgatatatacactttttaaaaaggtagaagaataagaggtggtaaaataagttattcaatttattgactatagtaacaacttggctctgattgttaatgtttgtccctgccatgtgatatatagttgtgtgagattaaaaacccccttgggtataattttatttacaccaacacatatattttgaagagatgaatgaccaattctgggaatagttagaagtaaagaatttgaattttctgcagcactgctgcacgttaggtaaattcctctctttgggcctcacttgcaacaccaataaagagaggaagttatactagatgttctataagccccttccagccctaacatgctattagcccatgattcttgtgtagggataccagaagaagatgaaagagagaacctaactcattttctgtcaccagtccttataattcatggcattgtgtatttctccttgagtcaacattgcttcttttagtgacacaagcaagcctgctttctccagctcctcaggaggcaactctgctactgcagaacaaagatcattctcttcctggcactcttctgattcctggtacctgtattcagtttcacattccctttcttgttgaggatgccattgcctatagaaagatactttaggtgaattaccaggcaaacgttactaaagcaaagataactgataagggggactagaatcttggaatttgtgcaaataaattcctttgtgaaactgcagactgattagaaaactgtcatagtaaaatactttaagcatgtccttttctcattttaaaataacaactggaaggaaaatataaatatatcactgaaataatggtttctccatgaagaaaaagacatttagacaaaccaaaagtgtatattctatggtgtagtaaatcattaccttactatattaggttaatacttgataaaaccttgtagtgagataaatggtgatatggagaacttaaatcttcaaatgtatgttttaagccccattatagctattttttttcaaacttacctactataaagttttgtccagagatattccaaaaaagaataatagattggtattaatgtttctgcctcttttactctttggaagacgtgccaataggcaggtaaagagatcaaaaagaaaaagtcgggcagggtgcagtttctcacacttgtaatcccagcattttgggaggccgaggcgggtggatcacaaggtcaggagttcgagaccagtctgactaacatggagaaaccctgtctctactaaaaatacaaaaattagccgggcgtggtggtgcacacctgtaatcccagctactcaggaggctgaggcaggagaaatgcttgaacctgggaggcagaggttgtggtgagctgagatcatgccattgcactccagcctgggagacagagtgagactccatctcaaaagaaaaagtcaaactagatcaccatttacttaacaaggagctgttagtgtattaagagtattatgccattcagtctgattaaaccacctgaaggaacagtggaacctcttcctaatcattcccatgtgagacttcctgggagacagctgggggcagccagaagcaagtagctagagaggactgtggatttctttgtgaggaaatctgaaactggccactttaaggcccctgggttctactgaggttaagcgtctaaagtgtccttgactcactcaatttcaaagcaaattcaatttgatctcttgcctaataataaacactgggcagaagcagacatggaaggatttggaaaatggtgttaaaagatcaaagagatctaaataaactattttgtttgaactagagttaccaagtagaatagattgttttaccatagatggagactctttgagaaggagttaaaatttgtgggagatccccaaaataatggcagttcccacacacacttttcccccagagtgtatataggggatatataccactttctcacctccttttccacttcttatcattgttagatctctagaaagttcatgtagcttctttctcctttgtcgttatatgtttcagatacctcaccagcttcctttgctttcatttaccatatcatagtggtaatttcctcaattcctatatcctacaagagcttgatgaatgaaaagaaggaagcctgtgacaattattttattcaagcctccaaaacagagttttgccaaatgcttgtcctacttctccgtgcgcttgccatggtctttgttttgcctctttttcttttggcagttaccccaactataactggaatttcctgattgatgaagatttagtggtccaaacacagtcagttgtcttttggccagaaggaaatatacattatataatccggtggtttatcttcttatccctcccccattaacttttttttgttttgttttggtttttgaatctctgcttcccttctccatcccctaagcaaaagcataaccagcacgttttttagcatttagtagatacaagcctagcattgtgctaagtattttgcgtctattatctcactaacttttcagaaccatcaatgaagttagttcctttatcatccttattttgtagataatacaattgagatccagtgaaactatagttagcaagtgtaggtgcacatactaaaaccaaatgaatgacttgaaatcccaagtggttaacatttattccagaatactttcctaatctgtgcctggcactgcactagttaatgaaaacagagtgagaaaagatatgatgtgtccagccaggtgcggtggctcacgcctgtaatcccaactctttgggaggccgaggcgggcagatcatgaggtcaggagaccgagaccatcctgaccaacatggagaaaccgtatctctactaaaatacaaaaaagcagccaggtgtggtggcatgcacctgtagtatcagctactcaggaggctgaggcagaggaatcacttaaaccctgcccagaggcagaggttgcagtgagccaagatcgccactgcactccagcctgggcgacagagtgagactttatctcaaaaaaaaaaaaaaaaaaatgatatgatgtgtccaagctctttgtctaatgaaggagacagatgtcaaaaagataaattactatacggtacaaaaatgctcttatagaggtatgagcaatgttctatggcagacaaaaaattagaaagaagacacccattttcctcatagtaaaccaaaaatgatctaaaatattccatgtttgttaaaaagcaagatctttatggttactgttaggcactgcggtatgcctccctggattgtcaataccaatgccatatagatagaacaaatagtttgaaaagacatgaggacaaaacagtctccctgtctcccaaataatagatccaaagaattctctggatttgaatttaatgttcaagagaggggaaggcataaatatataaacatatatgtttcatacatatgtgtatacatatatatgtttcatacatatatatatacatatatacacatacttatatatacatacataaatatatttatatatccacttaaaacatatacaaaactacctatacatatatacatctatatatcacatgtttcaagaagctgttttctactaacatcttcatgtacgtaaaatttaggtgttttataaatttatttgacagagcacccctaaaccttttatatacacacctcatcagatggaagtaatatataaaggaaaggcactggcttcattcttctatttttaaaaggagtgaaaacatttttgcatttgccaaactcctgtgtatgcaaactaattgtgtgtgtgtgtgtgtgtgtgtgtgtgtagacacagcaccatttttggtgaggatggcacaggggctctcaaaagaaggagttctcagaatcatagcaccaaaacgttgtgagtttgcaataatcagagtcatggtgagcatcatggaaatttagaactaaaagagatgttacagattatctccagtctgagtccctgccacacatgagaaactaaggccaagagatgttaaatggcttgaacacagaatgatcagtggaacaatacctagagcttctgtcttccaaatgagttctttttccaccttatcatgcacgttacatcaggcatgaatactggaaatctttctaatgtagggacatccaagcaaaacaagttgcatacatgtcataaaaaactttaaaaaattcagatttacttctggcaaattcattcaggaattcaaactcagataattaaattaatttcttaatattcaaataaagaccagatacacattgacatcatctctcttgtatattcagagtaccagataaatgggatttttcactagggggacaggattgctacactacaccattgccatttgcattcacaacacgggatggcggaagagacattgatacaacattttttctgcctccttcatttttaaatggatggtgacatgcttcacagcagcatctccaaacaaaagatgacaaattcccatttattttccatcagtggtactgtgtgagatgttgtactaagtctaagcttgttgttcctgaggcacagaagtctttttcctgcagcatatagcattactgtaaaaataaccattccattgccagtcactctgtcaggagtattggcagagtgaagaagacttatttgatttcactaaagctattagtttgaaattctgatctgtaaatctggatgggaaccacacgagggaaaggatccctgccagaagcaatgggtcttgtacattctcaaaaacaaaggtcagatgaaaacactggattgaaaatagagccctagaaatgaagcaagaaggaaggaaacttatattgagcgtttgtaatgttccaagcattctgttaggctgtttacattatgtacttgaaaccgtcaactggattcatcttttccttcctttttccaccattgctggcatgtgtgcaagtgggggacccagggaatagagactacaatgtaaaaaatggtttcgctgttatcgttgtcatgttttcctatgtaaaaaataggataatgtgacttttgctgttgatagatgtttcttcaagatcccagtagagtattttgtgactggaaaatttctagaatcttgaaggcaaaaataagtgaaactgtagagaagtgtaggaaaagtcatcaggggttttacataaaacagtttttattaaatctcctttggaagggagaattacaactatctgagctaagttttgttgtgatatgaacgatagtgactgctaaaaggatagcatgggaaagttttttgtttatttgtttgtttttgagacaggatcttgctctgtcatccaggctggagtgcagtggcaggatcacagcctactgcagcctcgacccccacccctaagctcaagcgatcctcccacctcagcctcctgagtagctgagactacaggcctgtaccaccatgcctggttaatttatttatttttttttttgtagagatgggggcctctatattgcccaggctggtctcaaactcctggccttaagtgttcctcatgcctcagcctcctaaaatgttgggattatagatgtgagtcactgcacttggccagcaagggaaagttttgaggagtgatggaaatgttctatatcctaattgtggtgatggttacataaatctatacatgtgttaaaattcatagaactatacaccagaaggaaaaggaacccttcaatttcactgcatgataatttacaaaaataaaatttcaaaaattccagtagtcaactctaagccaataatatgttggactatgtctaacaaaagggatattatttaaaaatattgccaactgactatcattaaagcctaataaataataaaaaagtactgtcactccccacatgagacaaaattgtcatctttacatttatttcttaaaattattctttcctggcatctgtaatcatctatggcttcttcatttcctatgcccctctgctgtttggaaaatcagaaaatagaaggcattttggcattcagggtgataggtaaatgcccctattgtaccttctaataggtcaaatatggtgactttggttggttcttatttttgttatttctccagtcatcaatcgtattgatttttttaaaaacaaaggtcaagcacatgttcgtaggtgacaccagttgcttcagtgagttggtcccttctgcttactgttctggtttaaaccccttgtggcattttctactgcatggatagtggtaaatggggttgatagtgacatagaaatgaacttagaagtaagtttatagactgttggggaccatctgttaatgtaaatgtttaaggtaaaatgcattaaggcttaagagctgacgagacgttttatttgcctcctgcttttgggattatgcctggcacctgcttgagtctagagggttcctggttaaacttgggaaacctggtttcctcttttatctgcagctgttcgttttctgggatggaatcctaagcacttatttgaattgtatttgttgaagtcactgggttatacagtaaaaataaggagtcatgttggtttttgttcgaagttttaaagtatgtaaattaaatacatttatatggctaattgtcatttatggttacctactgttaaatagttgtttaatttgttgtcttcagcattgaaaagttaagcagtatcccttagcactatcaatgtcagtcaagataacagttcatttatttcatagattactttgattaaaatcactattaaagctatttgaattatattataattttctggtgatgtcataataaagaagtttttgaacgtgcccattttatttttaacgcttcaatgtgtattactggagaagaaattgaagtaacatatttttactgttaatgggaaaatggtcttcttcaaaaaggaaaaatcaaacttacctcctagatataaatcaataattttcatttctagcattaacttagtagtttaatgacttgggcttatggaatgattttttttagaccacatcagacctacccaagggaaaggaagcacaaaaaatagggaatgatacgtagaattagatggcgagaagaaacgaggagagagagggaaaaagtctgaatgcaagactattgaaataagtgagtaacacacttttccagaaaagattcatattggagttttctagaagcctctgagtatgatgaggaaaaagaagtgattaaaatttgaatggtttccctatgggcggataaaactacctgttcagctggaatgattctgatgaccttgcctctgaagcttatcctttgagatcagcaaaaaagttcatgttctcatctctcatttgagctggagttgattgatgcataattaagatccctaaggaacaggtgcaaaagctgcagcgcttctagattcatccatttctctctactttttaaagaccagtctcatgattctaatactataaacacttggtggcttggtattgggggcagagagcttccggtaggatgacatgagataggatgtcatcctgccacagggaataaattcttggatgaaattctacaggtcatttagcccatctcctatattgcacaggatagggagctggggactcctgaggcaaagtcattttctcaaggccgtgtatctggttagaggcagaggtaggaaggaaacccaaatctttctatttttagaccatttgcctctctactaggccatccctcgctttaacttgggatcttaagcttcccttgtaatttcttgagagtaggttttaatcttcctactgtatgctctagaaactatatgctgggggaaagctgaggggatagcatagagtaatatccaatcttgaatcctttctctcattttaaattgtggtgttttaaattagcataggtaacatagagattattactcagttgaccactttgcacttgatctgagggacattgcagagtcatcacagattcttgagttatgaggtcagtatttaatgaaaggatacgtcgaaggcttttccttaactttcaaggacctgtggggatagtttctactcaatgcttctttttattcgctttcctaataaaactaatatttaattataaaattaaaatgaaacaagtttggacttccgtatgaaaagtcttatacttgatctgtaactacaagatgttagatgttcttcatggagatgacaggcaaaggttacttttacagttctatgaaagtaaaaagcttttaaaacatttgaatgggaattggtaaaagaagcagttcttaattatgtcaattgtctgtaagagctcaggtgattatggtaaacacacctgataacaataacttaagagagcaacaataactttacagcagacacacctgaatgttggtgggagttctgagctaaggaacccagaagtggccaacctgaagatcaattccttgtctacgaggaacatctgatcccctggcctgtcccttggaacatgggccatacaaggagttgaggccctttgttttggattaaatgaaggtttccaagcggacgtggttaggaggagggtactaagtgaaaatgtgatgtaaactgcctgccttttgcaagtggttctcctgtctagcctgctacctctggactctctcccctgtatgcaaggccccagtaaaaccccaggtctcatttgctggctctgggtctctccttcagcctcttgaacatgctgccatccccggtggagtcaataggaagtcggcacaacagacaaggaagagctgtcaccttgcctgataaaataatattctaaaggggaaagtacatatttataacaactggcaagccttatgacttaaatgaacagagctctgctctatggaaacacagaaccaacagtgccaggtatgaatagggaaaacttcttggtagtggtgataccttattagagtcttgaagagggcatatttcctggtacagaaaagggggaacactcaagtagaagagtaaagcagaaaatatataactctccattttctcaggaggtctaactcattacagttccatttaacccaatcaaaaccaatgctcccctttccctcacatctttaccgcattcttttaaagaagcatacgcacaactctttgagcaagaaatatcaggcaaccgctgccatcttagctaaaaaatcttttatgtttgagaacttacctggaagagtcctctggagagagaataagaagatgctttcagttgcacttggagagaatgtgagaattaatcgcctgcttgtttgggaaataacaactagttgtttctggttaaagcaacaccagtatttggatgagttggagcaacgtcagaatgattggaaattgctcaaagctcacaatggtacttgaagtaaaaggatgaaccccttcaagaacaatgctaggttctcctttgctacatggagggcaatggcgcatgataggccagggagaaaagaatcaccagatcctttgcctacttctgccaaatctgttgcaatgtttcagataaatcacttgaactatctgagctttgaagtgcttcagcttccactcaataagaaaaattgtttgaacctctctcattctgctcaccatcttacccttctccttgaagatcagcttaaaataaagtgatttgaagccccaggtgaaatgggagccctttactacctcctgctaaaggtggtaaatgactgtgcccaactttgacctcctctagttagcaacatcattctaaacttagcccagacagaaaaggatgacagcaaaggtttgaacacttttaaaggcctctccctttccccagagttcttatatatctatgtatatgtgtataatatgtttgaatattttattataattatcctccttaagaaaaacaaatttcttggattttccctatgacttgggcttaagaagtctcttaacagttcctcagatgtagtacctgcggaagggaaggattaggttagaatatattcaaagtttgtataaaaaagagggtaaactagtcatttaaatgtaaacatataaacacttactttttactgtgttggctttgatattctttaatttctttgttatatcagccctttttttatgtcatgttgaaaatgtgccttcctggttaaaaggatggatatttggaaacaaggcagtttgaatcacagcacaactatttaattttaaaagacacttttttctaacctatataattcttaattgttctggacatgtaggctatttcagtgaaatttagaaagcaaggccatttcctacagctaagccctttaatgataattatgacaccaacccccaaagacatggtttcatggctaacagatcactctcagattttgtggggatagagtgttggtagcaggaagcggcagaggaattcaactccttcttgagcttcttgtgttttataatcctccctatgtcccacctgttttgtctcagaggggataagtcaatagagctgctgctgttcacaaagccatgcaggtaagagacatgtaccccttgcttcaaagtcttagtaaacttatagagaaaatatgatttgattgcctaacaatatatttataatttacataccaaataagtgaaacgtaaggaaaaaactgctttgagctcccgagaatgctagttgatagcaaacaaggaaggtgctttggtaagaaggttgtttgctttgagcttccatggatgagaagaaatcaagtaatcaaagaggaggaagaggaggaataaaaacatagttgagaatggaacagtcagagacatgtgggcactatcttttcagataggaattttatctttcttccttgttcaacagttatttcatacacgaatgagaaaggccaaacatagtcatgaacgtttgcttttttaccttctgcctcttcagtttttcaagaaacactaaactcgcacctaggaatattttgacaagcttagaaactttttcaaaaaataactcttgtatatggcaagatgttactaaaatcagattttttttttcccatggagacgatgactgcagaacttttcattcacaccctcaaactcgtgcagagagaagccaagatctttcttcttctgcacatttttggcatcattcagtggacttgaaagaaacacagaaaattccatggagaaatatcttaaactccagctcacctcttggcttctttcaggaatgcttatttgacctgaattaaaatgatgacttttcatctctcaatctgaagcataaataaagtaggaattttgcattaggattgtgttttttaaataatcataaaactcatattcaagtacttccttgaggcctctaaactaacacattttggattgctataaaaatagaatcagctttcctttgctaacatggataggtatttatatatcaattttatagaggactgactgtactgtaactttggaaacaccttctctttttaataataagaaatgttggctaagggcttgtctttcctggttctagattagctatgataatactcatccccttatgcagaaaagctgcttttagacttctcattgcttcccagttaatataacatagggattattaaagtctctgagtatgcatttctagatgtgtatagcattagatgaaaattccttaggcctttggaaattcttcctttcccttttagagaagaagatattatcctggctatcatacatagcaagttatatgcatataagataagttcccttttgccatgaaatcaatcttccagttacaccctgggtttgttctttcttttctcatcttgttcctttgcttttcacttctctaattttacccatcaagtgatcatgcatctgtttttcaccttgccctacaaacctctcttagttgctttattctccttccccagtgcttctgtcaccatggcttcatatctggccccacccctaccccatcctatgcactattcaaaatcttcattcccagccatccaccaactgtcagcagaagaaagtccaactctccagcctctttagaaagcagactttattccccacactacataatgcatagtaggggctcagtgataccaaatatgcagatcacataattaagtccatagcactgcctaaacatacatggtatttgaaggaaataagtcctgtcatggatgttgactgaaaatttcccagcatttacagcctagaatttttaatggaaacataaagccccaaatttggagataaaggagctacagaaaacagcagatgtcccagagcacacaaaccatgtggccaagagcaaaagggaactcacaaggaggtgtctgtattacgagaactcgtgcccaaattccttttctgtgagaaaacagtaccatataatccttttgtctcagtaaaaaaaaaaaaaaagtggtccaaagcagacagaatggaatatgcattctccctcctttacccctaaaacattctgtcttgatcaatttcatttttttttgtcaggtgcactagatgttataaaagcacttagcttattgcctggtacatagttatttgaaaaactttgaccatggaaaaggctgaagaaagctaagagtattctatataaggtctggaatgtcaagataagaaatttgcattgatctaacaggtaataagaagctccataccatattctttttacctgtatgtaaaaatcaagaggagttaatacaagtagtattttattaccaaaatagaagttgcatctggctcagactcagcctctgattcctcaggaggtttttcccacccctttccctattcctgctttccagctgatttgaccgaaggacagaaggattaagaaatcaagtagcttatctgagaggttccccatggggcgctttgtcccaggtgttcctgcttggagcttacataatcaggggctttctgcatgctgagggtattattgtaaaggtgattgtttaagtcagtgggtgacggtgtcaggataattatagccaggagatatatgatcataaagacctagttagtaccccaggagaccccaagacagggcttctgcccatacttttgcaatcacacattctgaagtaaggtggcaccatttaccaagtaggaacaaaagtgaatgattagggagaactgtttgttccagtgctctggggacaaaaaaaaaatccatgttaatcttttctaaagtgtccacttttgttatgtttatatttttgttgaggttctttgttcacttgcaactaaaccaacacgtagaactgaatgtgatttctactgatctagaaaaaaataaagttattattaaaaaggaaatctaaaggatgataaattagctgcatatttttctgttcgtctattgttttctattttctctatcttaaggttgtttataatagacagttctacatcaaacttgagatgaaattaaagttgtgaaagatttatgatgtgtgttccagttatggccaccagttctaatatgcagggaacacgtttgaaacgggatcacagttgactattaggatacaggactattcttttcagcagaactaaagagaagatcagagacctctctattttttctctccctgcctcttcttttgtaatcacatgattaatacatgctattgaaaaaggtttcaaaatgtaatgaagaatatcaagaaaaacatagaagtcctttctgactatctgcaaccttagtcgcctctcaagtgggaaccactgttaacatttcaatgtgcagatgtcaaaaaccatttgctctgactttacaaacaggaacgtgcatgcacacacacacacacccttgccctaaaagttttagttttaataaatggtgtatacagtcaacatatgtcctggatatctctccctgtctgtacttgtagaaatatgtaagttccatttaaattcaaagtcaaatacaatttgaagttttgctgaagcttctttctcaatacatgcttctagattgtagtgaataagtgactgaaatcagctagccagtttctaccacaacatgatagcttggttttatggctaaatgagccccaggaaggagtgtgagaaactcccaccttgctccattgttcatgaaggacttgcatggtgagagacccttgggtctcctttcatcccagttttatagtaaaaagatcaaagatcttccccaaagtctctgcccaactgggtccccaccctgttaccttctgaggagtctaaccctgagtactgctgggctttgcagatcctagagttgcgggttatgagtgtgtccagagaaccagagtatgtcatctggattcactcactcattcacacattcatttattcacactcaacaaatatttataccattattcatagggcagacagtgaacattaaaaatgtgaaacaataacatacagtccattcattgtcaaaggatactacagatcaaggaaagaggcaacttcaagaaagtatgattagtacattgaccagccaaatgtagaagcttctgtgtcagacttgacagggtgagggaaagcttcctggacaagaagacatctaattggaatatggaaggatgcttagaatctagccaggtgtggggacttaaagggtaaagcaagtgctacccagaaaacgtaagtaaggcagatctctttggcctgaagtcctcatcaaggagtttaagctttattctgagagtcatgggaaacaactgagaaattttaagaagcaaagggacctgatctgtaagatttatacaatggagaacaatatggaaaaggaaaaagacaccattaggatgctgctgcggatgctggggtgagtgatgttgatggctttaactaagggaatggccctgggaccaaagaagtgtgcatgttttcaaaagtcatttcttgctttctgcgagcgagcctactaaactgcctaagcacaccggttaagtgtggcaactttgagaaacagcataaaccatgggtgacattgcaaaactgaaagcacttggtgcagaggttagataaatatctgtttctagggggatatacatgtgtgcattcattgttttgttttcaagagacaattgtgcctgaggctggagcttgctcaccctatcttttggactcagagtatggggcctggtctattttctacatgaccgggctttagttcagaactgacgagtcatatatcattctgattgattttttttttcttttttctttttttcccctctcaaataaaggggttgcaggggtgagatagagattgctatgaaccatcagggcaactcaacccaaatatgcatttatcaggagccccctaagtcaagctctcctgtcctcacttggtttgtctactcagagctgagataaagaaataaagggttaaatgaggtcagttagtgggtaaaggacagagaaaatagatgaacagcccagcttggactgctctgatctctgccggggagaaatggttagaaggggacatggcagagttacaggattaccaatcagtgtcctaagcagtggggtagagctaacccctgaattgcctaccgtggcttaccttgcttctgaattcttgggtttggtttcatctgtatcctctgttttagccttctttttagtgccactccaaaggcaaggaccacaaagcataagcatccatttttattaaagcagaaaggtgaagacttaaaatgtgcttctgtatgtgtgcatttttaaagcaaccctttgtaagaatgagtggatttagcaaagtagatgcgattgaatcacaatggaatacatgcctcttactcggtctaaagtcccttggttctgcaaagttttttattctcttttcaaaccttatgcaattgtgacttcatctaaattattgatacagttctaagggattagtatcttctgacggcagtctgttcaatatatttgtattttttacccttgaaggaatatgggactgttagggttttaaaagaagtctgagtttttgtttgtttgtttgttttgttttgaatgacagtaaatatccattaaaaagctgtagatttgcagccttgatgattagctctctcttagactccagcaagccttactgaatttcctctggagatcaagtattgaggggcaaaatactggggtagagttgaaagcaatagagaagatttgttgacaatatcgatgattaaaaaaatgagcctttttaaacaagaaattcctgctcatacatttggcttctgagagagagaaagagagagagagagagagagagagagagagagtgtgtgtgtgtgtgtgtgtgtgtgtgtgtgaaatggggaaaaatatcaatgcatcaaaatggacaggtcattttgttgaatgtaactgaactcctaagcattcagagattaggagtattcataatttctgactggcatgcattatgctaatgtggctgtcctctgttgtatgcttctgctgagacagccactttactcctgcttaattttctccctaatggtagcagtagggacttgggtatctacagtgagcttttaccaatttaacttgctgccgctataggccgttataaattattattcttatttagcacttgaatctataatttctttctttccctcatgttctataaaatatagacttagacctaagttagctatgcttttcccttcttataaatctaaatctttcatttgcaacgagctaaagttttggatgctcaacaactgtaacccctgcttggcagactagagagttatcaaggaacttcattcattcattcattcattcacacgtgcttgccttcatacatttattcatctctgaatgcaataacatatttacagagcacctactattttttttttttaccaggcaatgctttaggtgttgaagataaaacagttaacaatatcgatttgtgggaagaagtactacctataatgtctagaaaatacatgtgagatttgaagaaaaatagcttctccatactgatattctcaaagtagtttttctccctaattatctgtacacctccactggaattcttgcgaaggttactttgccttctggattttgaaaagttgtctttgattttattactttctccctaatgtcctagggaaaatatttccttccttcctactgattattgttttagaatttgaaaattactggaaacctatatatgagtattttgttataaaaattcatgtgcatttgaacaagcacaagagtacttcctatgctggatgctagattctagaaaattttaaaaattttttaccagtctcccagttgtgatattcccagttagttaattgctttttctgtctctttctgtttcttcctgaggcccctcctccttccctgcctctctcttttttgattttttaattttattctattcttttttttttttgtagagccagaatctccctctgtcacccaggctggagtgcagtggcaccatctcggctcactgcaacctctgcctcccgggttcaagcagttctcctgcctcagcctcccgagtagctgggattacaggcacatgctgccacaacctgctaatttcttttgtattttagtagaggcggggtttcactgtgttgcccaggctggtctctaactcctgagctcaggcaatccgctcaccttggcctcccaaagtgctaggattacaggcatgagccaccgtgcccggcttccgcctctcttttttttaatgagcaatcataagttattatcaactagcatgcaggtaataattttcttatcttgttacttgtgttccaccactaataactatgagactgcaggcagtttttaacttctctgagccatggctccttccctgtagaattatgcagtacttcttgtgaaaattgagataatgtgtaaaaataaaaaaaaaaaactactagcactatatcagccaccatacttggctctcaccagcattctctgtgacccaatcgccagagctctgatacttattccagactcctggcaccatgtttctattgctgctgcccatattcccctcccccaacagatcccaatcacccttcttgcttgagcctattgctcaagctttctgttttgcctttcatacctgtcagttctaaatcttttccaggtattcttgatctctcatgtcgaccccattctgccactgacaaatctagttctgagagtgtgcttcagagaaatttagatttttgagataattttgatatatagtaatgagaatctcagccttatggcagcctttatgctttcagccaaggtggaatcctggccaaaatgattttttttttttttttactttctgccatggtgcctggaatttcttcaatatagactcatttcttagctcttcaaaggcttccaggtttttagattttccttctaagcctcaaatcctgttggtcatcaccctaaataatctatcacttatcacctgcaacatgctcaactgagataggtcttgtagaaatgaagcatagcctgaagttgagaacagaagaaacaggaggagaaaaagcaccagaagcaaatttattctcatatcccagttttgagaaaagctagcctactgtaaccctaggagtttggcggctgctaatatctaaaaatgcgctggctctgtagcttggaagaaaaagaggaacagccattctctttctgctttccaagggtaagcatggccaacctagtatcctgctgtgcaccatgaagcatcatcaggtgcagattaggaaatgaatttacattaagtttcaagaaagaatttctgacaatgtaagctgaattgacaagaacaaagttctgaaggaagaggccaaaccattactgaatgggtgatttgtggctgaactggatgaaccgatagcattccatggctagaatttgtgtcactggttcattctgtgtttcctcttattttccaaattgcattcaatcgatatggcagaaatgaatacccctatatacaattatttcaatatatcttatataagtttagaaggtgaagcctgtatatatttttcatgtaaatgtagtattcccctgcaactcagtgcaataactacccacagtgctgatacataggactctctcaatttgtcccccatgtcagaaatgctgtgcaaaatccccatagctgactgcaaaacctgccctgaagatcaaataaatgatatacatacgaattcctaataagtgctcagcaggttgtttgggcttatattagtctcctacagctgcctctcgggaagggataccccaacaaagtgtttgttaatgcttgccacctttagagaagtctcctgggatgctgcctaaacctacactgtaagcaaagtggaataacaagccctttgaaaagtcacttgggaagatgacaacccataatggtcactttggctaggatttaaaatgctttattattgtcgaattaaagcaccctggccatattgctctggatataccccgtcttagccaatctcaggtttacaatacaagaacaatctcaatctgatttgcttaatgaaaatgtatccctctactttaaaacagggagataccccagttccttaaaaatatatgttttattgcatatgctttaaaaaacctatttacttagcagtttcattttgtttgcagcctcattgcattttcttctctaattagcagatacatgcatcatctcttggagatgaagcaaatatttttcttttcctcattgggtagtttcccaggaaagaagctcacggcctcactctggctccgggtttgctgtgtgctttcccacacattctcaccctaccacacttttcctgtaatgttgctgagttcggctaatttagatcctttctctaatttaagttgctttcatttaacttggcttgagagtgtctgatacttacactcacaaacaaaactatagagttttagaactcagagcagtgcttcccattgagatttctggatgccacaatggtgcctgcaagaggaaactcatcggagtgctttcatcagcaaggaactggaattcctgaccagtgataagacaagatgactgtggcagcttcagatatatttacaatttgacattcaaaggccaaaggggaaaaaagatttttcccctgtatctcactatttttcagggaggaaatttttcagacgcttcctatcccacccaacctccagtagagttctccttaggtctcattggttaaaattggatacatagtcaccctttaatcaatcgattgcacaggaaaattgaatttccatgatgactatagcctaatcatgatgcatgtcctggggctgacccattttcctgagcacagaatttgttcagtgtaaccagtttctgagctaaaggaaaattcacttaacaggtagagaagaatagatgtgagtaggcaaccatacaatagtgtttgttttgaggacaattatgagtaggttttttagatacattgtatgtcacttgcaagtgtataagcagagtttgctatttttttgagatattttttgagtaactgtcatttctttgtgagatttaattctagaccctaattctctcactgcacagagagggagaggcatgggcaaatatatgggattcctgagggaaaatgtaggcagaggggtgtagggtggccatacaatttataacttaaagcaagacacttctgagagtcaaaaggagagctgcgaataactctaccaagtcaacaggtataaattatcctagacaaactaaactgtatggtaaagtcagatttatataagggagtatatttttaaaatgttatggggaagctaaagctaattttttaaagtttttgtaggtggagaaaatgccacctttatttaggatcataaaaaattccaaatttatatgaaactttttcatgtataattttgtttaaatcctaagtcttatgagacatgagacattgactgtaataaaaagtgcaaaaacctctcagatcttataggtattctatgataaatttggaaagtgtaatattagcatctataaaatcaaaatattgcctgttggtttctgttcactggaaaattataaatgttgatcattttgttttacacaatgcctgtgccaagtcttcctattgtcttcctcaaggcctctaacttgccaggttttagctatcagtgatattagtaagaatctttttggtcttggccgtgatggaagtctgaaaaacagcatttggcaagggaatgacccaaacagaataattttctatagacaaaatgtgtttaagttgatgaatgaaagatgtgaatgctcatgctaggagaaggggaaaagcattggtatttcccttaaagagaccataccagggtattttatttcctgcaagtggtttaattttgtacattgcttctctgctcacagaatgttctctgtctgtcataataaaggagagccttttcattgaaatagacctctgaatctgttttagcgactgcagtgacagtctgtatgtatctgaaagaatgagaggcataagacacctacacatgttcacatctagggtagtattttcaaaaaatggagttactttgaatccccgatcgtctctttcttttactcaatttcaagttaatatctaatgtaaaacttttataaatagcaaagagacttatacttctctagctttgcaatatttagtcttgctttttcttgttggcacggtgtgccctttaccaaatgatccatccaggtgattgatactaaaacatctcattgatttcaagtttacgtgtctagatattagatcctagaaatgagttgttaataaatatcagctttacatcaagagtttaacagaaacatattcctgaacaaatttccattgccttctaaaagggttatttcttggtctgcagagctgctaatctgtaggttgcattcagtctaggctatcagaatagggcaccccatgggacttgatgatagtattgtcacttagatggcaaacaaggcatgaaataccttttcatagaactaaacaccctcaaatggggacatgaaaccctgtacctctgggcacagtcaaaagttgctgtattaagtcatgtgtttccggtacttctgggctcattaacccacaggttgtttcttgctcccagggatcattctttttggtccaaaactaaataaaaaaaatagatagatcttatggattgatgtgaatgttgaaacagaagctctactactaaaatagtggttcataattaataatcccttgatctttactttgtttttttcctaaggggcagataagaaagcaagtacaaagcaaacttaacactttggcagaatgtaatgtatctgactttctaaaattctgtatgccagaataactggctgtttcccattccttgctcttgatatacagccaacagcctagccaggagccatgtcgaaaaggaggggaggcactcagggcagtggtttttcatggcctcattctttatagtacaatagttagtgtcccactattgtacttgtggaatgactctgaaattgtcacaccatttatgtgtaagaattgctacttctctttatttctccaattcaagcttaagttttcctgaagtttccccaccttctggagtggcaggaaatttagcaatttccttttctcataatggagctatatatggttccccagctagccacgacagaaaaacgtcgggatgaggatggttcttcagtcatggtggagacatattttctgtgggtcttttggctgtagtgctttgggccatgccctgtgttgtctgtttgaagtactcccactccaggtgtgttcagtgatgtgtggtcagcaacgctccctctgaccacgagacagcttctgcaaacatcttctccatcctgtgtgcggcatgaagccagagcactggactgtgctaccttgatatttgctgtgggttgaattgagtcccccaaaaggatatgtcaaagaagtcctaatcccttgttcctgtgagtgtgaccttatttggaaggaggttctttgcagatgtgattaaaatggaagctaagatggggccattcataagatggagagtattgtgggtcctcaatccaatatgactggtgttctcaaaagaaaagaaggtaaacacagagacaggcacagagaagagagtgccatgagaagatatggacacacacagggaaaaatgccacgtgaaggcagagacagaggctggagtgatgcatctacaagccaagatatgccaaggatcactggcgacatcagaagctaagagaaagtaatggaaccaattctggagctttcagagagagcattgctctgctcatgtcttgatttgagacttctggtctccagaactgtgaaaaataaatttctgttgttttaaaccacccagtttgttatggcaaaccctaggaatataatatagttcccttctgccctggtatagttccttacatctttctcacccaaagacgtgactaggatcatttaacctaattcccctctgttgagtatttgagaacataatgagaaccttcctaggactggagaagataaagaaaatgctacttcaattttatatttttcttgttatctcaccctgctaagcttacattttcaggaggcaagtaggtattgacagttcccaaggtcaaacttcctggcctcctgactttgttcactctggcatattcttcatgtagaatgtctcttagaacacaggcttttcaattattttcagtaaatgtttactgagtacctcccatgtgcaaggcaatgggaaaagatagtctagatagtcttagtcttcaatgagccaacaatccagagcgacatatagagttatgtaaatatatttaccaagtgttagaggagatcggtgaaggtgtgaatagtttttataaggcaaaaggagtggtggtgtcataaaaatctttacctctaagggttattttgaactgtgtcttcaaggatagggaagattatatcaggccaattaggcaaggacatcataggacaagggaatattatgataaattacatggtaggtttgaaaagaggggttggcatgcatgattaaattataggtggggtgaaaaaatggtagtaagtgagaaaaaggtgaattaagatcaaattgtgaaaaatttgtgagtgcctacaatgggccaggtcctcagctaattatttttaatacattgtcttgtcaggtctgagaggtaaatagttgcattacatagtggataaacctgaaaataaaatgacatgagtaatttgttcaagaaattcagatggcaggtagtcaaggccagagttcaagcttggcataagtcccaagcccctgttcttctctgtacaccttgctgcaaaagtaaatggggaatgcttcagggctcttgagaaaggtagtggcaatgggttggcccaggtggaggattcactggactttagaggttatatgcagagggctgtggcaaaacaggaagaaggtgatttgggatttaaaaagaggaatcctgttggaaaggaggggccatatgtacttaggtttgatgatcaattaattgattgatggttgaagggaataagaaaatagtgcaatgactgtaaggttctttgtttgagtaatgatttgaggatggtgccattaccccaaggtgaattagagacaggaacaacacgttcttgggaaaagataatgagttcgtttttagcttctttaagttttaagcgcctggtagaagatgtccagcagaacattctaaattttggcctggagttcgggagggaagttggggccagagatccatttgtgatttatcaacatggtaggacagccagtgacttttactgaaatacaagtctcatttctgacattccattgcccaagttcctgcaatgattacatgaagctattagggaataaaaaaagacccacgttcttaacatgactttgaggtattgtttgatctgggcctgcctgtgtctccagcctcattttgaggtatattctccttctgtatttcagttctcaaatgtatatgtgaaggtcctttctgacccagttgcccgataccagaatgccttcccaacatacatacacatctgtacacaaatgcatgtgttcacaccaacacacatgtgcaaatctgcacacatacatgcacatctgcacaagcaatagacacatgttcatatgtgtacacatgtgcacacatatgaatagattcatgtgtacacatgtgcacataaatacccatgcctgcacatgcacagatgtgcacatttcatccagtaattccaactaattcctcagattctcatctgaaacgtttttgttatcagggaagtcttctgtgacctcacagtcaaacaagtttccctgttccttctatgccatagcacttattaaattgtgttgagtatttagttttctgtcttattagaatggaagttccatgtcaataggacatgtggaaacatccacatatttcccttcctctggcactctacatggcaaaagtgggcagtagtctttgtatactacaggcacacatgaatgaattcatagacgaatggatgaatgagttaatgaggctatgagtatagatgagatatagtaaacaggtagggggaacacagggcacaggaatatcctccccactccacagtggacttccagcccactcgttctcttctatgataaagactatgactctggtaaactttgaagtctttctttctaacttcttgacctctaaaaggaagttggagttttcattaatgccgtgggtcaggctctgtggaaaatacaagaggaaaaccagacagtcctttctattagtgtctgaattatctcattaattgataccaatgttgaggtaatcaacttctcattaagacttctcattagatggctatttctctcttttaccttctggcagggagtttagagcatttaatcatcactttcctatttatcacttaaaggaaattcacctttcccccagttatcacatcctaatttttctggggtttgtaaaattttaatcttatgatagggcttttttttttttcctttgggtaagcctttagcaattgctatatccaacatttcaaagaagctgtgttttagtggactgaggaatttactcatcaagattttattttgccaacactcattcattgtatggaataataattcggcagttttcatgatatttcatgtctgggcccagttgctcctttggccagaatacactgagactgaaatagcagtttatttcttgcttaagtaatatggttttcttgtgaccaaaagcataggaacattttatttcaccccagacagacacttctcaggtttgtgattttaattataacaaaaactggatgaaaagaatgacttgatcatggcatagatatgccaccatcagaaaaaataatccacagacagatcaatagtatcgttttcatttatgaatactattttaatgtcttatgcacaggtattatctctacaaaccatctcaagccaaaaaaagaacttcttcagtcacacgtgaattgtctacctttccataaaaatgttctgtcaagagctttctgcataaaagagtaaaaattttcaaataacttgtaattttttattttacacaaaatatctgggctaaagaaagtacattaaagcaacttgcatctcaaaacaatacatttctctggttgaagttttagtgaaaatcgatttattcctcctctgagttttacccaatgggtaaagttgtctaaatatgggattccttagaatccatcctccttcccaagcatttccccatgtttccttccacccccaaattcttaccccatttcaggcagagctgagcaaacataagccttctctgaagtattgagggaaagtctgctaaacggctaaactacttaaggagctaacagaaaaggttgtatcagagaaacagtggagaaacacaggtttctaattatatctggcactggagagaatgtcaaaggtactgggcctggggcaggttcacaagagtgaaagtaagagatttaaaataggttctcaactcctgataaaaacacgaatatttatttatttagtctagcttttctttcttctcttatcgttatgattattattactactactacttttctgacttttcttttcctaacctactagtgtttaaacctcccgaagacagaggtcagttctgctttgatcaccactatatactcaacaattaacatatattgggtgccgagtaactgcagagagactgttctctatagttttaaacgttttgaattaatctctccctattctgtcttctagcctcttttcttccccttcagtatggtagcatagactgtcttttccatgttcttgaggtcagtacatttcaggattataatctctcagatagtataatatcagctcataatcttccaacaaaatggccttggatgacggtaggtagcaggatgaagagagtctgcttggactgaaacccaattcaagagttggaacccatgttggcagtatagatgttttatcttgataatatttctttctttcaatgaaatgaaaaagaataagccagaagaactgctttacccaagcccagattcttcaaatgtgctttctcttgattcctgtaggaagacactgaacagaattctgcatttctaagaataaaaaagaaaaaaaagttaagtgcattaaaaaaagagcaaaacaaagaaaaaattaccaaactaataaaatagtacagttggactacaccaaagggaattttcatttgattctacataattacttcaccttactctcctctggacacatcatataatttaaatgaacaaattttaaaaagtatctttctaaaatagccattaatttggggactattatataaattttaccataattgattgtgtttagtacttccctatacagaacattcttttaataagatgactgaaaggcttataaaattcaccaaatagaatctctttatgcatgataactggtggtttcaagcaaaagtatataggagtgaatatttaaaatgaaaacaaccagttaatgaagtatattttgctatttatttccaaataaaaacaagccttggtgtctaagacttagttaactaatttgtgattttttaaaaaaagtatagatgaaaaggtagctaggtagaaatagaaatagcttagaaggctagatacacagatggcttccttatgcagatttaggaagcaaagtaaatttatactaactaaagaatatgaaaggtaaatgacaagctctatgtatcatgactgactatgctaattatagcttataatattctgctggacctaagagccctcctcagctaaaaaacaccataaagttcatttaatacaaccttcatattttactgatgagggtactcaggacttgagagagtagagagcagacacacctacttcctaaagccagtagtgtggtcttctttgaggacattgaagttgagacatgaaggctgagaagtggctgatcatgtgatgagtatgtgaactttgagggggattaatgcttggcagagggtgaaagtggcatcaacaaaattggtaaggcaactggccagactgccagcatcgaaggccatagtaagcaattaagatataattccaaaagctatggaaacattggtgggttttaactgagggaatgatgtaatctgatttatattttgaaagggtactctggttgctttatgaaacacggattgtaagggagggagctagagaggaaaagggaagattacttagaaggcttttaatagggaggttaggagaaagtggaaatattggatgtattttttgggtagtgctaacaacatttgccagtggttcttggatagggaggtagagagagaattaatagaaagggaggaattgagggcatctactttctttttgacttgaaaggctgagtagatgatggtagtgtttgccgagatggagaagactggggtagaaacagaaatatgttttaggttagtatttatattttatttgacttgtattgcctaatccaagtaaaaaaagattaatcctcacctagagccaaatatatattttattttagtcaggaccaatataaatgtgccaaaggaaatgattaaatatggttagtatctattccctatatagtaaacaaaataataatttaattttcacagtggtcagaggccatcttaggaactatatgtgaaggtagaatttgtgaacagggaaggagtagtagctacgtgtcactgtgttttatatgataagtgtgtatatgtatattaatgtgtatggggacagaatgtccctatgaacttaggaaagtgaattcccttgggttagaagacaatgtaaggtagccctgtattttcaagggtgatttttagaaaatcctaatcatttttcctgaagtactttgtgtgaatactcatgaaattatagacagaccaattctcttttgcttagaatgaaaatcatctgttatgccttcatcatcagtgaatgttttgggaacttcaagactatatccatcatccagagttttggcacacacacaaaaacatcgtttgtgctagccttggactttgctacctgacaaatatagtaaagcactcaatggagaaccatacattagctggatatgtaggacatcaaacttaaatgttatgtaatagctatgaagggcacagtttctcttatagttttaaacattaaggagtactgtctgaaacttgaaacttaaaattaaaactagtaaatggcactcttaaactgtccacatccatggtaatcacagttcaatacagcatacttttttgaatgccaccaaatggaataaaatttttcctaaaatgaatgaactctctgcttctagtttaatatagcataacaatacatacatactcaaaaataacttgaagggagaaagaaatttttcctttctagaagaaggggaggcaatttgtgatgcacagtagagggaggagaaatgagagaattaaattttttacgctgctgtcagaaaactgggagaaagcttaaagagaactaatggggagatatcattagagaaaacaaaaactcaaactaaatctctaaatggttgagttggacagcattggagcactcatttcccttgtaatcactctaaaaaataggctactgtctacgatagataatatgacaatttctgttcaggtagagcgtactatttcaatgtccaaagacgttattcttttaagtaatagatgttcagtgaatgttacattggtttttaatggactttccccagttggttgcttatttcctgatatttttatgttgtgtattcagaagagtgtggactggcttcagctaatcctcataaattgtctatccattagcagatttaaactggacttggggctgccatgtttgtggattcagaagtagccttatcaatcaattagccttatcttcttgtaagtttgatgattcactaatcaaacttagaagaactagataattctatttctaatgtttttatttgttgtattctgtagacaaatatttcagaataattttctccaaaagcctgagtaaacaaaggaaaaattttcagcaaaggcagaaaagtttaaaaacttggcaaggaataactcagtatgacaatattggtgaaccttccttttattgtcatacatgaaggaaatgaatatttaaacagattttttccaggcttgtggggatttggcaaccccaggctctgtctgtgataagatcttactggcctgagagtcctgcctagattcattaagaatttctttctgtctctctctttcatacattatatatttttcaggtgaccattttagcaattgtacaagctatttttaatattaaattatgtagcctcagctgcttataaggagagtttaaggagaatattagacatatttataagtatcgtttgtcatgcaagggctaattaaccttgaaaataagcattggcctaccttcccagtacctacaataaagcacactaggccaaatctctatgaggcggtagttttctatttaaaaaataataataataaggtataaaaagttactaacaaccatgcacttgttcccctcaacttaaaagttaaaaaaattagaaaagaaaggcaacatggctaataagatatgtaaattaaaaatttcctactcttctttcatttgtcactatgttttgtttgtaggtagattcaaagaataccatacttgtcatagacaattatttgtattatgttatattattttaatttactcagatctgttgcaatgggaaaaaaattcaggaaaaacaataactatcaataataaatataaaagcatgcattttcgtaacagaaaaactgaagagagttaagacacattgtacgttccaagagggttggaagaacacacataagaaactacaaagagcatctgcgagacggcttgtgtgaactgatggtgtgggccaaccttcaaattgcactgtcctctacaggtcctttctagatccattcctttatcatctcaaatgatgtgcagtaataatgctgcttgcagaatgaactgaattatcatctaccaactaggatgtgagttccatgaggacaccactgtcacttttgtctttttattcattgctttgttccaaaagcttagaatggtgcataccatgtagtagaaacttaataaatacttgctaaatagatggatgcatttggcatttgctgttttgatgacaagtaatatggtctatagtttagttaatatgatgcattaaggtcaactgcctggtttggatcattgttctatagttatgtaaatgttaacatgaggaaaagatgaataaagggtcctgggaattcactatttttgcaagtcttctttcaatgagaaattattattttatttatttatttatttatttatttatttatttttttattttttgagacggagtctcgatcagtcgcccaggctggagtgcagtggtgtgatcttggctcactgcaaactgcacctcccaggttcatgccattctcctgcctcagcctcccaaatagctgggactacaggcacccgccaccacacctggctaattttttgttcttttagtagagatggggtttcaccgtgttagccaggatggtcttgatctcctgacctcgtggtctgcccgcctcggcctcccaaagtgctgggagtacaggcgtgagccactgtgcctagccagaaattattttttaaaaagttttttgggaaattgagaatggagaagggaaaaaggagtaaggacatgaaaggctgaggaccattgactctggaatagtgcaggaagacaaggtatgggcaagaaagagctgatgtgagtgctggcaatttgcctctggaaggccaaatagcatttgactactactcaatctttttggaaaatcttgaattaaaatctcaaatactcactgtccactgtgaaatttcaatttcatcagtattcttttacctgtgctgcttttatctatctgctgatggctgctagtgctagctgcacaaagccctgagttctagaccttctctccctgcttaaagtttattaacaagggctgggcacagtggctcatgcctgtaatcccagcaccttgggaggccgaggcgggcagatcacctgaggtcaggagttcaagaccagcctggtcaacatggtgaaaccccatctctactaaaaatacaaaaattagccaggcgtggtgatgcatgatatagtcccagctaatcgggagactgaggcaggagaatctcttaaacctgggaggtggacgttgcagtgagctgagatcgcaccgtggcactccagcctgggtgatagagagactccatctcaaaaaaaaaaaaaaaagtttattagcaagtataaatgtatcagaacttaacaggtcaatttcttgtattattgtgagactaaaaaaaattgggaaaaaaggaaagctttgaagagaaaaaaatgggtagccatcagaatcattttgtgaaaggaacaaatactaataagttaatctattgttctcaacaacctgttatccataataggaaaggaatccagtatgtgcatgactaagttaactactcaaaactttcaaaaccagaagccaaaagaagttatagtttattttaagcaatatccacaaaacctaatatagtccacttctgagtaatcatttaattatggtattctatcattttatttttaaaaaatatgctgagtacataaacatgactaaaatatcaacacattctttcttcctacacataactattaatcttaaatgttccaagagaagatgtttaaaaagtaaccctttgcagaactagcccttctctctggagctgtaggcctctcttcttcccagccccctccttttcttttcttttatcttactcgtcaccttgcagtcatgagtattgtagcatgtaggagtggactgctgagagaagggaagaaggatgcattttgcattcacttgtacatcagccttgaagcctggctggcggcaatattgtggacaatagatctttcaaacaaatagacccttgtctgttccttccttctgtaattgttggcagagttctttgttatgtgtctggtttcttgaaactttgaatgaataaactaggacacgggattaatgtaaagaactggcatctttgctgacttattcaacagactgtgtgtacatagaaaagagaaataagcactttcagaagtgttgtctgcacatgcctgggattttacaaaatttaaacaatgtgaaatgcagtaccttgaaaaaagccaggctagtctctggactctgtagtttactttctaaataaaaaatatcctattgaccataagcaaatgaacaattcacctgttagcatatggaccaaatataggccaagatatgtagtggtagagttacaagtaaattttttgatgtgaagtgtcatagaatttacagccaaatgaagtgagtacctctttgtagcagggtaatgatgaaaaagattaggcaaagtttaaagttgagacgcagttttcctacctggagagaatggacattgttacctaaaattcacattgtacaatggagtgatacatgagttgttcacagtagaccgacctttctcagcctcagctctgttgacattttcaaataacaacttgctgttagggactgttctgcacattgtaggatgtttagcaccattcctatcttatgcctgctagataccagcagcactccccttccaattgtgcaaataaaaaatgtctccagacattgccaaatgtcctctggaagtcaaaaaagcattcctggttgagaatcattgtactagaccaaggaatggatcatattgaccagaaggaagttgtatattattaaaaaaaattatccaactccagaagaagtatactggggcagtctaacttggggaccttttgaatgtctccaccatgggaacaaaggctaagtaaagcagtggcccattgctcagtccaacagcactcctccatcaattaccccctcttgactttttgtgtctttagtctcttaatcggcctcgacttcttttccttgacctttaaattgtctcctttatcctaaagcaaatcaaaattactcctgataatgcaaaggtataaaattactatgatgtcttcacatcactactaacttttttgaaaagtagtcttcattctctacctctacttcctcactgtctactttctggaatacatcccagtttggttttttccccctatgtcactacttaaagtggctgcccaaatgctacaatccaacttctcaatgatcacattaactgaactttttgtgtacttatctttgacttccatgcaacttttgatactcttaatcaatggttctgaaactttttttgtgcatcaggatcactggtgagttattaatagttaaaatacagatttctgaattcaacacccagagttcctaattccgtcgggctaggatgtagactgaggatttgcatttctaacgagttcccagatactgtccacgctgctagtctgggggatcacaaatcaagagccatgccttgattattctcttcttgagtgcttcagttgacttttacaataccatagtttcctgatcttgacgcttaatgacatttgtagtcacattttctggtttcttctaccctttttctctaaaacagggcaatgttgcccctcagagaacattggtcaatgtctggagatgtgtttagttatcacaaataactaggaggaggggaagaaggaagagaagagggtccactgctactgatgtctagtgggtagaggccaggggtgctgctaaacatcctacagggcacaggacagtattattcacaggacaaagtattattcgtctcaatatgtgaatactgccaagatagagaaacactgctctggatgcaggcattctctccaagtagatatatattctttttttttgttatgagacagggtctcactctgtcacctaggctagagtgcagtagcacaatcatagctcactgcagcctccaggaatcgagacctgttgatattttagtcatgtttatgtactcagcatatttttttaaaataatatgataaaataccataattaaatgattactcaaaagtggtctactatattaggttttgtgtatattacttaaaataaactatcacttctttaggcttctggttttgaaagttttgagtagttaacttagtcatgcacatactggattcctttcctattatggataacaggttgttgagaacaacctggtcaatattttggagagatgaggacttgctatgttgctcaggctggaatcaaactcctgggctcaagcgatgctcccacctcagtctcccaaagtgctgagattacaggtgtgagccatggcacccagcaaagaatggcctttttatcttctcttcagtctatacctctctcttgtcgacctcagacatgcccagcacttcaactctcacacgtctctggaaatgactcccagaggtattatctttaaatacgacattactcttgggtctggcctgaatttgcaactgcctgataaatataagcttaatgagccaccggcatcttaagtttaagatgcgcaaactaggccaggcacggtggctcacgcctgtaatcccagcactttgggaggccacagagggcgaatcacctgaggtcaggattttgagaccagcctgaccaacatggagaaaccccgtctctactaaaaatacaaaattagacagacgtggtggcacatgcctgtaatcccagctacttgggaggctgaggcaggagaatcgcttgaacctgggagacggaggctgcggtcagccgagattgcgccattgcactccagcctgggcaagaagaacgaaactctgtctcaaaaaaaaaaaaaaaagaaaaaaagcccaaactaaacatatccttccagtaagagaatcctttattgccagtaatggtaattatttgataaggtgtgtctctacccccttttgaccttcataacttgtaaaaatggtacaagatgattcttttaagaaaagtataaaatcacatgtatggttcagaaataccactctggcaggaatttgaggaggtgacagatattcaagaaaattgaaagagaaactttccattccatgtgagattatctaacttttgattggccagggagaaatgtgtcttattattccaagtgaaagtaaatgtatctgcctgcctagatctcagcctagtattgattggagaaaatactgatctgatgctttatgcttcgagaaagaaagcatattgagtatatgatcttctcacacatatgatcagtcttttcattagatttgttttaccgtgatgtattttgttcctcaatagaatgccatgtatatgattgttactggtactcatagtaaatctaataatatccaccattttcagagcacttactaagtgtcagaacaagtgctttgcatgccatcttatgtatactaagcctatggggtagattttattattgtacccattatgcacccatggaagctaaagactagagagaatgagggatacacgcaaggtcacctagatcacaactggtataattaggatttgaagacaggctgtttgacacctaagctgatacttccaaagactattccaatagcacaaaattcaattgctgtggggacatggttctcagaacctggtcttcttgaatcactagaccgatcctcctcagaatttaagacctgggtggaaagggaaagaccatccagctcaccccatgtgcctctcaggaatggtgggggttgtcctccattactgaaagaagcagtacagccggctaatggatggagacacaggggagagattttctttgtgggagttcattacagaggcatctgcagacctctaactctctcctgcatgccctttctctttcatagcttccatctctaagctgtaatggatgcaaaattactgcagcattttgttctgccgggctgaccccattacgcatacaccacagtcataaagctctggcttagttactgtttgcatgttcaagactactctgaggcagggaggtgtgaagtttggctacattttcaaacagagtggatgccttcttcattttaaaaacaaggaatccagcctcctttcagagtgaatattgttttgattactgctggactaatccatacttatttaccccttaatgatgatgtttctctggtgtgtgaagggtctttaaataaatgttagggcagtgatgccaggaagtcatcatttcacatgcattagttgcagaagtttgggagacttcatttccaccccaacatcctgttgtcttgataatattttattaagacatagcaaaagatatagcagggtcgttagataatggttaataaaatataagagtttggaaaggtagtgattctcaaaagttattctcagtcttccttcttctccatgccttgtcaaagatttctgcaactttcatctcaccacatctggtgagaatacttatcagagaaagtgagcaaactggttttggtaataattgacatacctttatctactaggagattctgattttaattcattcagtaaaaaaatattctgtttgttctatgcacatttctaacacttgagacatattcaagaataagacacacatagtccttgtcctacagcttacattctggtaatatttgtcagaaagcagtcacatgattatgaaaaggttacccaaatttctgtatattctatagtttatcctatatcttcttccactatttcacacatttcataaaagatctcaacatataaatattgcttttagcctgtgatattgtctccatggagggaaggactcagatggaaataaggtatcacagaagggtgcagagtgccttttcttttaaagtaattgcaaaaataggagttatattggttatcagaacatgtttgtatttcattattaagctggtaaaaagaaccatggatatatggacatgttctggatcctagatacttaatagaaatgatcactagctgtccctaaaggatttttattatacttcctaaaagcatggactatctcttctgaggtatgccccccaaaatgtcagtagcaataaatttgtaagaacatttttaaggcagcacagacaagtgtgatcggtagaagtcatggtgagtgggagtgaggaagggctagtagcaaacaagaaaaagaaaagaaaaaaaagcattttcagtctttggcagcacttctgtctcttccagcatttgtcagaatccagttattaacctgtcagcctcagacagattgaaggagacaccacctttcaaggtgagcccttaagaaaagaaaaataagaaacagtcattgttggggttgacagagacatgatcccaccaaggcctgggctatgcttggagaggaaatgatactcaagcctgagtgtgtgcttaggggtcaagagattaggcttaggggagtagggatatggaagtagtgatagcagtgaataaggaaagctatctgtttgaatttgcttgtgcaaagaggcagaaccatttcaaagatacagggtgcagattttagtgaagatgttagagctgacccctgctgggactgtggcatttcagtagaggaatggtgaatcccttcccagtggggaacacacatcatccacatacatgagggaaaaaaaaaaaaaaaaggaatgactctttttatcaacaaaagcatgcccttatctatgattgtggtgtcattttcttttaacaaacaaggatagtttttaaccttagtttgctcacaaaagcttcagcaaaaaacaagggacatcaaatatttctggatttccatgttctgggcacatagtagggctgtgccttctgaaacttcctgtatagaatggagccacatgatcatttgcaatcaatgagctgtgaaggggaatggcatgtgttccttacaggccaagcatttaagtgttgatgtgagagtcctcagagcacttttttttcttttgcctttgtcatggtgccatggctaccagcaactttcagacagtggccattgcatcaacctcaaccctgaagtgaggaaccgtggcaacatgcaggcaagcctcaagcccgcccacagtagacaaacatatacctttattgttataaaccattttggacttgtttgttactgcagcataatctggctcttatagtggacacatttggttagatacaagtgtaagaagttttattttccttgatgaatagtgggaaagtgtgtatataatattgtaaaccttttttagcacccaaattaacacccctatgtacccaaagtcctatatctgggctgcagtatccccaaagacattttgtttgttttattttagtcctgtaagaattaaagtcaactttttaaaaaaatgcagtgctaagagagacacgacaaaattgagacaatttattagcggattctttcttttctgaggggtctttttgcatgtaggagcagtcattaccatctgtaaggtgtctaaagctcaatttatttaaatcatatatctgaagaccaaaacttttaaaacccaaattttgtttttaaaactttataaaagatggtaaattcctcttcaaaatttaaacttcaactccaaatttagtatgggtgatttctcataacatttcaaataccttttaaaatacataccttttatacttaaacttaaatctatagtaaattatgagtttggttcattttatcattatatctctatgtgtttttgtattttctgaggattatattagattaataccaatgaatctattaaatagttgttgcttctctaatatgaatcaaatctaagctgctgatcaggctgaggtgttgtttttaaatcattaaatttatttattgtgtcaagacataattgcctttcccaaaaagtctaaatgttttcctataatttgctgtctctccacaagtaatacatttttaaaagccatacttggtgagattatatgatccttgttcattattaaatattgccttttatttaacactattaaaaagatatattcttataaacagcttatttaaagtcaggaaccatctggaagtttcatctcccaaaagatgagatgaatccaaatagttctttctctttctagcatgtcaaactaatgtgtcatcctagaatgcatctctgagccccatttcactaggttattaggtgtgaagcccagatctagaccaagcctgtctgctcttggtaagcctctttctttttttcattttttctaatactgtttgatgtatttcctgttatttttatttactgttttctacttatccaatagtaacatggccatgcctatactttattactttgtaaacaagtacctaagtaacagctaaactaaaacatacatgttcatatattttagcattcccctaatcattgaaatcaataacaattcaatatactctattgtattcatatttattttatattaccactatgttttatgtaataatattctgtatattaacttttctgagcatcactatgactttttcacaaacttagcttgttttaatcaacagtaaaaatgaagagtgatgttgttgttagcaatcttatttagtgttcaaattattatcaaatggccagcgagatctcttttaaatgggctccttattctttcagcactttatttgatatttgtggccacatacttgtattttgcaataaaaaaaaatttagattctttgcaattattttcttccgctaagcagaaaatcaacaaaattccagagaaccttgtgcaaatgagtgttgattgtggccatggtgcacctgcactttaagtaataacaaagctgaaaaatatatttcttttagaggtcatgagttcacactgagaagtgtgaactcctcatgagttccatgagaagggcataactttaggtaatttcttgtaagctcattgccactatgtaaaccagcttatgattcttatctagttggtcagtatactataaatatcagtgaatattcagaatagaagctgatagaaaaatcaaaccatagaaaagcagggagagtgtgagaatatattcaccatgtgtacatatatgcccctaaacaaaagcctgaaagtatctactctaaaattgatttatcctcctcactatcctttttaaattttttatattattcaccttttcttctttgaacatattttatttttgtaatgagaatgcaaagatgttaaattttttaaataactaaagaaaccgttccagcaggaaatagcactatgtgttgttcaacatacatagtgaatcttgcatacacagcatattaataaaatctcaaaaattgcttactctttacaagtaggagatattttgctttttgtgtccatactttccctttagaatgaggaggattctaagtaatcttattgtatcacatttctacttcattgcattgctctctaggggggaaattaacagcagaagacttgtcacttgagttctattcatgaccactctactctgagcattacagatggaatgcagcaaagaggagatacaattctaggggaatatgggcccatagatctttcaaaacaaagaagaaaagctttctcacaattgctatagcaaataatgctttccactgctttagagtcatcactgtaagaacatttgatccacaagtgaagaacaggactatattccatgtggcttttcaaggcgactgagagcacctgctccctagaatccttcagccacattgatatgtgtgtcataaaactgtgagatcatgatcccattgatgtgatatgaatcaagaaagccatatgctctttgctggtataaatgatagctgcatgagggcttaccaataagtgaggaatgaaatttgaattttggaaagaagtttgtagctacatgaataccttgcagcctctcttttcaatagtctcaacatttttactgccatgcgatttcttctatagctccatttatatccaacttaaatttcactctaaacattttcattttttattttttattagacaattctcttttgattatctcgttttataaaatggcacatgggtttatcacttggagacaaagaagcaataccctatatgctgtgtgtgaactgagcaatacgttcagtgaccattaactgacagacttcacaagaactcatgagattggtcaatgatcacgaagtgcatctgtaattcatgtagctaatgtggactgaagaactaagagcaaaacatacacttcgtgcaaatacccacagttaatatagcatagaaacagaaatttaagctctgttgttagaaggctggagttatgaaccaaaccatagtaactaaaattcatgcatattacaaccaagcaaaatgcagactacctgtgtgtatatgtacatttagtatttttttgtttgtttgtttttaactttgtagcttcagcacaccatgccacaaactttgtgccttataataccttggctgaatatcttctcagaggatgatcattcacttttacctttgtttgccaacttattccactgcggctctttttgtcttgcaatgcattctgtgtactggtgaagaagttttgaccacgaatagctgacaaatatgtgcaggtggtcatgcacagaagcagaaagaaaattcctctgtggttgttaacgtgaaggttttccaggggcttggggcactggttaaggaaacagattaatgagcagcaaacaggaattgatgggagtcctctgacattttgaggatatccctacacatcactgcaggctgagggaagcttggctgaaagaaactggccagaggcatgttctgactttggctgacttggaaagaatggcagtgctattaacaatgtacacatagtgggagaatttcctctcagtggaatgatgctttaatggtcccatataatgctaatgccattagcactctcatttccagatactacatgggatacataagtagaagagttaggaatcgttttctgaaaagacattctaatattatttggatattaaataaaaataaatacctctgttaagatattcagacccagtattagtgtaagtgggtacagtagaaagaggccttaacttggaatatgtagtgattaggtttaactcacagccctgccaattattagctgtgtttgcccattcatttattcatacatttgtatacattcttttattttcttacaaatctttaccaagtgcctattacgtgccagatcccacaccaggctttacgcagtcagggtcaaatcacttcacctcttcaagtttctcacctgtaaaattctgagacttttttgaaatctattttttaaaaaatacatacttgattcaaacagcagctttataatttgaaaacctctattttactcctgtttttctttggaggccaaaggtgactctaaataatttcatgaaagtaatgaaaatataatctttagtgattaacttcagaattaagagagtaaaaagtatttttcaattcatcttcagcttatgccatcacctcagcaagaacaatgagtgtgcaacaattcactgttttgtaggatgctaattagagggtagactcctcatggaaaaagcccaagcctctggttgactcctgtccatccagatggagctacaatgaaatgattttctatggctgtgtgtgcgtgtgtgtgtgcgcgcgtgtgtgcgtgcgcgcacacacacacacaagcctgggaaggaagagccccccactctgtccattattcaactcaatgtttactgtcaagatgagttttccaatttccattgtttcccctaaattgagtctctcacatagagtttagagctggtatgtctgctaggaaatagctatataataaaacatccatataatagcactataattcatccagttattcattccttccctgaaaaataggacctaaaatgcatcattgtgtgtaggtttcaattaaattcagaggacagttattgactgactactgcatgcaagctggctggactgagagtattgagatggataagaaactgtcccctctcaaggagcttaaaatctagaggaaagagaggtgtataaaatatataattgaaaatgtttgctgtaatttctaagagaacacacctggggatgtgaaaatggacagaagggaggatttagctctatcttggaggctgggatataagtcagggaaagcatttcagtggagattacgcttaaagtgggagtactgtatacatgaataagcagagcaggccaggtaagcaaagttgtggttggggaaagatgcattccagacagccagaatgttttgcctcattggaagattgtttttctcacccttagcaccctctgcttattcgtctctttgtttttaaccatttctaagttgtatcttaagactctaatcaatgtaatgggatggctgtatccctccccactccatcccatatcacaccaccgaatgagcaacaaatcttggcgtctgaaaaatgtagcacctgacgccaatcaaaacttctgctcacagctctaatgtaggtctgggggcttttctgtgttacttgaaactagtattgattgcatcagcgctcaatataatgccccagtagtcatccttgctgctttagctgaggaacaaaaggtaaaatcaagctaaatgaaatgaggtaaatgtaggaccagaaaaaccagaagtcttcattgcctgctctcaggcatcatcaaaacaaaaggctctctggctggcaaggtcagtaagggagacgagagaggataggaatactcagagacaatatgttgccctgctaagagcaggtcatggtccttaatgtaagccatgtcatttgcttacagtctttattatttaatctctgacagatggaaattggttgagaacaggtaatggtacagagtcttctgtgtgtgcttgcatgccagtgagatctactgggagaattaacttctactctcccagcacaatcggtggtcattttgagtgaccacatcatttatctccaaaccaggacaccttggagaacacaagaggatactgttaaataaacgtgagtgtataataaacacacagtgggacttccccaggcaaacagggactcttaggggatgtatgatcaccttaacatgttttctgtctggagggaaatttccaaggagaaatataagtaatacctggaacatgactctagaggtaggctaagactgcagggtattaatcaatgtataagtttataagtttataagcatgtgaaaacttcaaatttcagcaatgattctctaaattttttgctgagacagataaaatagctgtttttttttctcacacagagtacattctcataggaatatctgaattacatgcagttcctagaaagcaagctataattacattattcaagaaaacactgcagttcaggctaatgtttttgtatatttgttttgtacattttgtacatgtttttgtaatgtgtttatacatatgtacatagaaggctttacatttggtgatcagcatttaaattatttacgtacttaaactattacaaatacactacttggcacactctttccccagatcttcatctggctgtcccttttcatcttctagatctcgactcaacatctccttcttaggccatttctgaccactataactgatccctgtcacgttctatcataatgtccttttgccattttcttagcacttattagtgtataaaattatcttctgtatttagctgtgagctttcctcactagaatgaaagaaattatggacaatagttccacctaccttgttcagtagtacacctccagcactttgaaacctgtggggaaacaacaggtactcaacagatagttgttcattggatggactgatgggaaataggccatcttgtctttattgaacaacaacttttgcaggaagcattctcctcccttcatgatttttgtgcataggtaagcacctgcttagacaactccagttcctgctctcacacttcaccactggattgttgcaatgcagtcttaaatagccctcgaatatggactcaaccacatcttgcaacaagattgtcatcagcacccctttcactatgcttggcctctatatactttactcttagccttctcctgaattagtcttagcccagtaacatcttgtgctgatgtcagtcttctggttgaccaagtaaacgtattttttcatttcctctttttttgctcgtctttttcatctctcgctgatgattgtcaactgcaatgacaccgtacttttatacactgcatgatgtatacttactcagaatttttcttattgccaaataaattatttcatacgcttatgcaactcctttcgttaaaagcatgttttctactttgttctcattattaacagaactattttttcagttatcttactcattgcttttgcactgattggacatcacagcattcaaaatgttcacaaagtacctaaaaaattgaacacagaggcctctgtggttagggtgactgaaaaacttaactggatttttaagtcagtctaattttaattaacttaaactttttttttccatagttcagagcatttatttatttttttaaatttattattattatactttaagttttagggtacatgtgcacaatgtgcaggttagttacctatgtatacatgtgccgtgctggtgcgctgcacccactaactcgtcatctagcattaggtatatctcccaatgctatccctcccccccgccccaccccacgaccgtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtgttccatggtctatgtgtgccacattttcttaatccagtctatcattgttggacatttgggttggttccaagtctttgctgttgtgaataatgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtcttcctatttctccacatcctctccagcacctgttgtttcctgactttttaatgattgccattgtaactggtgtgagatggtatctcattgtggttttgatttgcatttctctgttggccagtgatggtgagcattttttcatgtgttttttggctgcataaatgtcttcttttgagaagtgtctgttcatgtcctttgcccactttttgatgggattgtttgtttttttcttgtaaatttgtttgagttcattgtagattctggatattagccctttgtcagatgagtaggttgcgaaaattttctcccattttgtgggttgcccgttcactctgatcgtagtttcttttgctgtgcagaagctctttagtttaattagatcccatttgtcaattttggctttggttgccattgcttttggtgttttagacatgaagtcctcacccatgcctatgtcctgaatggtaatacctaggttttcttctagggtttttatggttttagttctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaaaatcagatagttgtagatatgcggcgttatttctgagggctctgttctgttccattgatctataactctgttttggtaccagtaccatgctgttttggttaccttaggcttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagctttatggggatggtattgaatctgtaaattaccttgggcagtatggccattttcacgatattgattcttcctaccgatgagcatggaatgttcttccatttgtttgtatcctcttttatttccttgagcagtggtttgtagttctccttgaagaggtccttcacatcccttgtaagttggattcctaagtattttattctctttgaagcaattgtgaatgggagttcactcatgatttggctctctgtttgtctgttgttggtgtataagaatgcttgtgatttttgtacattgattttgtatcctgagactttgctgaagttgcttatcagctgaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgtgtatattgaaccagccttgtatcccagggatgaagcccacttgatcatggtggataagctttttgatgtgctgctggattcggtttgccagtattttattgaggatttttgcatcaatgttcatcaaggatattggtctaaaattctcttttttgattgtgtctctgctgggctttggtatcaggatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcatagaagtgtttgtagtattctctgatggtagtttgtatttctgtgggatcggtggagatatcccctttatcattttttattgcgtctatttgattcttctctctttttttctttattaatcttgctagcagtctatcaattttgttgatcctttcaaaaaacgagctcctggattcattaattttttggagggttttttgtgtctctatttccttcagttctgctctgattttagttatttcttgccttcttctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatgtttatttctgccttcatttcgttatgtacccagtagtcattcaggagcagattgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtctattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatttttgttggtttaaagtctgttttatcagagactaggattgcaacccctgcctttttttgttttccatttgcttggtagatcttccttcatcctattattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctcgttattttgttcattagttgatgcagtttcttcctagtctcgatggtctttacattttggcatgattttgcagcggctggtatcagttgttcctttccatgtttagcacttccttcaggagctcttttagggcaggcctggtggtgacaaaatctctcagcatttgcttgtctgtaacgtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgacctttctctctggctgcccttaacattttttccatcatttcaactttggtgaatctgacaattatgtgtcttggagttgctcttctcgaggagtacctttgtggcgttctctgtatttcctgaatctgaacgttgggctgccttgctagattggggaagttttcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcacttcatcttccatcgctgataccctttcttccagttgatcgcatcggctcctgaggcttctgcattcttcacgtagttctcgagccttggctttcagctccatcagctcctttaaaaacttctctgtaatggttattctagttatatattcttctaaactttttcaaggttttcaacttctttgcctttggtttgaatttcctcccgtagctcagagtaatttgatcgtctgaagccttcttctctcagctcatcaaagtcattctccgtccagctttgttccattgctggtgaggaactgcgttcctttggaggaggagaggtgctctgctttttagagtttccagtttttctgctctgttttttccccatctttgtggttttatctacttttggtctttgatgatggtgatgtacagatgggtttttcgtgtggatgtcctttctgtttgttagttttccttctaacagacaggaccctcagctgcaggtctgttggagtacccagccgtgtgaggtgtcagtctgcccctgctggggggtgcctcccagttaggctgcttgggggtcaggggtcagggacccatttgagggggcagtctgcccgttttcagatctctagctgcatgctgggagaaccactgctctcttccaagctgtcagacagggtcatttaagtctgcagaggttactgctgtctttttgtttgtctgtgccctgcccccagaggtggagcctacagaggcaggcaggcctccttgagctgtggttggctccacccagttggagcttcctggctgctttgtttacctaagcaagcctgggcaatggcgagtgcccctcccccagccttgctgccaccttgcagtttgatctcagactgctgtgctagcaatcagagagactccgtgggcgtaggaccctctgagccaggtgtgggatataatctcctggtgtgccgttttttaagcctgtcggaaaaacacagtattcgggtgggagtgacccgattttccaggtgctgtctgtcacccctttctttgactaggaaagggaactccctgaccccttgcgcttcccgagtgaggcaatgcctcgccctgcttcagctcacgcacggtgcgtgcacccactgacctgcgcgcactgtctggcactccctagtgagatgaacctggtacctcagatggaaatgcagaaattacccgtcttctgcgttgctcacgctgggagctgtagaccagagctgttcctattccgccatcttggctcctccaacttaaacttaactttaaaaattgatattcaattcagtcactggaagacataagtatgtgtgaaactactcggatatatgaattactttttcagttgtaagttttgtgaaatgtatatacagataaaatatttctagtaaaaacagtgtcagaattgagatgtgctgtaagtataaaatacacatcaaattttgaagacttcatatgggaaataggatgtaaaatagcacatttacaattttaaattttgatcacattttgaagtaatattttgaatatattgggttaagttaaatatattattaaagttaattatacctatttctccttttttggggtggctgctagaaaatttaaaattatatatttgctttgcattatattcctcttggactgtgttggcctagatcgtttattagcttaggcaacataatgcaaatttacattaactttatttggtcttcatcatattaataataaaagcaaaacaaaacaagaaaccaccaggtgctaatagtcacaggctgagttccctaggaacagactctgagattgagtttagcatgccacataatttttaaggagttccctggggaaggaagtaggattgagcagagagaagttgagctgcgatgcaggcccaacaatgggctcagctaaccccacgaggagctctgacactaacatgacctttcagtttgtcctgagttgggccaagatggcaaagtctttctaccccatcatcaacaggtcattgaatgcgggtcactctgggaagagcatgatcttaggcaagatggtgctctgtgtctgaggccaaccctgaaggcgctggcagctgaaggctgtctatggacagcactctttgcagctcaggtcaggcagtaagtctttagttgcagggtgagctgggcagcacattacagtgtctactatactaacattttttgttgaagatttcccatgaagatattgattattgtctttttcagtttttaatcagatgcattggctaatacctgtttgtagctgaagctaagtctgtcctcttaggccatggtgtgaattgtgtgtttccctttcttccttcatctctggcttagctcctttcattaccttcatggcccctctagaagtttatgttaggtttttaaggccagaccagactgacttgagcccagccgtaattggagaccagattcaaggctctctcttggtggcaggtgacattagtcagactttattcttatctatgaaagttcataagtaagtgagcttttgtgtttttctgcttaactctcattactacctgttatctctttgaagacaagggatatgtaaaggtacatatatgtgtatagattgtgtatgtgtttgagtatgtatgtatgctttaagccttgttccaagattggtttatattagaaactaaacaaatacagcccagcacggtggctcatgcctgtaatcccagcactttgggaggccgaggcgggtggatcacgaggtcaggggatcgagactatcctggctaacatggtgaaatcctgtctctactaaaaatacaaaaaaaaaattaggtgggcgtggtggtgggcgcctgtagtcccagctactcgggaggctgaggcaggagaatggcgtgaacccaggaggtggagcttgcagtgagcagagatcgtgctgctgcactccagcttgggcgacagagcaagattccatctcaaaaaaaagaaaaaaaaaaaaaaggaaagaaaaaagaaactgaacaaatacgttatttactgaaggagtaaatatgtgtgacaaccagtggtgtcctcattccgtatctccatcttcagagaatgcttgtgtgccttcaaatttatgacattttcctctcaccccttagtggtgaagaaactgaaatattgaccccatccccaaaaattaataagttaagtgtaagtggtacctgtggtccatttgaaagggaatatctgaatggaatgggaggacagccacctattctcagcaggcagaaagggtacttgtcaacaggtaatatgggaaagctaagaaagattaagactttatttttccctatagtctgcctttctgtgttcccaattctttacactgctgtgtaatgttatggaatatgattctcaattaggaaacttgaacgaagacaaaaaaaatggtaagagactatcttctaaatatatccttagttcttcaggcagcaatttaatttcagttaaaagaaagaacaaaggcatgtcaatgttttggactgaggctaaccgaggactttcactggcactctttttagagctagaccattggggaagttgcagtgttacataatgctatgcttctcattgccatagagaagcagcagctgctttgagactttagaaaatcagcagcgacttgaactctgtgttgcttgtgtccagaaaattccaggcactttgtcaatttttttcttcattttcaaattatccttttgaggaaaatataaaggagtaatcccattatctctattttagagataattcagctgagtttcaagaggtttgttgtcttgcttcaagttgtccattagcagaacgaagaacaaaatcttgctttctgtctttcccagactgattctctattgtagcttctctttggctgttgatataatatcaaatattttgtatgtatgtgaaaaatttgaaatttcatttatttcactagtttaccaaatccctgcctttcactgctgaccaaggttagaactaatataaaactatttcctttagaatgcttagtgaatattttttgccactaaggctaaaacaccactgataatttttactctctcttgtatatgtttaaataacagaatagaaaggaatatgggaggtacatgatatggaatgagacacatcttgactaaaatattttagtttagagcaaattttctctgatcatagttattcaaaggatctgtttatttgtatgtggcatgatggtgtgtgtaacctcacaaacaaatgcagagcctgggaataagaaagatgacttatggtttcacctccaagattttgactctgaaaaagtcatagaacctctccctttcatagtttctctccctctctctttcatataaatatatatatttcacaataattacttgaataaatcctaggtacctctcctaaagagttttgaaaaataaacacatagatatgaagaaagatggcccaatataaaccaacagtggtcctactatccctgtcctctatgggcttgctaagcaataccccaaggtaactttcaagctgactttgatgtgaatgcccaggttcacgtataggagtaacatagaccactaagaggggtttcttgacaatccacagtatctctctcccccttacaaaagatagtttttaacatcaagaggacagttgttgactctcatttgaattattaaaccaaataagtggctgttaaaggagcaaagatctgaataataatcagttatcatttgcagagataattcaaatgatagctaattattgggcaggcactctacataaattatttcttttcattcctatgagatgggtactttatgaggaaagagagaggttcagagaaggcatgtcagttttctaagatcacacagctcattgttgactgagccttgacatgaaactacagctatgtttaaaaccagtgctatttctagtgtactatcctgcttccttgtaattatccaacacttttcttctttttctcctttttaaaaatcaggtagtatctgattgactttgtctttcttttttgccaagggtacactcaccaactgctgtccagagttaaatttatagtcacaaagcaagagaaaagtctttgtttccaagccaatgggctgggtttccagaggcataaatcctaggaattagtaatatcccatataaaatcactgaaggttggtgcctatggttatgtcagtggcctctatgatactccctaaaggcgtaatttattccacagtccctagacacattcgttcatgttctttgaaacagggcacacttgcctttcccagaaatttttcaaccaaacaggactaggacatagatcaaggtctgtcagcctatgctcaaagtgtcctctgcagactttgttgccactaaactagaaataatccatagtttctcctgtttccttttccgttaatgaccaactttatatacactcaaaatgaataagtgatacggtttgttcttctcctctacttctctgtttcccaaagtaatttgcaagttagaagaggaaatccattaggagaagctgaatggattaaaagataataggatttggagaacaggacccagtgaatcacaaattcattacattcacagctgacaattgctaagtcccggcctgctcctctcacaatggggccaaggtctgtgcagcatgctggtgtgcctggtgaaaggagaaaatgagcttcataaatacaaacgttagagtcaatcttatgttccccagggactgccagtactttacttggcaagaatagaaaaggaattcttaaggatataaaggcaaaaacgaacactgtaaaacacaaaccacaacaatggaaaactatagagccttgcttccaaagcttagtcatccatacttttctgaaatgccaggaattgggatatggaaaagagctcagaaaactacaggaggcatccatggaacaaccacagaattctcattctggaaagctttggcagggctatgttctcatcatttcactttaatcaccttttaccccttggggccatttgaggaccatgaaattctaagaatgggtagaaaatactcccccaaccaaataagaaataagattcttttgtttctatatgtcctggattctgcatgctgcctgctcggagaggagagccttacactggagtttgcaggcatttgctgctgtctcaataggtagatcttcagttaggtcccagcttcatgccatctgttatttctaaagtattttggccttcagctggaggaaggtgacaggagagtgttctgttcctgcagaaaatttgcttgtcatcagagtaactgtgtactgttgaaacagctactgcctacatttcactgcctcttgaaagctagcattttggtgtgaatcaattatgaaaagtgatgcacactgccccaacacgcacacatacacatacaccccgcctaaaaacctgagacataaacaatgtctagaattgtgggcaatcatgcagagcccttcaaacaatattaaaatccagccacttgtaaagagtgagtaataaaataagtttagggttatataaattgagtctaataaaataattcagattcctatggtacattacagttttatagtagtgcctttattttctcttgttcttctacaaatgcctttttgaatatttattcattacccatttcctggataaagatagtaaggcttagaccttttaccaggatatcatagcttaaaaaatgacagagctatttaattcatatttaaaatcatattttttcttttgcatttttctacttcctggcatatgtttttttctctgatattagggtataggacaggacgaggaataattaaagtccctccaaagattaggtcagaaagggaccataaaagcttttccattaggaagctggctttggcgtttcattgtcattggagaaggcccatctgtacctatggcacgtgttatgctaggaaaatacctcctgaatccttttgtagaaagcaataagatagcatttctcagaaagaaaatgctttgctaagcaaatactttgaaaaaaacaataaatgattttttaaatggcattacaatgttctttgaataggacatgggaacaggaatcaaacttggatatattgtattttcatcttattttatttcatttttattagtgacagggttttgctctgtcacccaggctgaagtatagtagcatgataatagctcactgcagccttgaccttccaggctcatgatccttacgcctcatcctcctgagtagctgggaccacaggcatgtgccaccatgcctggctaatgccttttaagtttggtatggacaaggtctcactgtattgcccagactgctttctaactcttgggcacaagtgatccctccaccttggcttcccaaagtgctaggatgagaggtgttattgcatatttttacaagtatcagacatgtatgttctgaaaggcactagaatcattgaaaataagtcactgtgaagtgcaatgactcttgaagataggggatagcagaagtgtgaaactttgtaggctaatcattatggccaatgcctaattaggatttatagtaccaaggcctgaccaaagtcataaattatcagacaaaattattggacagaaagtgaatgactgcatatcttgttaaaatcactagggaacttaggcagaaggtaatgactgaaatgagaacttgcctgaaacatcaggctaaaaatagttcttgatatatgaagatgatctgaaaaatgagccaaaatttgtgttgcaaaacagcaattcaagaattcaatcttaaaacattgcctatttttttcttcagaaaacaggatacaaaagtcagtgtgaatgagcaaagccattgagttgctcccaaagcagaagaaattagacaaagctattatggaggagatggggatggatttccacaagagagggcaacctctatgtgaggggtaatttaatgaaaaatttgcaggtgatgcacctgtcttttcaaagttcttttcatccctgcaatttcatactttttcaccttcaaggccaatggctttgtcagtgctgcctgaattgtgcctttgaatgagtaatgacagatttgaaataagaacattggagcattttaagtgtccagtaatatttgctcctggatctactttgaatggtgggtgtgtgatgactggtctccatgaatgggatcatctaatgccttttaaaaattaaagacatagtgtcatttggactttttatgatgcagtactatcttgtcacagaagacttcaggatttctcttggttagcaagtcaacagagacctgtgtatctaggcctgcatatatgcatgcatgttgttacttgatatattcggttataagaaaaggaagtcagtcctagtaaataacaccatccatatgagatttatgggtttcacttataaatattaaattaataaataaaatattatcctatcatacttagtaacaaaggtataaggctacaatattacacctgtcctgtaacttcacagatatctaatgaatatctagaaaacatctctgacttgctgcgagtgtgtcactaaagccctacattgaccatatatgtctttattctctatctgataatgttgcaactttcacattatttttgaaagttcttaattggtgattaaattcctgagaatttccagtaatgcataccaaatgtcctgagactttttagacataaatctgactcaccttcaaaatcaaaacaaaaaatcagtattactatgatttcaagtcataatctgaatttaactccacctttaaaattaaatgctgccaggatcacatgctcaaaggctttcttggaaatatggcttatacaaatggcatatgcatatatatatatatatatcatatacatggcatatatacatatatatgagatatatatgtatataatgtatatgtatatataaaactggcaacagaaacacaggaaatgatatgaaaaaattattttgttcatttggaacgctgtatttgttgtcatttttgaagacaataaaattgtcattcgaaccaaacccatttgtttcattatctattaatttctatctcttcacactgcttggattggagatagcaaacaggccatgaaaacaccttgggaaaataattcttgcacattctctaacaaaactggaaaaattactgatagattcttggtttggtcatatggtgcttacatgaactggagaactttgatttgagctagttcaaattttaacacactatccttacatacctacgtttgagagactgttatatgggatttgagagattttgaaaacatggcctttttcttgccgtttgtgagcaaggagagatgtaagctgtttacctctgtacccagcaaaataccttccaatgaggttagaatcactaggacttttcttaatgttggttcacccccattatacctcctgagtataagtggataatgatttttttaaatcataagagcgccatgttgcaattgttattatcaccccacctcactgtgtgtgtgtgtgtgtgtgtgtgtgtgtgtgtgtgtgaagttaaatgatctttaatagtggtttgttaccaaaaaatccatgtaagctcaagtcacctaaataaaaactactgtataagaaggaggcacaagtatggaaaacatataggaatacaagaaatgtttacttttggcccttttcctcttttaggccatttccttcctttccctctaccttggacagctagtttcaataaacaaaaccttgtccttattactaccacttttagaatgccttaacttgcccttaatgcctagcctttcaacaggtggattcttgtgtgtcctgaataaacatacaaacacatagaaacacacatacacaatacaaatgtatatatattttgtatagtatatctgtatatatttaggtacatattttaaaaacaaacacattcaagtaagagaaacattgagtggtaaaagaaaaattagcaaactgatataaggtgtagcagtcttacttatcaaatggaacaggtgtctttttcaaatttagttggtgcctttaattggccatttattcctgagtgtgttgggcgtagtaataaatgatatgacaacacagctcatgccagtggtggacttctacaaccagtggaatagtcaagaaaggtcaagctgtctccattgatttgaaagtagattgtacctacttatcacaagcaccttagttttcctttccttcttttctatgaaggattgtccccttgtccatatcacatgttatctatcatccttaatgtcactaataaattagattattcatggaatgtgcttagccctgtgtctggctccttgtaagcagttgataaatgtaagctgctatagttatcacactttgatccttaccacgtttccttgatatattgagggcaaataattgaatctgcattttattaaaagaacactgagactaatggaggtgaagaggttacctgacttctctttggctcaggatcagtgaacaatattataggtacttgaactaagaactccagtcttttaggccagtgattgctcctcagtatcaacatttaaaagtagttagttattcttgttttctgaaaccatcctgagaaaataaaggagataccacttctgtcttgtctcttctccctggttttaaacctgtgccttgtcataatgcaaaggccatgtatttatttaaaaattataaacacattttacctgaagtgacagctgaactgtggttctaaatagcctctgttggtggcctcaaacttctgtatatattcggtatattccattaagtgcaattttatgaaaatgtcataaacaaatcaatcactcttgacttaattttcagccaccatcagcttctattgagaatctcagccatcaaaatatccataagaccatatgatgaagtacatataaagtactgtgtgagcacaatgaaaaagcaatgagattcttttggggggttcacggaaagcccccaagtgagggtgccatttgaattgagtataaaatgatgaatagagatttgtccattgaaaagggcagacaggccaggcacggtggctcacgcttgtaattccaacactttaggaagccgaggtggacgggtcacaaagtcgggatacaagaccagcctggccaacatggtgaaacctcatctctactaaaaatacaaaaagtagccaggtgtggtggcgggcacctgtattcccagctagtccggaggctgaggcaggagaattgcttgaacccgggaggcagacgttgcagtgagccgagatggcgccactgcaccccagcctgggagacatagtgagactccgtttcaaaaaaaaaaaagtaaagggcagacagaagctggagatagagtgacccctgtcagactgagggggacatttgagcaaagatatgaatattaaaaaaacaatgatccaatatggttgaattgggtgagtggcaagagtggctgttggcaacctgtgaagtggcatgcatgccaggttaagaagttggagataatttggtagcatttgagctgcaatagatcgtgtcagagagaactatgccatgaccagatgtatgacttagataaccctgacagccatggggtggacaaatggctagggttgagactgcagccaaactcttcacaatttcaggagagaaatgatgaggaatgagattgaagaagtggccatggaggtggggaaaagagagcaaattccagaaaaatattgtggatttgctcagtggaacttggcactggatgaaatatacagaataagtgcaagggaggaggcagaagattaacttggatagatgggttgataactgtagccataactaagggaaatatattaagctcctcttctcaataaagattagatttaattacgaaaatatcatctatttatttgccatcttgttttacaataatatatcttgtatcttcatataaaagcagttacggcagccctctgcactgtattttcatagggttctgtttttatcttacttaactgtaaggtccttgagggcaaaaacagtcaagcctttctcattcatcctttgcaaacccagcaccctgattcccaacagggtagaactcagcacatatttgatgaattagattgaatttaaatctatatatagttataggaataaatgcttggaggattttcctatctctgtttcaattctttgttttagctcagtctttttatgttggctcctgtaagctttttgcagtgctgcaaacacttctagctgacaagagagaaaaagaaagtcagtgaaaaggaggagggggcattgcagcatctagattgaactctccaggcttgcctgtctcataattttcacctttggtggggaactgtcccagatttcatccaccaggctaaggttctgacatggtaccttcttaaatcaagcttgaagggaaattgattgaaaagaaaacaccattatgggaaaacaattcattttcttccccatgacagaaggtagacttttgtctatactgcagaataaatatgatctggctgattgctttaagatctggaagctcagaggagtcataatggctttgctcactctttagagggaaattaccttccattttggagacatttgatacaaaggttttggttagctttcaaaaagtaatattttttctccctgtgtgattatttatattagctagatataggtgcatgaaaacttgcaaatatttctgtgtgcagttgtgtgtttctactgaagtaccctccagacagggagtaagcagattttttttaaaacttttctataagccccttaaatattacagtcgtcccatgctttctgtgttgaaagaaaacaaatttaaactcataaaggtggagtgaaggcaaaaagatagaataatgtttacctgatgtttatagtagtagaaaacacttcattgttagaaatagccaagaaggcacttacgttgtgggacactcatccgtcccgttgacaaaagttggattcattttatcttgcagaaattgcaaactagcatcccctcagacaaaatctagccctgataatacgtatttggacaacatagaaattatgttggcaagtcttttctacttcaacacagtccccaccatgcccattgtacaatggctggccaaattcacacatttaagttcctagctcccaaaagacttgaggttgaatgccttgctaaaggtttttagtgcaactctgctttgctagaagatgaattcctaccttgcaaaaaactcggatgcatgtctcctgagattggaatggacaaggaacaaatgtacttgtttgtagtacttctagaatgtctccctaaatcatcttagaagcagaaatcttacccaaaatatgatgcttgccaatatattgtttaccacccatcatgctctgaaccatcatgcctcttgtctgggtagccttgctctatgaggcaatttgtggtataaagatttttcattaagttttggccagtgaagatgttgtcaatgtacaaagtcagtaatgcttcttgtgaaatggtcgcctctcatgccaatcttggaagcgtaacattttcttgaccactttagttctaatgacttcacgtttatcctgaactagaaatatggtatcttcttggttgtttattctctttcttcttccctctttatatctctccatccttctttcttccttcttttttcttccctctatttcttccttctttccatcattctctcctctttctttctctcattctgtttcttcctcttttttttgaaaatcttagcaagagttaatggacttatgatctaaaaattaggttattagaaatttttgtcataaaacctggagaattgatgtttgaattctccttggctagagtcaatcctttatcctttttaggtaaatgaattaagtctcatgcaatttcctgtgtgggagactctttagatgaatcatttaaatggaaagccctgtctgctcatcaaggggcgcgattttagagttttcctgagtattatgtgcacgcttagtacagtcattgagatacataaggcaaccatgtgccttaatctgtatgaagtctcagttcatatgtgattatttaggtaaagtatataactgaaattttacatcttttgatctctttgcaaaatttccctgagccacttaaaaataacctttctttactcctttttgtcttgaaacatttttattggaagacttcagacctaactttagtaccagagaccgaaagtcatatctcacttagttctacaatctctagtccacttttgatactcagaatagatagtaaaggtgctatttttttaccccagagtgacagactgttataaatgttgggatcctatgaagtactgtggagagtatttaatgagccgttgtagagcctacacagatacatttatataagatattgtttttataccagcctcaaatgctcctaggagcagccagacaggtcttcctcaaaaggataatctggaatctttacctttgcaattgttctatgatacttctctttcaatgcacaactcccaattaattccttggtactccttgcaataagagaaaattaaaagggactcatttgatattagatgggatcacacttatatacctattgcattgtataataagtaagcatgagtatcattctgttgtatagtcccaaacttttccttgaaataattggcaagaggatagaggaaagacatccaagatttattaataccttcatggttctagttacctctataaactagtgaaaccttttccaaatattgtagataaagaaattgaggcacagaggtgttacttaactgattcaagttcacacagctaataaacaacagaggcacaattccaaaccagctcttcatggctctaaaatctgtgttttttccataataagctgcctaatttattgcgcttttattgtggtaattattttacaagcattattgcatttaatcctcatagccttgttatgtaagtcccaatagtccccatttttgctgatgaaggaagtaggattcagagaaatcaagtagctctcatgttgtctcacagtgaataagcaatagattcaagatgaactccagagcctgtgctcttaaccactacagaaaattatgaaattacaaggcatggtcctgccttgtggctctagcatcaagttggtaagacaacacaacaccaaggctcttaaggaatcctctggacttgagtgtatgtatgggaggagaagagggtgttctaggtaggatagtaacatgacaaattcaaggatatgagaatggaatgttcagctttattttcattttagataaagttataatatctgataagatagcatggaaggaaggaacttcactctcctggagtgtagagttgtcaggagtggacttgaaaaaaagagtgacaaccatgaggtctgataggctttagaacgcaggtcttaaagagcctggagaaaagagcgtgcatcacaaatcctacatagacagcaaaaccactgcccaggtaaaccaaggccgcagtctaatcttggaaggagagagtaatttaggacagcaaagcagaatccatctccttgggcaaagcttcaggaaagccctgtctgaatctaagagggagctctcggaaggaaaggagaaggacatttgcagaaggaagagaggcagccttggcccttatgaactctgggggaggttcctccccctactcttaactgaatgtggccataagttgaacaccagtgaacaccagcaactgctgagactgaggagagcagcaacaactgagcaattaacctttggtgatgggcttgaagttctaattaagagcagagtctcttctatcaggtgggagggggaacagcagaaagatgtatgagggggatgaaaaagaccagcatgttagcaggtcagatttaaaagacatccaaatgggtgtaagagggtgagagaaaagaaggagatcactgaccaattaatttttctgtttcccagtcaaagtttcttctcctttctcttaaccctgcagtgactgctgtgtgcagaagccagcagctccggggagagctgacgttgaatgcttatgctcctctctgttgtaaattcctttcttcatttgctgagtatcattggtaatttctatgtaaattttctcagagtagcaatttagcagcttttctgttgacaaatgaggaataacttaatagtcaagtgactgcatgtcatgtttcgcaaggaggtggaagtagcgccttgtagatcgcagggatggatgctggaagtgggcgatcttgggaaagcctcattgcctcagtgccctatttaatttcgcccatttaagataggagagaataagcttctatacttgaggaacctagtttcttgtgaagagtgattgttaggaatcttttctcttttagcacttagttaacgaatacctttcaaaccaaatcaagaggcaagaccccctccaactttgtccagaagccttcacaagcagaggcatattttgttttgtatcaaatgcttctcattgtccatattcaggaggcaggcaacagtggggtcctttttgaagtgaccagggatggatgcaggcagcaaggcatcgttgctttccagatgccacctttactataagaatcgaagtcctttaaagtggactctgagaaacttcacctaaatcatttcccaaggtgacagctctctatgcagttttttctcctaactagaaagcttcctcttgccactgcgctgaaaatgggaaaagtaggtggatggggaggtcttttttaaagcccagatttctggaatttgtggtccttctactttcctgtctccagcagtgaccttctcctcatttattcatgacagaatcatacgtataaaaattcatgtattctggtcaccgttctaaattctggatggtgaaaaaaaatatgcagggcccctccttttatggaactttcattttaggaaggaggaaacagtaagcaagtgaacagataagttagtggtataaaattgtttaagagtgactggatgggaggagggtttactggaagctcagagggttcatggtagcccactctgcagagatgagagttaaacagtgttgtgaatgattgaaaagagccaaccattcacagatctagggaggcatgctcccagaagctgagacagctagagcaaaggcctgaggtgggaaagaacttagcttgctgataaatcagatacagagccaagctgctgttgtattgtaagattatttcagactcgggagtagggatgtgtttgcacttctagctctataggccctcatgagcctgttggacacattgttaaattgatgccaagtagctcaaagcagaacccagtcccttgtccctcatcttctttctgctgacttcataagaacatggttcactttcactgccttcctttgtggacatactcagcctgcgaattaaaaacagaactgattttctcatctcccttggatcctggggaaattaaggcctgcctaggcctcagttctttccctagattgagattaaaatagctttccttgcaatcatccagatgccaatttaataaacattctctggccccttccacatataacccctggactgccttactaatttcttagcattcttctccttttctccacaaatcctccctttaaagagtgtttttttcccatgcctttcttattcttttttgtggaaagcccaaattagtttgtttatttttgcccttaaagtccaccatatccaaatgagaagtacagaagctattaccttaaaagtaagcagtgagaatcctaacatctttttttccatccccacattctcctcaatatgttccctgtcctttgatgcataagagggtgaaaacctcacatgagtattttatgcactaccattttacaagtgtttcagtaaatattacttcatgtaattctcataaaaatcttgggagatcagcaacacaagaactggtaggaaactctgtaagggggaatgtggggatgcgagggaagccagatcatttccaaagtccaaaggtcagatcttcacgttgaaacccagtctgcactgacctttgacctggcatcaccattccatagctatttgttggtgtcagcatcctggatagggggatttttttttttttcaaattgtaattcaaaggctaacagaaaagagaaggtaggcttgagaaagcactagttttcttgggactctgacttattatttggaagaaaattgattgaaagcataggtgattatttgttccttgtatctttcagaaaaaatcaagtgctctatgacattactgagtatatacccaaaggaatataaatcattctgttataaagagacatgcatgcgtatattcattgtggcactattcacaatagtaaagacatggaatcaacccaaatgcccatcaatgatagactggacaaagaaaatgtggtacatatacaccatggaatactatacagacataaaaaggaatgagatcatgtcctttgcagggacgtggaaggagctggaagccattatcctcagcaaaccaacgcaggaacagaaaaccaaataccacatgttcttacttgtaagtgggagctgaacaatgagaacacatgggcacagggaggggaataacaaacagtggggccagtcatggggaggggaggaggagagcatcaggaaaaatagctaatgcatgctgggcttaatacctaggtgatgggttgataggtgcagcaaaccaccatggcacacgttcacctgtgtaacaaacctgcacatcctgcacatgtaccgtggaacttaaaataaaatgacacattactttccccactgtttttttttaagcaaaagtgttctcacacagaacacaggcaagcatgtctaacatgttccattctaagtcttgcccttgcatgtggttgaaaatgactatggactatccacatcacaaattatgggttccagtgtgtatatggacacttctgaattcactcaaaatttttcttactgatccctattgccagatgggggagatcagcttctatattaagcaaggatgtgtccaacttttgaaatggaatgaatagttaaaattgtgcatttctcactctggtggttgcctatagctgtctccgcccccacccccacctctcttccccaccaccttcaccagcagtagaaaagtatgtcatatgtgtgtggggtgggtacagatagagaaacttggcagaaatagggtgagagatgtgactaacaccctcagctaatttctgtgcatgttcccaaacagagatctgcagagaaaggagcaagagttccttgcattctaacccaagccaccccttcacacttccagctttagttcacttctccaccttccatgcatggttgccatctgacctggctactgagaagatcagacctcccagtaggagatccaccacataagctaaaaataagagctgctacttctctgcagataccattaacccaattagataaataaaaaaaaaaaaagaaaaagaaattacagcttcattaagtaacaccagaataaactccaagaaggcaaaccaaatcagttatacaatttaaaactttactcaaaaatcaaaatgatttgaaaccaatggtcacttaaatgaaggcagaagctgcatggcagccattattggagccagcaattcagcagaagtccaaaggtccagtgcagcagtacatgtgacaggtgatgttgcctgcatacacaaaattaaatggaactagttttcgagggtcttcttgtctccatgaaaagagaatgtatccttctgaaagtccttttgtttaaaaatatgatcaggctctgaaagaattttaggtcttgatactaactaacagaagacatgcatttattaaaaattgtatcacaaaggggtgaactggggcctgattgattgatgttgaaatttgatttatccccagtagaaagtgccaggatattaagcctctattactccacaagggataccattttgcctttggtgggtgaggtaaatcttcagattagaaatggtaaagcctcaagacttccaaaaacatacaggctcctattgtatacttgctgaagttcctataattatttacaattccctgcaaagaacattcttgggggtgagtcccagaacagaggtgagcctccagctgcaaaaaccatagcaagtatggcagggagcatctttgattcagaacagaacgccactcatcgttccatcagaacaggggcaggaggttcctgccaatactgattgatgccacgaatcaactggagttgttccatgatccacatggtccttggacttggtgctgtcctggaaactggattcattgctcaaggagctgagataaaagaaagcagcctaaccaatggccagctcaaattaggagctcaaatgaacagggcctcaaggaagtcagcctctgagaatctgagatttccagactctgataatgggaatctcacctatttgtccacttttggggtagatctagacaccgtgatgtgtcagcagcctcttagttgctgagacaattgtcccagagtgcacagactaaatctaaatccctacaatatgttttcaatgaatttatgccacactaattttctaatttgcaatttttaagtcaatatactttattttcttttaaaaatagtgttttatattttcatactataacatatttccatgatattaaaattggcaagtaaagaaaataaaatatgtaaagtcattactgtcatcctcccagaagtgatgtgctaacaattagacatatttcatccccagtttttttctacagacacttttgctttaccatattgtgtacttgggtctattttcaactctgagccacttgctatattgaacagtgtttctacagacaccgtgctgtttcttctttccttctttcactcaacaatcatttactgagcattttgagaagaactgggaggacagcgatagaatgcttttgcattttatctgcagtcaactagttagaaaccagaaacaactatcttgcatctcactatcttgttatttgcacctttaaaatccctttgcagaataggtgcatagtattaatttgataactaaatgaaaacaaaatggagttcatcaaagtggatttgttttgaattggcttggagttactggcagtctatgatgacatacgctactccccaccattgacacatgcattcaaatgcagatgctatattagtctgttctcacactgctaataaagacatatccaaaactcggtaatttataaaggaaagaggtttaattaactcacagttccatgtggctggggaggcctcttaatcatggcagaaggtggaggagaagcaagacatgtcttacatagcagcaggcaagagagcttgtgtaggggaactgctgtttataaaaccatcagatatcttgagacttattcactatcatgagattggtatgggggaaatcactcccacaattaagttatctcaccctgaccccacccttgacatgtaaggattattacaattcaaggtgagatttgggtgaagacacagccaaaccatatcagaggcacacacaattttatgtgtttgtgaagaaaaggcaattgtggaaactttacttaaaaagtgtaatgtcaatctcatgagttgaggacagttaggagaccctgaaatgacacctgtgggcttgcattttattcttggtcactgctaaaccatttttcacttccctctgtttcagtaacctaaaaatctagggttcacaaaacaatgagattaaggaagccaactgataactattgtaataggataggaaatgtttcctgatttgggaaggatgggcaaggaggtggagaatgagcttccaaggcagttttgattttccggaaaaactcatcttaaaactgattatctccccaacatgagacctaccaactgacctgtatcagcctaactgcaatgtatctgtctaaagctgttaaacacagctattttcaaaacatttatccattttcataaaagatttcttaaaattcaagctaggttttcttcctttatttgaaaagggaatatggtaattttaggaatatgattatatatgcatatgtggaagagaagcagaatacttaaaagacaagcatttcctctttttatttgagagagagaaagagagagaaagaaactcctaggcaatcagagcagaacattcctaaccttacatttgatccacccattgagctactgaataaatgcttaatatgtcagtgagcccacaagtttcttgtcctgggccctttaaactgatatatctcaatcacctttactgaaatgttatcctgagaagaccgtaaacccagggctgctcaccactgagtcttcttttatgaaggtttctcaggagaacatacagctaaagatctctaacatttttcctgagtagacctcttttttctcttcatgaggatatcataataaatgactcgttggtaatttatcagagcttgttccttccccaacccattctccttaatgcattttttaaatttatccagtatttgaaatgcagaagtccaggcttggtaggaacccagaagagaagaaggtgaaagaacaaaatgactgtgaagctaagaaatccagatttggaaggagtagcatcctcacagatgctcacagaagtccatatgacactccttgcattgcctggggctttatggaagaagcagggtcacgcaggattagtcattgcccaaagagcgaagagcatggaactcgccaatagcctgcaaactctttccttttggcttttctagcacttactactcttttatgacttttactttacttaattttcttatataccaggaatataaccaaccagggtagttgggggccattgtgtattgagcactgcccaactcaattcacttagcttgcaatgtgaatggcttctctcttctagaggtgctcaaggtgcaacccacataatcacacctgatagccatgttgtcaatgcccaatcacattttaaacacttggagggcagagactatgacatagagaaagatttgaatagctattcacagaattcagttgagctgaaaaagtcagaagaggagactagtttcactgactacaagaaagagtgatttggttttctgagagtgaaatcttcccccacaaacatgtactgtttggcaacatgtttttttaagcctttagaattgtaatgctttttgctgggtcatatgttctcaaattttgcctcaagccccatcattccctgttttattatggtaagcttattcacacatttatatacctgccaggctattgtaggtattttgatatgtggcttggcctttctgggcctcatttaacctctctagactgcagttttctcaactgaaaaaattcccatcatatctgccctgcctatatcatgagactttgtgacgattcaaaggagcaattcaggcacaagctgtgtaaaggttacagaacacaatatagactacattatcattaaactacttgatagtcttatgactatttttatggtaatgaaacgtaatccaatgcaacttcgtatatgtaagtaaaacttcttaattcttgtcttgtaaaactgaatcttcatcctttgactgatcaactgaccagcttaaaccttggagaatcttaaacttctgaacacattttacttctctctttatgttcccctgtggatctcttatgagtatacagagattgagagtccaccatacaggttacctttcactcaagaggttgtggcatcctattcattgtcaactactggactttttcctccccgtcgtggaaaattggtgtcacattgccacatggagcatcccttcttcactcttgacccttccttcatcaatggtggagcatcctcctgaagctggagaagagaaatataaagctatgtgtttcagaatgaaaggaccaatcacaagaaactctcaagccttaaaatacatttagcttttggatataatacatcacatctgtatttgttagtaacatattaaacaaaatgatagataaaatgtagattatataagaacctatgtaattgacatgatttagatactcattcaaagatgagtcatgaaaaaggtacggtattgtcattgcacagtatttcctatccctgtgacatatgaataccaccttcaccgtttttgtagtattcactcatcacttgcactgttatttacttaatagtcttctttaagttgatttattttacttaaatatatttattttgaaagcaaaatatataattctaaagtaaatgaaaagtcggtattacttctcataaataaaaataattgtaaaaataaaagctttaagaacaaattatgttgttatattttagctatgtattatagcctgacaaaagacaagaattagtcctcatttaaaaaaaataaaggagattggcagattttaaaaaggcttttaaagatatataagtgcttattttctctctgaggaaataaagagcaaaagaaaacttaaaagttaataattttgcataagtataatttggaatgattcagtgtattttttcattatgacttcaaatcatttaatgtatcaaaaacatagtcataaacattggggtcatcatctattttgattgtagagattttacttttatacatagatgttttcaacaatataacctaaatttctgggaagttatatcttttacatttattttaaaaatctctctcttccctcacttcttcattgaagtaataagggacttaacttctttaaaccaaagtttccattatagataataaaacaaccatcacaacaagaaactactaaatgattatttattcagatcccagaagaagtgctttacacggatactctacttcaaccctcacaactgctccataaagtaaatgctattagagtaaccgttttacagatgtgaaaaataagtcttagagcaatttcttagtttgctgtgatcacacagctagcatgtcaggcaatctgatctggcacctgcaatcttaacctttcctgaaataatcttattacttaaaaaagtattactaataatgataagaggctatatttcattattttttgaaaagtatgtttatggtctatgtcacaaattaagagtgacaatcagaaactcctgtaccattggaaaatgaaattttacaatttggattgctgttcaggaagcaaggttaaacaaataaacaaaaataaacaatgacaaaagccttttaatgaccattctggatttttttttcattttaaaaatgaatgctcaatgtttcttcctcctagtgtattgctttacttccttaacagaatcctattttattaagaagactgtgaagacaaattttagactgaggttctgagagatgtcttagagccagagaaaaatgaaaaattccagaagtctacagaatccaagtaaagaagactttgtttggaattggcagcaatgacttccactagtagcttaccatgctagtgtaattaatctcactcccatttctacttctttttatggcagaatttcttaacctcagcactgctgacatagtgggtcatatacttcttcattgtgaatggctgtcctctgcatggtagaatgtatagcagcattcttgggctctatccactaaatgcccagagcatcccccaagttgtgacaataaaaggtatttccagactttgtaacattactctggttaaccacagctagagattacctcaacttgtgatacttttctgcttattttggtgttaattggtatctgccattgttgctggtggtcatgttattgttgttgctttgtcctttagtaaaggttccttctctgcttagagacaggacatgcttagaaccctttgggtcttaataaaacctcttttaatattcaaggtatagcagtgagatataaaaatgattgcatattgacatatatctaaatattttcactttgatttcagcattgaatcaacatctctatcagcttgtcttcctggagaaggatattttttggaggttctggtcaagctcagtggttactgaagctgtcgggagtcttaccaccttggggtcactgtggaaaccagaaaataaatggacaaagctgggattgctttttggctagtataatatttccagaatccctgaggcttgcttttaaatcagcataagctggttttgtgtctcacttttgtgttgtacaattacagaaagcagcaaatacttatcttggcatgtcctgtcatgacatgagccaaaagctgtcatcctcatagattccctgtctaagggaatagttgccctatcagcatttgaaagaaacactcctgaaaccttttggagactctaaagttatgtactgtcatttgatggataagtgactcaaaattcatattgatcacatcatttcaaattcttacctgttagactggtgagagaactctaggtactttgttgggaaggatgatggagaagagagaagtgaaaatatgaaggattacttataacaaaagacttgagaaatattttaggcttgagaagcattttataagggaaagatatttgtgatggggactagtaagtaccacttttcacctattgccatttgaaaattgactgtttgcatattgtttttttctgaaatgccgctatgcagtcagggatgagaaggggattgtgattgagtaaagatctttcttagaatcatgtcctcatttgtaaattgtgattttctgtccattaagaagataataatttctttttcctgacatggccttgtatttttaacttcttgctccacccatactcaaatgcaggttgatttattctcctttatgctaggtgacttccccctgtgtatactctctttcagaagtatttctttctatctccctaaaatcaaaaccaatgttcaccttaggttgtgtagaaaagtctctgctaaggcacctcacacctttctaaatcacataagttataacttatttatatatttactttgaagtaccattcctgaatatctaatagtgagattaatgagttggttaatgtggtatcaatttagggcagaaatcattttgaggaactcataaatacctactattatgatgtatgaagcttcaggtttttatggctgccactcaaacaaagaaatattatttggaagatgtgatttgatgttagtatttaatcaaatgtacttatttcacctacttgctgaataagcacccttctttactaccatcactggttttcatattgaggtatgtggatttatcctttatcattgctcacctttgaagatggtggcataattaaagaattacaaggggatttcagaaagttgtagataaattgaactaaaagataaaaatagaaaaaatttatttctcaacataagctccatcgggttcaagacatttttgtaagctatgataccagtgatttagtccatccttaaagaactgaaggtcctgaaaatataaccatactaatgcattctttttgacattattacctgaagaaaactgggtgccctttaaagaggttttaagattaggaaacaaagttaggaggagcaaaatcagggctgcaagatggttgcctaattatttcccatcaaaactctcacaaaattgctcgtgtttgatgagaagaatgagcaggagcactgttgtagtggatgaggactctctggtaaagctctcctgagtggttttgtgtttttgtttgtggtttgcaaaagctttggctttctcaaaatactctcataataagcaggtgttattgttctttggccctccataaagtcaatgagcaaaatgtcttgaacatcccccaaaactgttgccatgacctttgttcttgactaatctgcttttgctttgatttgaccacttctacctcttggtagccattgctttgattgtgctttgtttttagaatcatagtgatgaagccatgtttcatctcctgttacaatttttcaaagacatgcttcaggatgttgatctcacttgtttaaaattttcatttaaagctctggtcttgtcttcagcttatctgagcacagtggtcttgacactgattgagtgaaaagtttgctcaactttaatttttcagtaagcattgttagtgaaccaattgaggtgtctatggcgttggctattgttcatgctgctaattgatagtcctctccaattagggtacaaaaagattatttttttcttcagaaattgagtggatggtctgctgctgtaggtttcattctcaacatcattttatcccttcctaaaaatatccatttttaaactgctgatttattttggccatcgtccccacaaactttttgtaaagcatcagtgattttaccattctctcacccaagcttcaccataaatttcatgtctgtccttgtttcaattttagcagaatttgtattgctctgataggagcacttttaaaacaaatgccttttctcttactccctcaaactagatcatgttcagacatgttataacaagttagtacaagtttattttgctacaaagccaaatagaaatttatgcatttttttcttatatgcgttttccacgaacttttggaagacccctcatatatccatctacatatatggccagtgctaaatctcaatggaaattgaagacacagcattactcattggaatgaaatggcttgcaggaaattcccaaagctggctagaaagagttgaggtaacctcttccctcttcatggttccagtatcacccaaagcttttcctcctcagcactaaatctttgctgcaatactccttcttcagaggtgcttatgaaatggcctcatttcaaagaatgaaagttaggttgtagcaggaattttgaagcccagaactttaacataaatagttgaaaagaagaaaaataaaaactctttatacaaattcttaatcttagtttactctgtgtgttaaattgtcattgccataatgattttagtcctttctctgacctggattctcccactccccagcttttaaatttagtccattctatgtagtgcctcttgtaatttagcacattgtaggtgccccattagttttgttgctttattcacctgcatcctcacacatcgtgtgattgtgcttgcagagcacactgaactacaacacattctctcactctgaaatctgtcaccataaagcataaagcaaaatccttccctcctttactgaatggatggctgggtggatagctgttctttgcacatgttcgtgttgagtaggtgctgtataaaatcacttgttctttttttaacgtgactcacgaaaaaattatcccagctttcagtaatctcaaggaaaaaaaaacacttgccatctgcaatttactgcttttaacctgaaaaataggatctaaaatgatactcagatacttaagaggcttcacgtgttgtaggcagaagctgacagatggcacatggtggtaggctgttgcctcataaggagggaaggcagaagcaagtagacagtggtatggaaagcttcttgggaagaggtcatgacaacgcttcaaccagagataattaattatttgctatattctgtaactagcctgtttatacaaatagctggtgtgctcagtacaacatagcagtgaatctatggaaaaggaatctgtaaataataatgcaagggaacttctcttacgtctattgctaaggggattatcatagcattcaattttaagccatgtaacctggaatgcttactaaatgtgtaattcttgttcttcctcttcatataatgcacagacttgaattcctatattgagagaataacttacctcttttaaataataccataatttgccttgaaggtagggaagaaagagagtgaagtggggaaaatttcaaaattctgtcttccagggagcatattcctactcatctgtgacgtctaatgtaatagattttgaagaattatttgtaagatagatacttggagaagtttatactcacttcctaatcccagactatagaaacttctgcattctagaatttcagagaatgtgtctctgtcaattgtattctgaagataagatacatttgacatttgattgcttcaatcaacattctccaatgcagatcactaggcagaaacatcttgacacggcatatatttgatacacaatgattatttgcattgacttttaacaaagtcccatttagaaagattgaaagaaaaggcaaatgtgattggatgtatgctaaagcgtgttcagtatgtgttttgaaatatctttgaaagttcccaggatgtggcacgtatcattcacttgaagctgaaaatctctcagttgagcaaaaacaagtatttgctttgttccatgatgcactccacgtgtgactaaaatggcaaagtgaagcctctagtttgtagatacttgctttgggagacagggagctgtccgtcgtcctgaacgggtcatgctttaatgaggatagacacagggtgcaaaggaaagtgactgggatcccctgcctgcactgactttaacaataaagatactggaataatgagatcccatggaatttagcaaaatacgagtagaaacaagtggtaaagacagcccagactgtagttcaaagtctaagaacatctaagctgcgggttcaggtataaaattagggccctgtggcttatctcaagacagtaactttcaaaggggggtttgaatagtctttccaactgtagctacattacctgaggcaattagtttacttattttttgtttttgttttttttttttgtggttagcttttctttttttttaatttattattattatactttaagttttagggtacatgtgcacaatgtgcaggttagttacatatgtatacatgtgccatgctggtgcgctgcacccactaactcgtcatctagcattaggtatatctcccaatgctatcccgcccccctcccctcaccccacaacagtccccagagtgtgatgttccccttcctgtgtccatgtgttctcattgttcaattaccacctgtgagtgagaatatgcggtgtttggttttttgttcttgcgatagtttactgagaatgatgatttccagtttcatccatgtccctacaaaggacgtgaactcatcattttttatggctgcatagtattccatggtgtatatgtgcatccatcaaaaagtgggcgaaggacatgaacagacacttctcaaaagaagacatttatgcagccaaaaaacacatgaaaaaatgctcaccatcactggccatcagagaaatgcaagtcaaaaccacaatgagataccatctcacaccagttagaatggcaatcattaaaaagtcaggaaacaacaggtgctggagaagatgtggagaaatagtttacttattttttaaggcaagcaaggtgggcctgattgttacatgaattaccaaatctaatgacaaagccaggtgccctggtactgaggctgtgtctcctctactccccatttcctcccctttccatcactattttctccaccctgcctatcctcatttctctttgctcctcctctttttccttctactctcttctatcctcccattcttttatttctcctctcttacatcccttccactccctttccttctcttcctttttttcttctctctgtctctctgcatgtgtctgaattaactcttgagtcagcatttaaatttggtaattgaatgttatgggtctttatgggcttcactttgggagaactgcttttcaaacagagaacctgataagtggtggaccttagggttactttgacatgtttacaaaaataaacttatcagtagttttagagactgccattggagcaattatagtctatgctcacagaggcttggtaggcttaccacaatccaacctcactctcccatcattgattctctgctctgtgaaacaagtactgtactcttcttcaagcccaggtgaataaggcttttctaggaaattctttgggattataataaaataattccttctatgagaaaggagaaaatggtggcttttggtcttaagtagattatttaccatctctctcaagagagataaaccataattcttaacaaaaccatattctaatgaagtcattggtcacagtgtcttctatcccaagagagatgcaaattactaaattcctgtcctggtacaaatataagaaatccagtcatggcctgacaagtttgaattccttcttgtccttgatatactctgtttacccccattgtaatttatctcttccttattcctccatattatttaatttagtaagcaaatgtcccctggtataagctgtgtgaatattataactgaattactgtctgtttgcttaactcattacagaaaactatgataaggtttttaattacaaaattagccctgccaaatgaatttctttcattcaatgaactgcaaaaggtggtacagtgaggataaaaatcatgtcctttcccatgttatttatagtacttttttctaaaaataattgttataataaaaaataatgccaacaacaacaacaataatattttcttcctcgtctgtttttgtgtgattcctttaaactgttaattcatgctgaacttgttcaaccaagattccataaagtaatcctcttcaacctacattttattctcagccttgtcttgaacatcttactctgacctcactagctcttcacttaccaatttgtttctcatcttctccttaataaccttatgaataagttttctatgtagtcccttgtattgctctttagacctgtcacttatcacttcttcttcttaggatactcttctccactgtaattcttatgtctactctaactatatatctttgaattctttagcatacataaacatatctgataaagcaggatcaagcacaaagatgctgtatcttgcctgcatccaacagactgggattattctgagctctcaagcaaaacatggttaaatcctgacaacaaaatgaagtgacatttatgcttacatatatccttccttgttttctgcattttcatttgaaaagtaaacatctagtccattttgtttatgtgtctaataatcattttattttactttaatttctttggtaaaagctatggactatggccattgcagaattatcataatttccatggagaaacttctgacatattttaccaaatatttttgaaatgctacactcacagttaaacctagagaggattaatttgggaaaagggactactttatgaaaatgtgggaaattatttctattctttcccttttgtcatgcctatttccctaaaattagattatttatactatacaagtaattaaacttatttcaaaatctaaagttaagagaaattaacaggtcattgctcagaaaaatgcatagtaattgtgagttttctaagactgtcacaacatttgaccaacagtctccttactgaaattttatggtttctttctctagacaaggccacatgcatatgaaagcagacttaaaatatttttacctatagctggaaaatcaaatcataaatggcaaactatgtattacttatgttataattttggagctataattttggagctataaatccaggatatcagacttttttcccactaatattgtagtattaataaaaaattctcttaatgtgtttgcaactaaattggcattaatttaatgaattctttctttgaacattcctcatttttagccagcggttggtggttgagttgcaaatggttattgcctagtaagagatggcctatgaagaataatctatttcactggatcccttggttaggaatgtagcatatgcttgcccaggtccacttctaaggaccaggtctgtttctccttgctactgcctgaaatagcataataattaattcaaaagttggctgcttttcactagaagtctttaggacattgtaagacaattaagtctgtagaagaatgagaaggaatcttttatttgaggtctagaggtgtcataactgtgaatcacaaagttgtggcacaatgcattcacctcagaaaattttcttcatgaaattaaagtttcattttgtcttaaagaaaaggttccactctcatgcgattttgtgtgttctcatcaaagcaagaatctaacttcctgatctggttactgggaatctatgcagacacacacaatccaacctctggggcctgttttgcaaacagtctttatgtcatgatttagaatactgcataagaaatttctccttgaagagagatgactgcttttgacagttggcttttcccagtgcagtcattagactgcacatgactgatgtgtgtgcatggacagggaggggtcttcattccctggaactataatgtcaggtttcatattgtctgagatcagcatctcttcagaaacaaccatgtactcctttctccccaaaccaccttccctcctgaccataactggttatataatcttgcatcttctattaccctgactgctgatccgtgcctgatggctatgccaggtctcacaacaccacgagcttttgattgctgcactctaagctgcttaataagacaattaaaaatgatttacaaatggccatcacaatgcaactggggatcaggaagagaatgttctatttgctccaatattaaaaacgcatgcccttctacagttccttctgcagctgcctttgatttcagtactggtttactccctttttagaaattatttttttgatgaatatcatgttaaaatagttcctcctaaataatgtatagctggaaataattcaagggatgtgttacacatgctaggtggtctgaaatcttcttccctttggtggggtaaacactgcctagaattctggagtagttaaaaagtagtacaaatgatctttcatcatgccggctccttctcagtttgagggtcaaacctaatttaatcactgacacatccatcttgagcatttcctctttcctcctattgttgcattgattaaaatgggcaaatctcccaaagattccattgtgagtcacacaaacgttcatctataaaaagtggaaatttatcagaaatgatgaccttgatattttgaatgtaataactgagaaattcaagtagaatctcatctagtatgtgttgaaaatgctcattttttgtttaattttgtttagtttttttttcttgtccagaggaatgaaaattgatattggcccaaatattaagaagattctctatttttagtgctgagacccaaggattagtaagatgggcattggcagggttaccataacttttcttaggaaggatgtgtggaatagattttttaaaaagaaccatctttgaagccagatatccctgtattttattcttgcctttgttacttagtaaagtgtaggactttgagcaagatgctacatctatctgagattccattttctcatctgcaaagtgaatacactaatcttaacattcagatttgctatgagaattgcatatggttatctttgtaaataaagtgcctggcacacagtaggtgctcagaaaacattgatttcttttaatcctctcattcaagagcacagatgataaaatatttatcactgttagtggtgttatccctggtatatcctggcaaatgcagtgagatactaagaagtttgatgctgaaattactttttcagcactagattattacatttttatgacaatttgaaaattaacctatcctatgtgtatcaatagcccagttttgtgctattttcaagtaatatgaatgttacagtgatggtggccacatgatatgttatgaaggaattttatttacatcaaacttcccacaatagcctgtttattgaattatccctgaaataaaaccaataaacctgtctttggaaaccagtgaccactgacccacttacatgttatggatggtttcttttctgattgccagttagtgtgattggggtaaggaggaggtaactagtgtgactttcttcagggctccccttatactctatgtgtcttctctccctagctgtctaaagttctcttcaccttgaagagcctcccatatttaacagtttatgatggatgaccagcccacattagggcactgttcaaatttcagatactcaggaaggccaatcctcagagtgtttctgatcaaaacattctttcttatctgttctgcttttttaaaattgcttttacttttcttcctttttttgttattcctaccaggttttgttgttattttttttcttcaatgatgtctaattgcaggttaccatttcatctgctactttattttttatgcctcaacatttggtcttctcacctctggttcacttctcatgggattttcttcacctaaagttacaacttattcttccttgtcagtcccacctctctggagctgccaaaagctccctcttgcccctacctgcttcagccagcattatctgcagatatatcaggtaccatctgggtcctacccttctcatatagatccaccccaaatctacctgccttttcttttctttctttctttccttgttttttttttttttttaccttcaggacttatgattctcagagaaaagagatggagaaaccagcccataacttatctatctgagctgaaacagaatcaatgacaatagtggcataagtatccaatgattttgagctaggccttgtgagtctctgactgtaaggtcaccctccttatctcaccagtgtgctgagccttacccaatcctcagcatatcacacccatgtactgagtcactctgcatcaatcccacgttggggaagagagcaaatctattggcaggggataatacaggatggaattagcacaaaggctcttctagtactacaaaatggctttcttgccatctacttgacccagcaaaactgttgtgtgataatatttaccttaaagttggttgttagagggagatagttgatattcacatattagatctcaatagaaaaaatagatagtataggggaatattttttactccataccaaacttaataatttaccattttctatgaaagtgtcttacattctacttctgtattttaataacatgttaaaattatgataattatatgatgtttttaaattttttaggtgcttttctttttctaccatgacaatgctaagtttctcttcctgattattcttgataatattctcccccacaaggccaatgttatctcctgtttcttccctccactctacctaggctggtttcctccctgttgactgtcctatcatgcgtgttcatctttgtattcttcttgaagcctgtgatgactttcactacattctctaccttcgcaaatgcagcatttccttcaaaagtcagttccaagtctttcctggacacaaaaatcaccacttatgtttctgtatgtgaaatttatcatgaaatgtaatacctaaatttatagtatgtggtatcgtttcctgtgctactaagtgcattactttgcctccttcattagagtacaaattcctccaagttaagggaacatggagactatgggcacttctctgattcatgtgatgttctcacaatattgaacatagcacatgaaagaatatgtgattatcagttggttagtggctggcttgctttggatagtcattcattcattccttaataatggttttctagactgtgggttacagatgctcccttccatcctcagtcacccttgaaaatatgttgaattacatcttacactttgccttagattagcgtttgttactatgaaagaaagaaagattttctgcctttcacagcctggatcctactcactgagactataggctgtcagaatgctacatgctcccagccctttaactcttttcactctgctatggccacaactggaatacaccttttcctcaattacaaaagccacacaagattctacctgcagcctcagtacacttcaacaattctcttattagtccttttgtaaacttactacctaagattttgcagtccctttgatgtctatatatcttgccaatctatcacttgaaggtgcctgttttactccaatgacaaaaaaaatccaatctaatattttttcaccttttctttctctgcctcagagttgataatacttacctttgtcactttcgtctcacctaggtccaggcatgagcatagccctgcttcatttcaacttagcctatctttatggccttcaggtctcctctcatctggaattgagttctgtagattttgtcctgtatgcccataatccactaaatagtgttcccattgttttcaaatataattcacaggggtaaagatagaaaatgtattttttagggctttttctaacaattatattttccatggaatgctgaagtcccacaaggaattctgaggcccaggtaaggaagaagaattagggaagacacaccagtgggaggttgcctagggcacaccaaaccattgcaaaagtatagtaaatccaggccaatccacaggtgagattgagactacagaatacattgttctttggttagaattggcttaacaacaagtcaatgacctaagctagggtaggcataagctggcgtgtcttatctcttatgcaaaattgtaagttctccgagaatagtcttccacacttagcatattacttctattacacattttaaaagataattttgattgtatgggttaagttaaatgtactccatgctcaacgttaattgatgaacacatatctattaagcactattgtggaaaatctatttggtgaggatacacaggaactccaaggaagggtaagacctttattctgcattctaggagtctgtaacatagctgaggagaagaaacacccagtaaaaatgtgtcactgaaacttaaacaaattatttaacttccttaaaaagtagtttttaatatgaaaaatgggagattaaagttggtcttctaggttccttagaattctagaactccaagtaaactagatatacatgtgtccatacttatgtcagatgggtgctatccacagtaggtgctacagttatgcagaaaataaagagatatctggaaactggggtagatatacattcatggaggtgttggagtttgaactgagccttaaaggaatagtcttggaaggaaaaattattatccatcactgaataacgtgggcaaaagtacagggaaaatacatctctacttttttttgttgttgttggggcaggcttcagccaaaagagcatttggaattgtctcgacttttccctgctctagacttctcctgtctctgcacatttgtttctgcattttcagaatctagctattttagtgtaccaaatctcttaaaaggacctgtattcattgtgatacaacccctataggaacttgagataatcagaatttcaagagaaaattatagtttcttggtgcctgaactgacccaacctcatgggtttaggatactaatcagtggttccctggatcagttatctgatcctgtcaccaatcaaggacaggactgtcacgtctcaaaatactactttttcaaggggaagaatatttctcctttagtatgtctcagcggaggtggaaaatgcaaataacctttttaggagccctttaaacacatagactcctcacttagggcccaattagtaggaacaaccaacctactctacaaggttttactcttcccttgaaattacacttcaaaaaaacatgcactgactccccccaggcatagaagcaggatccgtgttttaattctaaccttaattaaatctttacacaaactcactatttggctgtccaatgaagaagggcaagtagaaggaaggaagtgaagagcatttgctcttcctctgtcttccgtgagggttatatacccaaaactctctgtcttaatttggaatagggggaattagattttgtcataaagtcataagagttgtgttataagagtacgtgtatacagtagttgaaatgagtgcccagaaatcttcctagtttcttccccacctgtcatggagtttcattgtattaccttgcacttaacaaagccaaatcattgaaagatacagtccctccatgaacaacaatcaattctgtaactgatccttacccatctatttcaataccatgcataatgacactatcctttggaatgcagggaaaaaaattccaaatgacaatttgtcttaaatgtagacagtgctttaaaatatatgcctgatcataagagtggatatagtatttaagtgtgtcagaactttcttgctcttctaccttcctcctttttggttattgttgaaaatatatggggaaaaaatggcaaaagaaataggccctacatctgaattttaagttcctgttttttgagagaaagaaatattttgtttattttatttgttttttttttctttcccattagtaaaataattccaactaaggtaaagtttagtggaactaaacttttactgtgtgcaactctgactttcaagagtaaaaggaaagtaaatgtaataccccagtacacctaaaaccaggattaatgttttactttatcttgcaacagtactaaaattaaaagcaaaacaagacacattttagatatgatacagtgagcactagagaaaacctcttttattgatgggagcatattttaaaatatcttctcacctttagtctttgggttagtctcagtccctctgcatagggagcaaacaatacatgaagaactatttgggggaaattgctataaagaaacaataacttgctagggaaaaaaaaaacaattaactgtgaagcatgtatccctgaatctgaatcatggccataatacttattagtcccccaaatttgagcttccattgccttacttgtagaatggagaaaaaaaattcctcttgaggtgtcagtaaaagaagatgaatgtatccctcatgtttattctgatcagattatttttattttttgccttatggcatttacctttaacaattttgaatatctctgaaagaaagggagaaaggatggaaggtacgaaggagggtgaaaaggaaggaaggaaggaaaggtctttgttttccttacctggcacagctaaatattggcaaatcacaatagatagcaaaaatctaaaatacctaggagtacatttaacaagaatttatatttttaaactataaaaatgaataaatactatctaaatcaaagactatggttttgagtggtgacaatttaatatcaaagtaattccccactacatttctaagtaaaatctccctctggtgtctttttcttaatttcccagtgttcttaaaattcctatggaagaataaatatctgaggatagccaaggaaaatataagtaagaagactttgagtaagaactatgctttataattctaatataaaaccattgtaataaaaaataatgtatgaacctggcatgaaaagtgggcaaatagattaaaggacaagaattgtagctcagaaattttccccagcatacatggaaatttaatcacttccaaagctgttatcacaatttagtggagagatggaaagtgtttttttggcaaatggtagaaagataaccaaccatccatatagaagaaaataatgttggtgcctatctcacatcataaacagaaataaattccaagtgaattgaagacttaaagtttaaaaaattattaaaaatattggaagaaaatttggactagagatacaatctagtgattggttgaaacattgctaaccaaaacaagaatcctatatgctataatcttaagagaaaaaaggtcaacatataaaaagtttaagagaaatttaggccaggcacggtggctcaatcctgtaatctcagcactttgtaaggccaatgtgggaggatcacttgagcccaggagttggagaccagcctgggcgacatgatgagaccctatctttacacaggcacacacgcacatagctgggcatggtagtgtgtgcctgtagtctcagctattcagaagactgaggtaggagggctgcttgagccaggaggtaaaggctacagtgggccgtgttcatgcccctgcactccagcctaggtgacagagcaagaccttgtctcaaaaaaaaaaaaaaaaaaaaaaattacaataaaagatatcattgccaaattcaatatgtaaattatatatttggaaatgtaataaaatgtgtccatgagaattacaagtagttataaccaaaaacccaagtaactgtggcttggacaaattaggtgtcttaatttttgacatgtaataagaagttggaaggtaggcaatccagacctcatacaatgactccatgtggtaatcacaaactgagctcattctacctgtctccttagctgtcctgactatataggctttcatcctcatatttgtcacttcatgttcactgaatggcttctccaccttaaggcaggaaataaaagaaaacaggaaggtgaaagcaaaaaatgtatatgtgggctaagtttgtatcttttaaaagaagagacccagaagtctcttctagtaaattatggttatatatctttatccataaatgtgtctatcccagttgcaaggacaactggttaatatgatttgttttgtaattgtttttgtttctctaatctgggcatatttgcaactttagcattagagttattttactatggggagaagggcaatattaattccagaaaggtggctagcagtgcctgccacacaaatgaaggtagcgttaatgtctagactctacctaaaatttttgcaaattgataactgaggaaaacaacccaatagaaaaattggtgataaatatgaataaacaattcacagaagaaaaaattcagattatccttaaaccaatgaaaagatgcccaacctccttcatcgtcagacaatttcaaatttaagtaacaatgagatgttttgtattcatatgattggcatgaatttaaaagtgtggtaactcctattgccgtttgagatgtagaaaaattttaaattgttacagcttttttttaaaaaagattaacttttgaatggcagtttctattgaaagttttatatatatatatatatacacacacatatatatgctttgatcagaaatcctaattatgagactctcatagaaataaaaataccagtatctagctatacatacccaatattgcatcatattttgcggtggtttaaaaaaaaaaaaagaggaaagattaagtaaatgttcactaatagaaaaatggaattaagtaaattatagtaaatccctatcagggactattatgcagtcattttgcagaatggacttgatctgtcttcatctaaagcagatgacttagaaatatttccacaatgtattgttaagtgaggaaatgagatagtaatggagaaagataagaatgatgcaggttattaatctgggtggccagcgcttggagagaggaaggggagcaataggggaatatggaatggggaaagcaaaagaaatcaaattttagatatgtacacaagtaaaataacttagaattcagatttcctttttttttttttttttctgaggcggagtctctctctgttgcccaggctggagtgcagtggtgccatctcggctcactgcaagctccgtctcccgggttcacgccattctcctgcctcagcctcccgagtagctgggactacaggcgcccaccaccatatgcggctaattttttgtatttgtactagagacagggtttcactgtgttagccaggatgctctcgatctcctgacctcgtgatccgcctgcctcggcctcccaaagtgctgggattacaggcatgagccaccgtgcccagcccagatttcttttttaaaagacctgaaataaggaagagaaatcatagcataaactaagtttaacaagatcagtgtgggataaagaacagaagattgagaatttttttggagctgttcctgattagatgttagaagattttggttatcaccaatccttttcagagaaaaattttataaacttacaagtatccattgcacgtgctttacatttgttttatatcaatatgactgtaaactttatagagatctttttaatacatgaataggacatcttatttttaaggcaggtaaatgtgctttttctcacttcaaacaaattatgtccacaagctgaataatgagaagggtacttcatagtgtatcacactgccgaattacacgttcactgttttcatccttgaaaaccgtgggctgcttcagagtgggaaacagtcttcactgcttataactgagttccagaattttcccagccatctgattcccaagcccagagcttcggcttctgggttctgttgctggcagtgaggaagtgggatagcacattgtttaaatcacagcacttctctgtttcctggctaagttacaaaacagtgttgtagtcgtgaaactgaatatcatcagcacacatttgtggcatgcacagagcatgcacgactctgtagtagcgctctaggcaagcttatgatggcttttaaaagaggtgttgttgcttcctttaggaagtttatgaactaaaggaagacaaaaaccaaaccaaaccaaacagaaagcaatgcattggactttccatcacagcaattacatgtctgattctgggctttgtgcctattaatactcagtaatatccattgaatatgtgaacgaaccaaccacgttaacaggaactgtactgttatagcaattcttaactggaagttttgtcttctgcctcactccactagaatctatctccatccagttgaatgcaaatctgataatatttttttcctatggtttccagatagctttaggaatcagaaagaggcactgattgtaaacctgaaagtgtgctttgtggagcctgcatgatgttttaaataattgaattagaatgccttttaatgagcggcacactctctagttttcccacagaaaacctctagcctatggtgttgaataggtgatcccccagctacaggataaaatcccaactcctcagtgatgtacagactcttcccactttatcccttgcttattatttcagtcttgagtcccaccattttgctatatgcaaccggcactctagccatgctggattgtttgctgtttcctgaatatgctgtgctcgttcagtcctctgcaaatgtacttatgctacttctttctcctgaattgcttattctgtctcattaacctagtgtactccctcctacccattcatgttcaattaaaatattactgccctcataatatcatttttaactgacctagaaaaacaagttagatattcacatcttcaatattccatctatttatcaattgttgcactttttatattgatacttatctgactcttcacccatcagaaagatggagttctctctttgtacaccttgcacctatcactggcttcatcacaggatccctatcacagtctttttgatgaagcattgttggatggatagatggatgcatggactaggtgataaatgaatgatgaaccattaagtgaaataaggagtgtggtatagacttggaaaagaaaagttactgttgaaatagctctagagaaaaatattttttaagagttgtataggataagatgaaggtgaggatgacttatctataattttatctttggaaattgtgagttaacatttgtaaacagggtggatattttggagagaaggtgctacataactacagcacaattatttattatcctctaaaatagtccctttctttggcatgtttaaaacctaaagtctggttggcgttataaatatgcatgagctgttgggggaagagagcataaagtgtgaatcacacttcaaacagacccacccgctcactcccgacttcaagtttttcagaagtgtgaaatgaaaatgctttaaaattagaaaatgtgccatcagaacttttatcagccctcggagaaaataaataatctctaaatgtggggaatgctggggatatttatttagttagtttcacagctaagatgctttgataaatttttgtgtcataaaatgcacaaattaattttaatgaatgtggaaacaaataacttctaaaacagcctgagtacccaaggctgcaatctagggtttctgagggattattgaaacctaatctatggacaaattgtctcaatggggaaaagaaactcttacaggtgtctttccctctgatacatttgcatttgaagggtgatcttgtagcatttgaggagtgggtgaatttctggaaagagacacttggatcttaaattgctaaatggtaacgaaaatgagagaaaatagtacagttagctgtttgctttcgagtttgtggaaagtgattttctaatcaatgttactcttgatttcttaagcataacaagattaaaatgagtgtgaatataaaagatcatgataaaagataaaggatgatgacctgagatcttctttattttttattactaatttgtttgaagaatagtccatcatttccagtaactttttgaccaaaaaaatggctatgtggttgttgccatcaaggccagtaatagagaagagggacaaagagagaggtgctccattggtatcctcaacctgtgtgtagtacataggcatcactgggtgggctggagctagcccagatggctgggctccacccaggtttcctgatgcagtatgcctggggttgggcagcctgagttgcatttgtcataccctcccaggtgatactgatgcacactttgagaaacactgctctgttccaatacttacatgcaatttttttaaaaaaattatgtaatgaccatctgtggttaaatgctgagctcattttataaaccttaagcgtcttggcaagtgtctctgtcttttttttaattgtctgataatttaaaataccattttattagcctactattgtggaagttgaaactctattatattcactctgttattgttaaccacctcacattttctgtggtatcgtagaacagaaattgttctaaaggaatggaaaaacaacatttactttcatcaaattgttgtctagcctcttgattgagttatagctattgttactaatttattgctagtttttacaacatgcccatgatttttttctgtttcagactgaaagtaaatctgaatagatgaaatctaatttaagtacatgctgttaggttctgtgttttgggggatagattaaaaatacaagagaaagcacaagacaacatgatctctcacatgtatacatatgttcaactgcatgtcttttgttgataatctccaaaacatacatattttgacttcagtaccataccagatactggaaaccaagtgataagatgactttactctgggatgtgaatgtcattgagtcagcagctttctaccaaatcattaatctctgcccaggtccaaattgcttcagtgattttcctaccactcagcattttccttggtgaaggacccttccaatacaagtcttctggcttttctttctactagagggaaggctttctctcagcagctatttctaaaatgaggctgatgatgagagtgatagatgaaaaaactcatctctgaggtttgtcttcttcttgcatctgctgatagcactcacttctcagctcctctttatacctaaaagatgtgcttctctattatttcaataattctgatgctgctcattctttacttattttcagagatgtttatgagatttcaagctccttaactagacatatacaaagagcaagaaaacaacaacaacaaaaaattctccctggtcttttctggaactaacaatagaatacttgaccaagaaccaagattgcagactatctcagtgttagtggaaccatttcacttctcgatgttttcttataaaacacacagtttgagctgtattgttaatctacttggaaagatattatcattttttaaaacaaatatctgctgggtgagtgttaggcaatggctctcaaagtgtagtcccaggaccagcagcattagcaaattcccagttcccacctcaaacctgctgagtctgaaactctaggggaggaacccagcaatttgcgtttcaacaagccctcccagatgattctgatgttatagcaattcttaacttgcttaagaatttggaaagtcttacaaataagggcaggactgggtggagaaaatggagaggtctgattatctttcatgtaatccccacataatttggtgtctgcaggagacacttttatttgtttgctataaataactgggagcttgccagtggtgaagaagatatccagagaacattgtgaatatatacttagtttctccaacctggacagaccaggagcctttatgtcaagatcctgcacggataattcccctcaggtggagagctggtggtttttccaagcacccagccacaactgccactgcattctatttctttaatgctcaatcagtgcccctggccatttgatgatcattcctccctaatgttgtgaggtatttagtccaaatagtacaatccatgtttgctttctttctcttctagtaaaatgtataggttgctgtaatagcctgtgtctgccccagaccacaatcataaaaataataataaattacctcgctgtctctgggttttctttcaggctcaacatgtggtttgtggcttatggggtattgattgtgcattatcagtttagctcacacactgacaattacatgtagcgccaaggtagccgtgacaatgtagtccagttgccatagcaatgaaagaaggcctattgctgctacctgcaacctgctttatagtgataaacgtgctgcttatttcattttaattgaaatttgaaatcatagtctctagcaagaaataaatggactcattccccatttttcccccttggccacacaaaaacaagtattagtaggaaatatctgagcatttttaaaaagtaaatatcaaatttttgacagtatgttttccagtagtttcactggtactagaaacagatgaagagtgatactttgctgaataaaaattgaattagctctcatgtttttgcattcttaattaactgctattttttatttccctaagtccctcatcttaacagcttaccctgcatggtgtactttatataacagagactttaatggatttacttgctgagtttagttcatatctaaaaactcacagcagatatcataaggtacttgaaaattagaatcacagggcgctgtggaagcttttacataattgaaaaaattgataataataataaatatttagccatgtacggtttcacttctatgccagtgcctcatctatgcctcagacctaataatctttatgtgacgtcattactacgtactacagtcatatacaatctatagtgctatatgtagccaagagagagagatactgtgaaatatggtcaggaatgaagagattctatgtcagtcagtccaaaaaagatagaaatttagtacagaaaaccaaccaactatggaaatgaatagtaagatagtaactaaatatgtatagatgtgtgtatatgtatgtgtctgtgtgcatatatatatatatatatatatatatgcacacacacataggcatgaagtgccaaactatttttaaaagtatgaacttggtctataaagattctaaataggtcagtggaagactgggtcaaatctgagattccactttgaccttttgatctttatctgaaagaagtcagatgatttcccttttctggtacaagcctgtaagttagcacaacattttatttccctggactatgtgaagtatatagtagatatttaggacagagagaaacctatggtggggagtaaaatttaactagggtaatataaaatataggatctccccttaaagagcttatgatgacatgtggctgggcacggtggctcacgcctgtaatcccagcactttgggaggccaaggcaggcggatcgcttgaagacaggagttcaagacaagcctggccaacatgatgaaaacccgtctctactaaaaacacaaaaattagccgggcggatgagggttcctataatcccagctacttgggaggctgaaacacgagaatcgcttgaacccaggaggcggaggatgcaatcagccaagatcgcgtcactgcattccagtcctgggcaacagagtgtgaccctgtctcaaaaaaaaaaaaaaaaaaaatcttatgataacatgaaaacttatttttttataaagtgacctcagaaaatgtgcacagggtggggcatctcatgtgaaaagcatctcaatcattgattccagccacatgccatcataagcgctttaaggagagatcctatattttatattaccctcattaaatcttactccccaccataggtttctctctgtcctaaatatctgcttttagaaggagtaaacatgacttgggaattagatggctcccatctgtgaaaatggattcttaccagtggtgttttttgggtggttgggttataataaaaaggaaaatattatttcccttatattttagtctttcttcttactcctagttataatcatggtcctccaaataattatgatgataataaaatgatcaatatcatgtttaatttattttatgtccttattaatacttactgagtacctagcatgtgtgaagacgatattctaagtcagcagtccccaaccttttggcaccagggaccagtttcaccgaagataatttttccatggactggggttgggggatggtttggggatgattcaagtacattacatttattgtgtaatttatttctattattactatactgtaattatataatgaaataattatacaactcaccataatgttgaatgagtcggagccctgagcttgttttcctgcaactagatagtcccatatggtggtgatgacagacagtgacagatcatcaggtattaggttctcatgaggaacgtgcaacctagatccctagtatgcacagttcacaatagggttcacgcttctgtgagaatctaatgctgccactgatctgacaggaggcagagctcaggcagtaatgcgaggagtggggagcggctgtaaatacagatgaagctttgcttgctcacctgctgctcacctcctgctgtgtggccccagtttctaacgggccacagaccagtactggcctttggccacgggtttggagaccccttttctaagtgttaagacaagacttggaccttcatggaacctatattctagtaggattaagacaggcattaaacaagtaattacacaataaattacttaagttcaattataatgaaaaatactagattctacaagaaattataaaatctactataaaattctttagtgttgttagcagataatttactcaccatttaaaaattatatcattgattaaatcaattttaaaatgggaagtgactttgagaaacagacttactacaaacagacacataaagaaaaatctggtacatgttaaagagaaatattgctataaaatcagaatacattatatgaagtctacatttgaattatgccatgtgtcaagtttgttaagcatataggtaagatgtaattattattttgctcttgatctacttttattttttatacccttaattctaaacctttggattgtattgaactttaaaatacatatatttgattcatttaattttaaataattgaaattattatcaaaacctcattgctctgcttgaagcagtagctctacttccctatacttcagtttttcatgtgttatagcaagatctgtactagaattagccagttcaacccaaccacatctttctgtttcgtccttgccttgactgttaattagctcagtggatttttatgtcatgaatgcatttgttttctaatacatcttcattttaatgtaagatggttgaaaagaaggaccaagtcctctgagaaccccatagtacaaagtaaaatgcctcacatctgacaaatgctcagtaaacatgagtagtgggaaatcttgattatatgctcattaaaaatatatctatgtatttaaagtagtaagtctggtgttcaaaaggtaaaaccttcaaaattctaacacagttcttgtttggattaactctagtctataatcacaactcttctgtttccttgtctgcactgtgctcacataatggctatgtctcttaccgccaaagcccggctcactgcttacaacggcatcctgtttcttcacctgtttttcttttgcttacctgacaagctcttgcattcataaaagtcgaaaggattccagcttaacgtttcaatcccacaaagttgacttccatagcgtagcctggaacaccttgtctgtgaatagatatggaatcctcaaatggttttgaagccactaccagcaacaggtctgagatcataggacccaagaagaaaattgaggctggggaaccacagagagtctttccacaattcaaagtaataacaaagcagccacaacagcagaggtggggagagatgtaggcatcagattgcctagagctctaacaacctaccctccacatagaagctgctctctgcttcaggcttcagatccttaaatatgggtggggtccttcatttagtgtcaaagaattgattagaaagctcctgcaatgtaagctcattaatgaaaccattttggcaggccagatgatataattagcccaaacaagatatgaaatctacagtgttttgggcaactgttcagtaatttttaattttgtaataaaaaagacaaggaaaggaaacagcaagagaagatgattcatgcttattggtgaaaaagaataagatataaagaaaaagattccaagataacatttgctagatgtggatagtaccttcaggtttccatcatccttctgaagacagtagcatttacaaaaactgtatcatctctacctttacaaaagtaggtgctatgtcaatagtgtgtttataggatgcatggatattcttcaaaccaaagtataatcacaaattctggtctcgtcacagacattcatttaaggaacatctccctcccctgcccccatgctaacctgagctttctggaggatgataaaggcgacctgaataatgaagtacccaagtctcactactgaggcgagtcaggggtaaagagtttagcactgagtggctgaggatacgtatcaagggaaaatgtcatccttgggacttctctttaaataccagaatatgttttgttttgttttgatttgttttcctatcagggatgtgtctttattggcaatccctaatggaaattgctctctaattttcctctagtcttcttatttgtattgtttgtatatgaaaagatgagatgaatagttaagggtactgcacaaatactttgcttggtcctataggctctcaggtttttttgatatcatgtggcatttgtgtcaaattgagttgtgctgtaattttattaacaagcttcacatctcagaatattttacagagatgcacctaacacagttgacatgttgtctattaaaagttacatcatcttaagaagttattagtccttttaaacatcattttcattctaataagctattttttatttctaataagctatttcttatttctaataaactattttttatttctaataagctcgtgtcttgagcagaaacactaatacccaggaaattttctgaggactggctcacttaaaatgaagggaagtcactccacgctctgagttgtcttctctcatcttcttcatgtgaaatcctggacacttgcagattcatgacaattcagagattattaatccaattgcttttaataaagactgtcctgaaagatacacatggtgaaacattctaattgtaaaagattcatagagcaaacaattctgtaacatctatttccatatgatttgagcaatttcacacttgggaatttttttttttttttttagatggagtcttgcactgttgcccaggctggagtgcagtggcacaatcttggctcactgcaagctccagctcctgggttcacgccattctcctgcctcagcctcccgagtagctgggactacaggcgcccgccaccacgcccggctaattttttgtatttttagtagagacagggtttcaccatgttagccaggatggtctcgatctcctgacctcgtgatccgcccaccttggcctcccaaaatgctgggattacaggcgtgagccaccaccgtacccggcccatacttgggaatttttactacagctgactgaaattttttatttgaatcctattttatatatgaggatactatttcttctttacagcattaaattttctagattaaaaaatactcatttccccccaagattttataaaataatttctggcacttctctaggttttctagctgtatgctattttgagatgacttggagtcaaactgtctgggttgaatcaaggctgtccccaccagttactgtctgtctgaccttgagaagttatttaacctctcagtgtggagatgttcatggtacatatctcatagggtttctgagtggataaaatgttctgatacatgcaaaatagttagaatagtatttgcctggcataccttaagcactcagtaaattatagccattctattttattccattccatgttaatggttcaacatgaaatagaattgcatccaaacaaatcgtgacgtcaagggtgttacctgaaaaaaaaaggtgtttcttacttaaatatattaagtaaatatagggttgtgtacaaattttaaaattttgctttactgtgggacttttagaccttttcatatataaatatgtattgtgtatatccaacgtggctaacatgccatgtctctctcttttttatgaatcacccactaacatctccagtgaatcaaatttggaaacaatgggcagtcacaataagatacatgtctgaaaacccaaagttgattttttcatgctttcagtaattacattgaagttgtcccaaaggcagaagaaagaaaaagaaatcaagtctccaaaatttctctatcctttagaaagaaactccaccttaatttttggtgaggagtaacagatctcacttgggtggtagttacattttgtgatgtgagggtgtcagctttttctccaaggatgacctcccaagaagggcagggtcactcacttctgctacacttcccagctgtctcttttggctttgcacattcctgtctcatgactctacagggaaatccatgatgtagattttcctgtattcaagcaggcaaagatacgggtcaaacatttaaggccgttaacaagaagttaaatcagcaacaacatttatatagaggcattaattcagggtgaacgcaaaatgtgttgcagcatcgattctggcatttttctctgctcctaatagctctgagcatttgatctatatgttatatggacctaaatgaagggaaataaacatctggacagattccttccaatcgagtttccttcttaccatttttctgctgtgatagttaaccaaggccatgggcttcgttcacctagaaccagcctaaaattaaggatgctggccagagtacccaagtgtgatgcttgtagcatttaagcatacagataaattctttttgaaaaatttcaaacaagtgtaccatgagcggagtcagagcccctcttgaaagcaggttggtaaatttccagaaccacttagcagttttcataggtggcaaggcattgtattgttatttttattattgttaggagctaacatttgtttccaggaactgggctaaatggttcaaattcattatctcatttaatctttacaatatttctgtgaggtagaaagtattgttatctccattttagagatagcagttatagaagaggcatctggagctaaaacagattaaatgaccttttccctcaggttcagagtaagtgtcatattgcaccccagaataattctgtgctcaccataatgatttacccttctaaaaggtaatataatgcaatttcagaaattaatgattcttaaaaatgtgtaagcatgcagtgagccgagattgcgccactgcactccagcctgggcgacagagcgagactccgtctcaaaaaaaaaaaaaaaaaaaaaaaaaaatgtgtaagcataagaaaaaatagcgaatgtccttttctagcatcacactagattttacgggtgattacaggaagacccttttgagattttcagcaatggacttttcttggatgagacggaagatgctctcagctggtgtgactaaattgtttgcgacttgaggacatgggtcatgccctctgtgtgtaccactcactatatcctcatcacagttcctgcataaagcagagattcagaagggtcagtcgagaacatggatgacaacccaacactgtaacccagcagcttgtgtcttggtgtaacattggtaggttttgtttgcctttacatttttaccataagaggtcaactagagtttctatcttgttacaagttcattacacaggtatcccttattccttcattcaacattgcaaagaaaacatctgtaacatgctttgagtcattaagagacattgcatacagtcaaaaaatagcatgaatttattaaattcagtactttggctgataaattgagaggaaacctttattgcaatttggtggtgatagtggagagtctctttccaaatataagacctagcattaagaagtatttccaagtctcctattttaggaatctcaaatctctaaattcgagatatgtggaaaaaataggcaattttcaagaaaatttgtgttgctgctagccctttggcttgtacaatacatatttttttttttagaatatactggaaagatgaaatctctaataggtatctttctggagaacagtctttatagcaaggttttctttacacagagcaaccatgcacatgtagttaatggatctccagacaaaggccatttcttccctaaaacaaagccaacaaggcaattgagccaagtaacttcaaactccccagaggggacagcagccattcttaaatccaccatacttttgaatagctatcattggtcattatcttccaaatggctttgtaagtgtctaggcataatgtgattgctttggaaattctccatttttcagggtgctgggaaggacatgaacagacacttctcaaaagaagacatttatgcagccaaaaaacacatgaaaaagtgctcaccatcactggccatcagagaaatgcaaatcaaaaccacaatgagataccatctcacaccagttagaatggcaatcattaaaaagtcaggaaacaacaggtgatggagaggatgtggagaaataggaacacttttacactgtcggtgggactgtaaactagttcaacccttgtggaagtcagtgtggcgattcttcagggatctagaactagaaataccatttgacccagccatcccattactgggtatatacccaaaggactataaatcacgctgctataaagacacacgcacacatatgtttattgcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaactggaaatcatcattctcagtaaactatcacaagaacaaaaaaccaaacaccatgtattctcactcataggtggtaattgaacaatgagaacacatgaacacaggaaggggaacatcacactctggggactgttgtggggtggggggaggggggagggatagctttaggagatatacctaatgctaaatggcgagttaatgggtgcagcacaccagcatggcacatggttacatgtgtaactaacctgcacattgtgcacatgtaccctagaacttgaagtataatttaaaaaaaaaaaagtccctttcttctttatctcttcctccctgcccctttcactgttctgcccaacacaaagttcaagtcgtctagagacgaatatggcttttgcttttgtagggactttttcctgagtcccttcctagcagggtacatgcaatataggcctgtgagaataactttctgcggtgacacagaacagtgaaaactgtaagtcagtctatggtgagtgcaatcctacattatttcatgcataaaaaagtcatacatctgtatacatatataacctatttcacagtaacaataaaaacatatttatcgattcatcagaggatagacagatttgtgtgtctatccaaatgtattacactgtgatttttttcttccttgagaaagatttccctgaagacaatatttatggcagggcaggaatttatattacacttgaatatatgttctgacaaagaagcacattgcattttggaattgggtgatattggacattcttcaaaaaatcttctaaagggaaagaatgtttcatctactcatttgttcagatttccctataatttttagccagcagtcctttatggatcagatattgcatcaaaaaagaaggggaaaatattcttgtcatggagacattttcagattaagttgaaaaggtccataatccttacggaaattttttttttaatcatcatcaggctattcttgacagtcagtaaaatatcaggtctttctcatttaactgacagatttcttctttttgctttctttcttccctctctgtatctatatctactctctttccagggctcacggcatatagtaagtattgaaaaaatgaatttaagtctaacttatacatacttgtgaaacctcattccttatgataaagaccttaagcttttctaaatgcagaatcagccactggtcatttttaatggacacgtagtggttgctattttctggagtgcaggattcattagggtcattgctggcatttggctatgttcagttgccccggtgtgctactgaaggcaagtgtccaaacgccaataatgtttggtttctctcgatattccgaggttatatatcaaaagaagccgtgtgtatggcttccagttacccatccagagaattcctgaaaaaagcaaattattcttaagatcccctggaattatgaatctcttggtggagatgcatggtagggaaaagggaaacttgatctggtttattctgaaccctttcttctcatcttatccttctactaagtcacttgaaaactgttaagaaggagaacatataggcattatgaaagaaactatgttgtagcagaattcttcaaggtctcaggatttacccttataaaaactgtacataatctaaagcataatagccaaaacaattcagtatgaatcagacgtacacatacataattgtctcattgagtttcccatctccactaagtcatggtcactgttttgccttggttatggtaactaaaagccaatggagattaacggaaagccccccaggagaaaatactcttttgcggtctttggatgaaggcctgagtatcagcaggactggagttctaaagaaactgctatgcccattgcatgagacacatgaagtaatgaactatagacaagtcatcataccagtatttcagaaagtgaaactgatataagaacacaggccagacaccaactcaaacaaactatggaagcagggagagcaaactgaaatacaaaggcatggccagtagccagagcaggagtgcctcagaaattgatgatagatgaagacaatttatgtagcagttcgtctaatggcagttctgcagggaggcatccttttgaaggtgatggctcaggttggcctacatgttcctgcccaattttaaaggtgtcataagccagtgtaattggggatctgtctggcttctgacttcttgcataactatgttcccacttacattggggtcttggcataatttgtctcctgacaaagagaaaatagaaaatatccaaatattccagccttatagcatagatgggtaaatataagacctttccttttagcattgatgacagtaaacacaattaatagctttctatttgccaggcatgtgacatacgactctgaaatcttgcaacaacccagttagaacgacttactaagacttgaagttaagtttgcctaaatgtatacagcaggtgattaaaatatggatttaactgctgatttgttcatatttaagatccttgacctttccactgttataatagtacatattgatattccactggcgatgagtaagcatgccttaccacttcacaaatagataaggtggcttctaagaaaatctcaaatagaggtggtcaggaagccacaggaccaaccaagaacccagaaacgacagtgcttactagatgctgcttgcattctaccatgtggatacaatgagtaaaacttgggtactaaagtcaaagtgcctgccaccacacctggctaatatttgtatttttagcagagatggggtttcaccatattggccaggctggcctggaactcctgaccttgtgatctgcccacctcggcctcccaaagtgctgggattacagatcccaactggattgggatcttagcacttacttgctgtataacttctccaggttactgatcatctctaagtctttgattcttgttctgtaaaatatgataatagtaggaataataatagtgccttctttagagatagttgtcaagattaaagtgcttagctcagtgcttgacatagggtaaatattcaacctatagtcaatcatcttaagtactcttgtctcaccgaggaaccatcaggaggtgtaggtaatatgcaaccttgaattagatgtaataaaatggaccccacaggaagtatttggggatattttaggcatattttccagtacacatatgcaatattagataatattttccaaaccaatgctatttaacctcaaatccagcacagtgaaaaaacattgaaaggtaaaagaaaaagtcacttcacttccatagttctcagaattaccatgtagatatcaaaaggtctcttccaactctgaaagtctgtgactaattttgttaaacccctactgtgtgcaaagtttgtcactgggacgaataaggttgacactctcagagaagcaatatgtaaaaagacatgtacaattctcttaatttttttttttttttttttttttgagacagagtctcgctctgtcacccaagctggagtgcagtggcatgatctcagctcactgcaaactccacctcccgggttcaagagattctcctgccccagcctcctgagtagctgggagtacaggcacctgccaccacacctggctagtatttgtatttttagtagagacagggtttcaccatattggccaggctggtctcaaactcctgaccttgtaatctgcctgcctcggcctcccaaagtgctgggattacaggcgtgagccaccacgcctggctatgtacaattcttaaaataagctaaagtgataaacttaccctatggctttgtcatagaagggttttaaagacaaaaaaaaaaattgaaaaaaattgaacttctgagaagaatggtgatattatagatatgctatagcctctaaataagaatagtgatgtttaaaggaatataaattaaagagaacactaaagggaaaagagagatggattttaccctctggatctgactttggttttaaattgcataggcaagagattggttagagagatttatttcaacctttagtagtgtattagcagtgtcacagaacaagggatatggttaaaagaaagaaggtgagaaatgcgaacaaacaagatagtgtcttggaatctgatttatttaaatttagattatattgctgttgcattaatctttgtataaatcatagttctaagcacattaaacttacgttgcagtcaatttttaattttgcaaaccttaaccgatgtttattattataagctgtgaacatttttttaatcattgagaaggcccctctcaagtgaaattttggttccaaatggccaaagtaactaatgggcagggaaaaaaatctgcttaaactctcatttcaatcacagttatgtggaaacatcttgaagacaacagtaaaggaaagagaaagaaatcaggtggatggagaagatacactagaggaatgagatctcctacatgagtaaagtgttttctaatgtgtttttcttgaatgatagcatcttgaatttcctacaaagtatggaatagtttacctctgactagcgctgccctacagaacaatgtcaatttattctaagactgcaatgttcagaatgcagatatgatcagttcaacccagatgagacaatcctataaatgtaataatagaaataactatttgaaacttgaaaatcagaagtgttttaactttcttcaaacacttagactataacaacatttttagtctaatgtaattagcgcaattttcagaggatatgtttatatcaagaatattcctgtgggagaaatagaaacttttaaggagaggtttctaggattcttagacaactaaaactttcgtttgactcagaccctgatattacattttcccaggattcctctcacttgtgctgttttcagtgattgctcaggttatttcgaatgatggcatacatatatcttctctgacatgcaaaaatgccagaaccttctttttcctccctctgttcccagaaagaactaagaacggtctagctttgagctaaattgtacagctgactgtttgttttgggaacttccaaatgaacatatttggtgttgcactggtgcatcccaggaacagaactgtctgaccagaagagcaattctgcttctggaaatttctagcacataagaagatagctggagggtatgtttgtctgtatagtttagaggctggctggtgctataaaggaaagtaagaaaaaggcaaagatatccttcagaggattcccccagaagaaagtagcagttatgaagttttattcctgaggtaggacaggcagtcagacccaagaggtctcagtgtctctccctgtgttggatgtaattgcttttcattgtcaatactgaaagaaggcacacaagagacaaatgaaatgtgtgtgtataaacctggctttggttttcagagacagtcttcttacaccttcagatctcctagatgagctgggccttacagaaaatacaagtcttgagctctatttgtttacagttttcaaattctcagcttctgcctgtaagatatctcatgtgattaactgatttttctaatttaagggagttattttctgtggaggaagaggctataaagtcacatttttatcttattttcttttttttttctctgatatttcttctctgttttccacattccttgtcactgtcaaaactggtaattaatcaagagttagtcatggatggctccttttccctccccttcttatccttcattttcctgcctgagtgataacgaatgatgtctcttgtcctgtacccctggcttcctctcctcagagcattcaagccagaccccatgacaagatgctcccagtgaagggagaaaactgggaatgacaaatgtgagtctgggaacccaggcatcaaggggtggacttcctgatctctaccacttgccatcatctatctctccatgtcaggaggcctttgggaaaagcagaaacaaaagagaaaggaaaagttctcatcccagcattttagcatcatgagaaacctggaagtacctttgcaatagcactaaaatatgatgagtcttgagtctttcccaaggttttgatacccaccagcccacgagtatacatgtaggcatacttttactctctactttctccagcttaatgtttttccaagtgtctggaggaaaataagagcaaacatctttgtaaaattggacacatctcttctttcattatatgattggtttatgtgtctgaacaccttaggactcagtctttactcttatttaactgaagagattaggggaaatacttcctcacccaccacagagtctgaaattctgctattagagactcatgcctttaggtgaaaatgttgcatctccaagaagacccatgaaaacagaagtgattctaggtagaatgaagatacaatataagctaatcgatgatatcctcctataaattcctttggcagatctatttactatggagatccctagtggagaggatggccttaaggaattgggaaataaaatagttaacttgagataggttgaaagagaaaataattcctgagaaaggaacacaatactgcttgaaaatagtactaatgtatttttacagattagtttttgctggttcctgaaccaaatgactagctgggacttcttattctcagatttgcctcacacccacttaagaaaaataccagattgacatcctcaagttataatctaaaatcccagggagggagcacactagtcaggggtgagattaaatgaggcaaaagtgactgcatcacatttcactgtctatagaggctattggcagatttatgcaggctgagttaagtgaatgacttgatagcctggatcacatctatatgtgtttttcacaggcatcatgtcttagttagttttatgttgccataacagaatgccccagactgggtaactcaaaatgaacagaaatttatttggctcacagttctggaggctgggaagtcttagtgcatgaaactgacatctgacatgggcctttgtgctacatgatcccatggtgaaagttatcacatggcaagagagcatgggagagagccaaactcaattttataaccaactcacttctgtaataatgacactgatccattcatgagaacagagccctcatgacctaatcaccttttaaaggtcccattgttcaacactgttgcattgggaattaactttccaacacatgcactctgggggacacattcgaaccataccaaacatccactctgtagaatgttgcccttaatatgctgtgattgatatagatagatagatatagatatagatttttttttccttttcagtgtgttttagtatattagttgggtctcatttgcttgcttaaactgttgtatgaaaaaaaagaaatgtgctgcaaagatacagaggtatattgtgcagctcaaattaggtcaggaatgttattaatttaattagttatccatgcaatatgctgcataacaaacaaccacaatatctccagcagcacaggacaataaacacttatttcttatggagctgtgggttgcttgagggtcagctattgcagcttgagactggctaaatggctccactaatctcagctgggctcactcaagggtctgggggtcagttgaggttcaggttatataggctttgctcaggtgggctaggtcagctctattacacatctcttatcctatttctgggtccagcctgctagcttgggcaaattcttttctgtttctacaggttaattttggctggttactggaccaaatgtctctgtggaaattctccttctcaggtttgccttatatccacttaagaaaaatgccagattgacatcctcaagtcccagtctaaaaacttgggtaggtgcatggtagtcaggggatgaggtcaaattaggcaaatgtgacttcatagccctgctgtaaccagctggaaaataagagaatgaacagacaaaaatagacttgtaccacattaatgacatactgattatttgaattagttaattttgctaggagtagagataataagagtgtggttctcagttgctgcttaccccgaacaagagtcttagtaaattgaccagctgagtcatttgaacttgattcttggtaggaagacttttgcgtggcttatctactgttttttcttctctttttcttttcttactgtatctgtaatttctttttttttttaattccatgatttactggaaatctcaaaggatgtttgaatgaactctaattatccgttgtctttgttgtcgctgactccactgtcaaaaacccaagccaggcatccgcttggtttggtgaccttaaccacaatttgaaggctgctgactgatcagggcagtggttgcggaaggttggggtggcaaacaacaaagatgtttcccgcaaggaatttgagtcttcctttcatgaaagacttctttgtagcatgcgatgctatttgatagcattttacccactgtaggacagctttcaaaattgtagtcaatcctctcaaaccctgccattgctttttcaactaagtttatgtaatattctaaatcatttgttgtgatttcaacaatgttcacaacatcttcaccaggagtagattccatctgaagaaactactctttgctcatctataagaagcagctcctcatctgtttaagttttattatgagattgcagtaattcagtcccagtcccatcttcaggttccacttctgattccactctgccacacatttctctgtgagtctgttaaaatatggataatccaaataacttctttctaatgtgatttatatgaaatggaagcatgttctccttcccccttatgtgctcttgttttgaattgcaaatattcagttttgcatatatttaaaagttattttgacagtatgtaatgtagatttaaaacattctgaagttggctgttttcccttgatcaattcttcttttagaagaaacactgtaaataaaccaacaagtgtcagagcatacagtatagggaacagccaaggacaatctgttatgatattctgtgtattaaaaaccagtttgtttataccactaggagaatttcattttttagtatttggatttgatggatttagtgagaacgatatgatttgcttcattagacagctatgccacagctgaacgatgtgcattactcttaatgctaaagggagataaatgtaatgatagaaaaagttaagggaaccaaagaggcaatattcctagaataagcagatgaaaatttaactatgatgcacagaagttaaatgtcagtaattccattcaactaggtcagtggaattggggcaggaactttcttcattgtagcagtgaagctgttagctggtttacttagaaaccttgaatctgaggaatcatctccagagaacacctgatataagctacagttttcttgactcatattccaaaatggggattgaactgtgagaaagactacaagtaatttctgagttactgaacttagaaaaagcaaaactggccaggtgcggtggctcacgcctgtaatccagcactttgggaggccgagaaaggcggatcacgaagtcaggagatggagaccatcctggctaacatggtgaaaccctctctctactaaaaatacaaaaaaattatctgggcttggtgacatgcgcctgtagtcccagctactctagagactgaggcaggagaatcgcttgaaccctggaggcagaggttgcggtgagccaagatggcgccactgcgctccagcctgggcgacagtgagactgcgtctaaaaaaaaaaaaaagcaaaaccttgggacttctttctttcccttcttattttcacctttccttctcttccttcttctctttctacttcccttcttgtctctctatttttaccttattcatttcctctcgtgcctttccattttttatatcaggaattaaataccctctagagtgaaacgatgaataaaatctactagtcctgtgagaaggacaaaattaaatgtgttgggttgtgtttgtgattgtgctgatgacagcaaaagaagccacactgaggattgaagatgagaaaaaacaaactacaatgttcactaacgtaatttttaagggagaagatataaagattaccagagttcacactttcaaattgtttgcaatcaattgaaagtcgaaaaaagttatatgttgaacaacatatgagaaaaaagcaagtgaccatttaaggtgatatgtgttaagagcaaatcaactgatagagatagaaatgtggatgaggaagaccaccactattccctggggtagtcaaaggaaagttggcctggtactggattttggataacactgaataagattcaaacagacaaaccatggttggggcccagcttgagcaaaggatcagaagcagcagtattccagacatgtgagaatataaatttggttcaagtagaaaggtttcaaatggcagatgactgtggaaaaataatttggtgaaaacttataaaaggcccggaatgctgagatagaaccttgggttctattcagtatatattttgagaaccactgatggtcactatggagaagaaagacgtgtgctatataatagaacaagaattgagaggtcattgactgggggagtttcctagacccagagaagggtaagaagggatacattttgaaggctggtacataaagagaattaagatatcaatgagacatattttaaaagccaagagaaggagaggaaagtggtcattttcagttctgaaggtgagagttttgaggtttggatgactatgaaataacccagtgagaatacccatttatcagtgggaaatcctgaactagagtttgagagagtctgctaagctaaagttgtggatttgcacgttagcctcctgaagaggatggttgaattcataaatatggatgatactctacagaaaagaagtttgcttagaggatttggcatatccatgatgagagtataccggggaagcaaggaaacactgaagagagaaggggtggtcagaagaactgtagaagtggggcaatatgtggaatagtgagggtctcagaacagacagaggacctgggccttgaaggccagctgcgtcatctggagatgaagatggaaggaaatggggatcattgaggatgaagaagaaaaggagccctaaaggtctcttacagtcatcactttgtccgtagaaacacatctctgggaaggaatgagttaggtttttcttattctttcttcattaataaaaatagaaaaacaggtggtgaaacaaattggaaaacaatgtacacacaactaatactcttgaagaaagagatttcacactgtgtcctgctaacctgttctgatattcaatggcacttgttacccaggagttcttttttaaatcactatctgaaatccctattgctctcctgtgagctgtattttttttttttttttttttttttttttggctttcctctgtttatcctcaggggacagaaagaacatatggcaactatctctcaagtaataatccttcaattttggaaatacgtattatataagatttttcctctctagccttttattctttgagctaaataatactaagaaatttaggctttctttatggtcatttcttcccaggacaatggcacagactgagtcaaattcagttcctaggacttggataaaatttatattgaagccactgctttgaatcagcgagcagtactgatgtcaagtttgcctattaggtagaaattcaagaatgaaatgatgatgacccttttgggaacaactctgtgcatcctttgtatcctgagagcacttatcaaaactaatagatgagtaataaatctttcaaaacaaagaaaaccgatggacaaagtggtgaaaatatagcatttgtctcttattgccaatgcgtggcacataccaactcaattcatatttgcatgaatttatgaaagcaaggatgaaaaaatatgtactaagatataaaattagcaatattatttttaaaaggttgttaaaagtcaaggccttttgggccaggctgttgggctgtttcttaaggatatgatattttatttattttaacatattcagaaacacctagtggtattaaaacctctgagattggcagcatttggccttttagagaatgttgactctactttctttctctagaatttattctatcattttttatgacagtcttaataaagatgattgaaagactctgggtattaattcatcaaccagtatttgttgcaggccaactaagagtttggcactgtgttccaaggggaagttaagtaagcacaaaaatcacaaactattaaagttgataaagctgctgatttaagccaaaatagtaattctcttgacaacataagagtgaatgtttacatagcattgaccttttgccaggcactgttcaagcactttctacgtcactacatatttcttttaatttttacaacaactcattaaacaggtactattactatccttattgtacaggcgaggaagcacgtgagaattggctaaagccatatagttagtaagccatagagttaggatttaaacttgggtccaaatcctgtatgcttaaccattactgcaccagagaggtcctccaggcttcccttgagtaatctgaggaatgaggtgtgtgttatcttttttttttttttcctcaatcaattgaggttttattgagctagagcttgagggtgtgcccaagataaacaagagtcacagaaatcctctgtggcttatgttctccctgaagaggttttcaggaggctcagttttatacatttccttgggggaaaaatgtgtgtaggaagagttggggggtaggcagaagaatgattgctctcatattgtctttgttccatacctgagaaaataaggattattagtgtgaagtataataggcatatccttgttttgtgggagaatatacaccttttttaaggtattaagattatttttttctgtaagttattgggggtacaggtggcattcggttacatgagtaagttctttagttgtggtttgtgagattttggtgcacccattccccaagcagtatacactgtaccatatttgtagtcttttatccctcaccctcctacgactcttcccccaaagtccccaaagcccactgtgtcactgtaatacctttgcgtcctcatagcttagttcccacatatcagtgagaacatacgatgtttggttttccaacctgagttacgtcatttagaataatagtctccaaactcatccaggtcacttcaaatgctgtgaattcattcctttttatggctgagtagtattccatcatatatatataccacagtttctttatccactcattgattaatgggcatttgggttggttccacaatttttgcaattgtgagttgtactgctataaacatgtgtgtgcaagaatctttttcatataatgacttcttttgctccgggtagatacccagtagtggcattgctgggtcaaaatgttgttctacttttaattctttaaggaatctccacactagtatacattccctccagcagtgtagaacttccccctgttcaccgcatccatgccaacatctactgttttttgattttttgattatggccattctggtgtccattatcttttaccagaaaactcctcctgttgaaatggaatctttcttcccatacctttcctttattggtctaatttcactgcctggaggaagatggagattattttctacagagcagactctggatctgaagacagccttcaaactcctccagaaattgtttcttcaggattaatattctctccttaaattgctacatatgacatttttcatttgtttagctttgcaaaacttgcctattcaaaaaaggatattagatagttcacagagatatacacaacagacaagcaagataatatatatacctccaggttttgtggcatcaatagatttgataaacatactttgtgtcttcattagagcagtagataaatgaattagggctgtacagagtataaatccctgcggcacacccctacatatgccccatctagaatttctcaaatatccaggccacatctttctgtcctagttacaatgttaattgccaattagcatgtttatgtcaagatttcctgtgatagcatttttctctgggatctaataacccagtaaccttggacaccagcattatatagtgatatggaggtggattttggattcaaaatgtgtgctaaagctttgcaataatagacaacttaatttctgagcttcagtctccttgtctagcagagataacaacaggtaccgtgcaccttcttaaggctagttgtatggattaaatactatatacatgtaaaattattagcagatagtaggtgcttaattataattgtagacatttgtcaagaatgactcatttggccaatggagtgttggcaaatgtttacttaataattaattggctttctgagagaaaaagctctggtttggagcatttgatgatttccctggtataaacactcccaccaaagcttttgagctaccatcatggcatcatgaaaggcagagttgggtagcgatatatgcagtcaaatggctcttgggagacagtgccagccagtgccaacatccccctgtgtgtggcccatgctacactcatactcccactcacaagtaagattgcagcattaatatgtgagtaaaaagatacaaagaaaaaagatttccattacaaagagctcccgtcaggtgctgatagtgcttgaaaaagagatggttattttagttacatttataattgtgaagcttcttctgcttgctctggtatatggaagtgccagttattctttccaaatgtgcttggttttgtctttctttacctctttctccctcaccctccctcttccaacaaatgcctcatatggtaacagttaccaagcaaagtaagggattttatgaaaaattccaaggtttgagtaaaaaaatgaacaccaaaatacccattttattagtataggtagcatccagttaagagttgggtataaaaagaaacatttgcctacccaaagaaagcagcatcagaatcttggcataagaaaaatagcattgtttagtatttgggtgtttacatattccttgtgagggtgaatgtctgaatatgctcattttcatattttaagtcatcatcaattaaacatttgtgggtgtatttcttgtgggctgactccagtggctgtcagtgaaaccaagcagctgttgggtagatatggaacaaaaacaccctgaatgttacactcctgattgcttcccctggcacaggtagaggtacttatgcacagggaaggaaatgaagggcatgcatccaggttcctttctagctgtctccttagaaatcactgctttttggacagtactgaaagtatgacacagctgagacttggtgtatgtacacacacagtatcatatttgattgtgttggttgcttccttctggcaatcctttggcaggtggtatcacattcttccctctaaagagcattaccaactgagatttccctttgtgcttagtaaatatttaggcattgtagattgtgtcagcaatgattccttttatgtttcaaaggctggaaaatttttcttccttgacacttcactgttgttgatttggggaagaggtatgagccaaatggacattggacaaggaattaaaatttataattgccgcgaatagtaacttttccttagctgctgcttcgtacttgaaaatggaatgccctgtagcttgggaaccgaattttatggtggctctgcttttgtgatatttcattcaatccatttaacagttagttgtatttttcaattctaattaacattggtgtttttaatatatatcttaaaactataatttttgagctaagaagccttacaacagatacaccagcaaagatgactagaggtctacaagagtgcatcataagtagagcaatttagatggacttccttctgaactgctgcctaaaaagtttgttactcaatcttatcaccatagttcagcacaaagttaatgaaaatagggctgtataattttgttgtaaaacatcaagtacctgataattatcatcaccatccatctttatccaccatcatcaatcaccattattgtatttttattgcttggattaattcagtcctaatagagcataatggtatggaaattatttaattacattataagtacacactctatcaagtcagaaatcatttagtcctatgacagaaatccagcaacaccacctcctggtaggattagctatatatgcctttaagatatataacttaagcatgcagagggatatatagattgactgacagctgacttttcttctatttctccatgttgctacacttaattttgcctctatttcaaggaacttcaaacacagtgtttaaaagaatcatttaggctctccctgaatatacaaattttggtacctcatcattgtagttctctgataaggctcttggaatccctatttttgacaagcatgccagatgcttctaataacttgtctggaagaacatgcatggaggaacacaccattctgccctcataaaagtcattcatttttctgtctgtttttgttatatcactgcccaaatggaatgtgactatcaatacataataatttcagttactaatatataaattattagcattaatttgcatcaagttatactcatcattggtaattaataatgatgatgaatgatagcagatgtatatatggtgcctactatgccagacattcttaaaggatttgcacgtattaatccttacaagggccttcggaggcaggtaatattatatccccattctctagaggagaaaactcagctgaaggaggctggtcactgaatcacagaaggaagagagcaggctgtagaatcagatggcatgggctctatgtctgcctgtgccacttactggctgtgtgtcagtgacaagggtccatcatctcttcttgactataaagaaaaactggggatacagctgctgttaactccagagacaggtggtgagaattccatgagctgaagtatacaagtatttaaaggctagcctgaagagtaggcatgctctagaaatgttaactgttatcaccttttcttgtgacaaccctgcctttccaataccttttctaatgagttattgtcaataacatcccagtgctgctttctgaactgtgactatctttagctagtaaggagtgtttggtgtctcttttttagaatttttcttttctttttgaacattgaagagcgttcaatttttaattaatcttaataggcacacataccaatattaggcataattaataaccttattatctcattagaaaggcagaacacaatgcacataaccaggaaactaacgtacaagtcttagtgttcattactgctatgatattcattcacatgtttagtagaaaagaaaaaaaacaaaaacattgagccccttttcctaccggatcaagttacagatgttagcctgttcacaaactttcccacatccaggggcgatgtcccccagcacaccatccctccccagctgcttcctggccctcttgcctctgaggcatgctcacaaaaacctgtgagttttgaaagtattttcacctgccagcatcaatgagaaatcttctgcaagtcccctccccatgttcatttctgtcagttccttgggttacggttctcagtacataagtgtcattagcttcacctgggattttttaataaacgcaaattcctgaatactaaattcggattcagtaggtctgcaatggatctcaggaatctgagaacccccaccccgccccaagcgaacatgacacttctcttcgaaaaacactagcttcaattgtagagaaaaccaaaagtgcacatgaatggaaatctgggacatagtaagacaaaagagactgaagtaggaatagcaagcatttcaaaggaaaatgaggctgtcccttctgaggatttcatattaacaactggtgcaaggaaagggaatttgcagcagagttcagaataggggcagtgaggaagtggagttgaatctgagaacatgaataaggaaaccactctgaagatgagcatgtggcataagggaaattgccaccggaatgtaccctctctacttccctaactcctctctttacttctttggcccgttctttctgccacaacctaccactaaagatcctgctttgaatgaaccaaggtcccaggggattgttgcataggcataagggttgttcttggaagcctctgggtttgttgatacagaggatccctatggctccttgatgataattcagttgtgaaggtatagtattgagaaactggtctaaagtttttatggtatatatattttaaattttatttaataaatatataaaaagcactgttctatgtgttttaaaaatactaacacattgaatcttcttaagtactttgtggagtaggtaacgttattattccaatattacagatgaggaaactaagaagttaagtaacttgcccagagggtataaagaggaagggacaaggtgattgttccatactttaaaggaaccagattatcatatttgtagaaagaaagactacattttgagtctatcccaaagagtgttatttgaagtaattagactgtgtagctctgaaagaattggaacccgcaattcaaaacaatttaaactgttctggagacaaagctaactctctggtggggtttctttcttctgatgataaatttgggggtcacttaatccaggacagttcctgcatttatggaaaatgagcatatcgaggtaggattaaagaagtgaattcattcattaggctctatgccatcatggttcatttttttctaaagctgagccaagaacatctgtaccccaattttttattttcttggccaaaaggggacaaataacatctcacactaagaacattaaaatatttaccaaaggtcttcttttagcaaagaatatttcttcattgcaatgcctctgaacatcttcctgaatcaattaatattcatctaaacttttattttctatgactaagtaacagtaatattcataatagcaactgacattcagtgagctcttattctgtggtcactgtttcaggtgttttacctatattctattgtatgaaatagcacaacttactctgattaactcaattttattggatataacagttatttttcaatttctattatgacaaaaaatgttttattaatcatatctatagctaaactatgtaaaaatgtttgtaattatatccttagaatcaattttcagaagcagaattgccagtgtaagagtatactttaagaaaaaaattcagcacattttaccagttttcctgccaagaatgttataccaatctatattcccaccaacaatgtagcaagacttttgtgaaaagtttttttgtttttttgttttgagatggagtcttgctctgtcacccaggctggagtgcagtggtgtgatcttgcctcactgcaacctccacctcttgggttcaaacgattctcctgcctcagcctcccgagtagctgggactataggcacgtgccaccacacctggctaattttttgtgtttttagtagagatggggtttcaccatgttagccaggatggtctggatctcctgacctcgtgatctacctgactctgcctcccaaagtgctgggattataggcgtgagccactgcgcccggtgtgaaaagtttttaaagtaatgaattgctagttagcaacctctgagttttttaaggtgttgtctagcagtctttattaaaaaaaaaaaacagaggtccaatcacctatttccttagaagagggaatcaagggtatatttcagtctgtctataatgcactgctatgtaattactagggaaacttctccaaaagtcacaatgggtaaagtgttataaattctgagtcataagtaaagtttctactatgtgagagactctcattccctgttgtcactgagatcattaaggtctcagttcacatgttacctttgagagaagtttttcctattatcttatctaaaatagtcttcccaaggtctattccattactctgtcttgttttcatagcacttactaattatctttgtttattactttattgcttgtctccccattataacgtatgcttctgggagtcaggagctctttcttataccagcgattttatcacaagacctaaaagagtgcttggcacatgaaagatgtctatatatgatgaatcagtgaatgagtgatgaatgaataaatattggtcctcttaaatcccaaagtcctctgtttactatttatgcacagctattagtctgtagtacaacactgttaagagacaaaatatgcatatggggcaaagcaatatttgtaactctaaggtactcaaccttgtagatgaagataagtgaggaagaaccagttattagagtatcaatggcattggtcatttggttataagcgtaagtgaatttccccttgaatttaccctgtgagttgctatttaatggtgttggacagttacagataagtttggtagaacttttctctttgtttccttaagggttttgcctttgggtaaccaccttaatttcttcagtccctgtcttccatggataaagtcttagcagagctattaaagatcctaatgtcaacttctcttaagattatattgtccattaatgggtgttctgagagatgttattttgagatcaagtgctaaagatttacaatacacactttaactgggagaatatgcttgtttcactaggacagatatgtttctctatggtatccccagcacttacagtaactggcacgtaggaagcattaagaaaatgttgaataaatgaacaagataatcaaattctgtcttgtgaagaaacccatttgggatctattatatgttctgggtaattcctctgagcatcagcgaggatctgtgcaactaacactctggtttatatctaatttgaactgctgattgtgggcagtagaaattatttcagtagaaacttagctggcttgaatttatgagatattattagtctcattaagaaaaatgtctaccgacttctttaggaagctcatgtcttcagaaagtttctttgagatttcatatagaattccttggttttaataaacgttcctgacttctgcatatttgctattgatgcaacaatgatgcttggatcaaagttactttgtcactttctaattcatttattttagattactcagctagtagaaaacaatagagtcactttgttgctgtaaagtctcttcgtagtatttggtgggattgtgctattcttcagtgggctggtaatccctataaagcttagagaaacacagggctctttaaacgatcctttttctcttttctgttttaaatttcatcacttggttatttttgccacctgcttggattgcctccttacccaaatctaaaattcctacagtaaaataaatagaaaatgtggtcgctactctccttcaaaataatattttcatttctttggacaagtatgttaatttcttcatatgcagttgtcaatggtccaggtttcggaaccaaatagcctaaatttgtgtctggaccccactacctgctattattgactttgggcaaactagttaacctttctgtgcctcagttttctcatctttaaaatggggctattaagagtacttctctgtattgtcattgtgaattatgaatcaatacataaaatgagtttagaagaatgactggcacttcacaagtgctcaatgttaaattgtttttattgggaagaaatgaaaatacttccttgcttaatgttggagaaaagaatcactaacccatcgcatctctaagatgatgatgataattgcagttgccatttattacatccctactgtgtactaggcactgaattcaatgctttgtccaccttatgtaagtgaaatctcacagcacagtgaagtattattattattccatgttaccaatgaggaaacaggagaccctaaaaactgagttctttctctaaggttaaacagctcataagggatggagttcagatgtgaatccagttctatctgattttaaatcctgttctcttaattgttatgtcatgtcatctctacagtcttcaataattgagacttaatgttctttgattactaacatccagtggctattccaagggaattcaaaacccttgtcttcatgactttcaaaagcaacccaagtcctgaaaacaacatttttgtgaagtatattagtgtaatccaaaacatgataaacactttttaaagatatttgcagataagactcccctaccctcactgttacagtaacagtgtaattttccctggtattgctctgaacattaaggaattaaaacacttgaggctggacttgtcaagagacctatttttgttttgttatgttgtaatagctgttgtttctgatatttttctttttccttcattctgctttttctttctccaatcttggcttaaagggcaacttcctgtgcatgttcaggaatctgtggcaaagggaacaagtatgataatttgtctgctaccatttggatgttactattgtctcagcagccaggaaaacagacagagcccctgtgagcatcattgtgtttgggctgcggctttagttgccaaagtgcagtttttactgttggcatttccaccacctgctatgggcaataaccatcgaaaggacaaatccccttgtctgtgatttttctttctaggcttctttggagaaagactgtgaaatgatttattcctctgtacatatgaagctatagtgtattctccactgcatagttttggcctctgatactctctgttcttaggttaatccattaacttgcctgggggaaaagggacaggaaagatggatgaaggtgttatgaaaacagagatgagaaggatcttaaaaaatcccaaccactgccttttcttccctgttcccatctgctcctgagaagtccttcagaggatgccaggcctgttaatacctatactttatacctgttgttttaaatgaggcagttcttcctcactatatggatataataaacagttaagctgtcttcctctatgcccctcaaaaggagacaaacacacaagccctacacaaatggtatcgtgcccaaatgagtgttggaaatgctggataaaacaaaggtaagtaggtcttttcattgcaggccttctcagagccttaaaaaaaaatcctcactcatattttgaatctctaggagagacatatagtatacaacattctccaaatttgtttgaccttggaatgcttttttttttttagaagcaacttgagggacaaaagttctgtagaacacgctttggagagtattgggatagattactttcattgcatttttgcaatttggtttataaacttaccttggagattgggcaaattggctggttagtttagatacaatatatttttttcgggttgcaattgtatttttacagtagctagcagaagctgtggttctgaaaagatactataagaacattatcttgtgttctagaaaatagaaaatactctattttcttccccacctccatttttcccctgtctttagaaaaattaaagtatacttaagaagaggaaacaaagtgagtggtaaaggtgtatgcctctatagatggacaggtgtgttagttacattatatccaagtaatgtgtaagtgggccttattaatgagatcctaagaaactataaaaaatgaacataccccagatttctctttgtgtacactttgaaagtgtttttccatttctattaaaaagtttaatttgtcatgctcatgaaatcaacataaatttatggaggcagaacataatacagtaaaaagacaatgtgatccttttcatgtggcatttttaatacattgtatcacaaattacttcaaagaaacaattaaaagaacaaggaagaacttaggaggttcttaaaatagtatgtagcacattttagaactcaagtgacagagctttcctgatgggcccaagtcctgtctcctctcaccctttttttttgggggggggtggcgggaacaaaacaataaacacctttattacatgggtgaagacaaaacgaggatttatttgcctttccgggccttgatcttcctaagatagaactccaactctttgccctctagcacatagccatctgctcggccacatccacacagttctctcactctttcaaaatgtcagcaccagttccagaaggagggactggcccttgtgatggccataatgtaaagtgttcacacgaccaggtagcatttccattcttagaaagctacgcttcttagaaagctacgctacttgattctaagagatcagtcatacagacgtgtttttattcctttcagaggcaattcatttcatgaaaaaatgctgaaatgaaaacactttatagttaagcttggtgtagtcataaccacacatagctgtgttctgtcataatttgtaaattgagctctgtcataatatctatttttcaggaggctctcagttaaattttcttaaaaagtctttctgattatgaaagtaatgcatgcattgccctgtggcatattacatattactctctcatagaatatatagagagaaggtggcagtgaggacaattctgtggtcacctggaaggttttcctctggcacaggaaagacagctgtcctatttctagttgataaagtgcctagactgtgcattagaggccaaacattgaaggaagtcaaattgcctttttgttgattctaaagtggtctttgtatcagaaagtagaatctgaagaaatatgctgcaagccaggatgattatagttaacagtaatgtattatgtagtttcaaatagctagaaggaggatgttgaatgttcccaacacaaagaaatgataaatatttgagatgatagataggccaattactctgatctggtcactctatattatatgtatcagaacatcactatgtgcctgatagattatgtataatcatttgtcaattaaaacaaattagaaaacaacttacttgtctttttgctaaatctggatgtggatccagctgaatataatttcttcctagttctatgaataggatataggtcttggtttccatggtgttgtgtgacttatacttttgcttatctttgtcagtacttttgtgggaagaagataggggctctatcagaggttgttagcttggtgatgttttcacccacaaattcttcatttgttcttagaagttttctcatttctttgaactttccattaacattcaatctttcacttatatgaaaaatattttccttcctcctctttttcctcttccgtactttctccaaattcaggaggcagataatggtaattgaaagttctagggacacactgtgagctcaaggtccagaaaggttagggaaagtctttattttgaactgtaggtatgttttaattccttctggagactagcactcctcagggatgctgagactggcactggtgctaccggatattaaacagaatggatttaaagtattctcctgtattaagaagattattttcaaaagaaagctctattttgtagttattgtcactttcctaaagatataactttcctggagctgtggatcgccacaatattgatggcccatcccagcactatttaaaggcagggctttgtcatattttttataatatttgcagcttggtcaaataatatttattaaatgattaaataaattcaacagcacttagaaacaatagaggcagaaaatgaagttgtggagttggggtgtgtgtgtgtatatatatatagaattagtacattttcacactgctgatacaactgagactgggcaatttgcaaaagaaagaagtttaatgtactcacaatttcatgtggctggggaagcctcacaatcatgatggagggtgaaaagcacgtctcacatggcagcagacaagagaatgagagccaagcaaaagtggtctcctcttataaaaccatcagatctcatgagacttattcactaccatgagaacagtatgggggaaactgcccccattattcagttatctcccactgagtccctcccgcaacatgagggaattatgggaactacaattcgagatgagatttgggtggggacatagacaaaccatatcatacatatacataggtcagattggtaaaagttatagaagcaaatgttagaaaactattttgtaaagttggaaagtagaaacaataaaaaaacacaattcaaagagataagcattttcactggtgtttttttctggtgtgattcttccagagattattctggttatccattgctgtgtcacagaccactccaaatttagtggattaaaaatgataaatattttatgatgtcatagattctgtgggccagaaatttggacagggcacagtgaagatggtgagaacagtttgtctctgttccctgatgtctttgatctcaactgggaagaactgaggagctagaagtgactggcatggctgagacctagaattacctggaggcttctttattcacgtgtctgtgtctgagcctggaatgggatgatttgaaggctgaagttagctgagatggtgtggcttttccatgtggctcaggcttttcatgcatggtggctgcgcttctgagagagaagtcctgagaggaagtatctggaaagggagccttccaagagaaccaggtggaagctgcattgccttttctgacctatcctctggaggcacacagttacatttccaccacatttcattggttacatgtgaatcagaccaaacagattcaaggggagaaagaatgagcctcacttctttgcgcaggagagtcaaggtcacattgcaaaagagcgtgttggatggaagatgttacatctgattttgaaaaatatacttctctacaatattgtttggtcatcttataaaagtaaaaaatagtgtacctttataatatttcattgagaagtgtattaggcactttatcttgctaatgtaagatggttcactttaaagtgctctgtgtttgaaacattgtctttcttcacctttctaaagaacgctctaagatgatatatggcaaccaatcaatattacttttttcatttgtgtagcttatttaactacaactatttaataaatattatagggacattgtgttattccattttgtgaccctataaaggaacacctgaggctcgataatttataaagaaaagaggtttaggccaggcacagtggctcacgcctgtaatcccagcactttgggaggctgaggtgggtggatcacaaggtcagcagatcaaggccagcctggctaacatggtgaaaccctgtctctactaaaagtacaaaaaaattagccaggcgtggtggcacatgcctgtagtcccagctacccgggaggctgaggctggaggatcgcttgaaaccaggaggcagaggttgcagtgagctgagatcacaccactgcattccagtctgggtgacagagcaagactctgtctcaaaaaaaagaaagaaagaaagaaagaaagaaaagaggtttaatagccaaagttctataggctgtataggaagcatagtgttagcatctgcttagcttctggtgaggtctcagggaggttttactcatggtggaaggcgaagcaggaacagcacatcacatgacgagagcaggagcaagaggagtagtggggtgccacactctcaaacaaccagatctcatgaatttgcagagagaactcactcattactaagagcagggcaccaagccattcatgagggatccatccccatgacccggacacctcccaccaggccccatctccaacataatggattacatttcaacatgagatttgaagggaacaaaacatccaaaccatatcaaatatcatagaagaaaaaataaacatatgggaacatataagtgagaaaataagtttgtgaattatcaaaaagtggaaatagtaatatctaggcaggttagcatacataagtgatgttctagtggttctcaatctttgtggcagaatataatcatctacagaattcaaatcaaaacaaaacaaaaaaaactctggtaccctgctccctcccccagaaacactgatttaactggtctaaggtatagaccaggcatcaatatttaaaagttccctaggtgattgtaatgtgcagccaatcttgagaaccattgctttaaacagtttgtaaaatgtacgaaacagggaaagatgtttaattacaatgtttagttacatgactgaaattttatcaataagatctaaattctaatctaaacagaaattcatttgcctcttcattcttcaacagattagttcccagaggacactgttggattcatatctgacacgtaaataaagcccacacaccaatatccaaagcagaaagctgaaagggacctgtttccttgataatatcattgaaccattgaaatattgaccccataattgttccaattttgacttctaagaatgtagaatatttgtattttgtttcaactagatgttggaaaattctatagtttgcacccgaaagcgtttgaaacattcctttgtataaacacattttcttgattgtgtggtcaatctgctggacagatccactatgaattcagacagatctgggtttgaatcctggctctgctaccgtttaatgactttaacaatcttatttcatcatgcctccaaaaactgggagaaaatagaatacctgtttcagaaaatgattataggaattaaaagcatccattcttttattcaggaaacctttgagcacatgagtattccaagattgtattctgtacttggagtatataggaatgaacaagacagccacacttagcagaatgggagagggaggcaataagaaagttaaagaagagatgacaatgtcggtttctgatagaagctgggataaaaaaaggaggtagcaaaaaagtgtgaataggacaagtctgagactcaaatgataaaaggtagctctgcaaggaccagacaagcacatctaagtcagagaattgttaatacaaaagagtcttatggcaaaaataagattggtttatttgagaacaacaacaaaaaaggtcagagagcctggatctaatcagtaatgcagtggagagtgagaaaagtaagattggacgggtaaacagacgactgattaggtaagccaggaagaggagttgggatttattataaatctcatgatcagcatttataaaactttaagcaaggtgctaaattatctaattttatatataaaggggtaagagtgaagggggaaacctggttagcaaggtcttgtaatagtcccagtgagatatgatggtgccttgttttagggtggtgctggtggaagtgaaaaaatatatgtttaattttgctgtgaacccaaaactgctctaaaaaataaggtctattttttaaaagtatataaatgttagtaaaacacatagatttacatggtgggcactcagtttattagagatagggtctcactctgtgccccacgctggaatgcagttggcatgatcatagctcactgtaatctcgaactcctgcactcaaacaatcctcctgcctcagcctcctgaggagctaagactataggcatcaaatgcccagctaattttatttattatttatttatttttttgtagagacagggtcttgctatgttgcccaggctggtctcaactcctggcctcaagcagcccttcttccttggcctcccaaagtgttgggattacaggtgtcaaccaccatgcctggccagtaaatgctattttattcataatgttatcattaccattagtacaatgtggaagcaagatctggctctgtcattagcattgctttggtggaaagatttactaaataaagcagagagacttttccaaattgtatttattatctttaaaggctttcccctgaaggtacactgggatactaagaagacctgaatagcttaagatctctacaaaaggattccacataccggtttgggacttctaagggaaaatgcaaagattcacaacttttaatagacagtgatttttgtttctatatctgacggtcatataattatattttagcatcccaacacagttttgccataatggtgtgactctatgattgtgttgtattatgtaccacttcaacccaaattagtttaatgatgctatagaggcagagttgttttcccatcaaaatgggaacaagtatgcaaaagcaagataaacactatctttcagagtgatacattcaagcagcattggttttaagattaagcaaattcccactgccttgctttattagtatacttatgagaagctactttataggtcatataactgaagtgagtttataattatggcaatgggtctacattggaatgtagtttatagttactagctcaaatatctctgcctttcacgttatgttggaaaactgcatgctatctttatttcttagtttcacatctgtaaactgagattaagatctgcttttctgtttaaagactattgcctacatcagagaaatcatccttcagcacttgaaagactttgaaaacagaggcttcctaggcagataatattttgtttactatggttggttttcttttttccttttgaatagactttattttgtagagaagttttaggttcatagtaaaattgagcagaaagtatagagttctcataaacctcttcctatgccatcacacatgatagcttcccccatcaggagcattccatgcctgagtggtacatttcttacaattgatgaaacagtattgacacgtcatcacccaaagtacatagtttacactaggattcactcttggtgttgtacattatcttcatgtgtcaccatcataatatcctacagaatagtttcattgccctaaaagttctctgtgctgtgcttcctcattccctcctaaccactgtcaagtaatctttttactgtccccatagttttgcattttctagaatgtcatatagttagaatcatatggtatgtagcttttcagattggcttcttttacttagtaacatgcatttaagtgtcttccatatctttttttaatatatacatatatattttttattatactttaagttctgggatacatgtgcagaacgtgcaggtttgttacataggtatacacgtgccatggtggtttgctgcacccatcaacccgtcacctacattaggtatttctcctaatgctatccctcccctagcccccattccccaacaggccccggtgtgtgatgttcccctccctgtgtccatgtgttttcattgttcacctcccacttacaagtgagaacatgcagtgtttggttttctgttcctgtattagtttgctgagaatgatggtttccagcttcatccatgtccctgcaaaggacatgaactcatccttttttatggctgcattgtattccatggtgtatatgtgccacattttctttatctagtctatcattgatgggcatttaggttggctccaagtctttgctattgtgaacagtgctgcaataaacatacatgtgcatgtatctttatagtagaatcatttattatcctttgtgtatatatccagtaatgggattgctgggtcaaatggtatttctggttctagatccttgagtaattgctacactgttttcaacaatggttgaacaaatttacactccccccaacagtgtaaaagcgttcctatttcttcacatcctccccagcatctgttgtttcctgactttttaattatcgctattctaactggcgtgagatggtatctcgttgtggttttgatttgcatttctctaatgaccagtgatgatgagcattttttcatgtttgttggccacataaatgtcttcttttgagaagtgtctgctcatatccttcacctactttgtgatggggttgtttgtttttttcttgtaaaatttttaatgttctttgtagattccggatattagccctttatcagatggatagattgcaaaaattttctcccattctgtagattgcctgttcactctcatgatagtttcttttcctgtgcagaagctctttagtttaattagatcccatttgtcaattttggcttttgttgccattgcttttgatgttttagtcatgaagtctttgcccatgcctatgtcctgaatggtattgcctaagttttcttctagagtttttatggttttaggtcttacgtttaagtctttaatctatcttgagttaatttttgtataaggtgtaaggaaggggtccagtttcagttttctgcgtatggctagccagttttcccaacaccatttgttaaatagggaaatcctttccccattgcttgtttttgtcaggtttgtcaaagatcagatggttttagatgtgtagtgttatttctgaggcctgtgttctgttccattggtctatatatctgttttggtaccagtaccatgctgttttggttactgtagccttgtagtatagtttgaagtcaggtagtgtgatgcccccagctttgttctttttgcttgggattgtcttggctatacgggctcttttttggttccatatgaaatatgaagtagttttttctaattctgtgaagaaattcaatggtagcttgatggggatagcattgaatctataaattactttttatggttcaatagctcatttctcctgactgctgaataatgttcccttgtctggatgtaccacagtttatttattcattcacctgctgaaggacaccttagttggttttaagtttgggcaattatgaataaagctgctatgaacactcatgtgtagatttttgtgtgaatataagtttttagctcctttgggtatataccaaggagcacaactgctggattgtatggtaagtgtatgtttagttttgtaagaaggtgccaaactgtctttcagtgtggctgtaccattttgcattcccacaatctatagatgagactttctgttactcgacatctttaccagcatttaatattgtcagtgttttaaatatggaccatactaattgatgtataatggcatctcattgttgttttaatttgcatttccccagtgacaaatgatacagagaatcttcatatataattattgccatctgtattactttttgggtgaggtgtgtgttcagatctttggccatttttcatctgctgttttcttattgttgaatttcaagagtttttaacatattttggataacagtcctttatcattatgtctttttcaaatatttttcccattatggcttatcttttcattctcttgacagttacatcatgcttttaattgtagaattagacaacaatgaaataaccaaagccttagtaatcttaattagagattatcttctattattttctatttttcttgtttcacctgagttagaaaactgacctgcactgacttcctctttcacaataattccagtgaaatgaaagtgattagaaagtcttagcaaattcaccaaaagttagagccagaagactcacatttcaattctctacctaaagagaaggacaggcagaagccaaatatgtaaagagtttgtcagaagtatgccttggagccatgggcattgttcattactctgctgaatttatcttatggattttcccctccacattaatgtttcaatgatcttggttagattgttgaagtacaggttcctgctaggcatttctaactttttgttttaatattctcttatcctgttcatttactctcatttttccttttagaaatttactgccatcttctcttttagaaattcttttgacaatctgaaggaatgcagttatttatccctatgagcaattaaatacttttaatgggaatgtcatgtttttaaatcacatttcttataagaaaaaaatggtgtttactcaaatgaatgtggtctgatggtgatcctgatctatgagcagtaattgagatcatggaaataaatacaggaaagctggctccctgctcccttcaataaccaaatctatggtttagacattttttagcactttgctccaacctgttacagattatcaacattatatatgatgataataaatcagagcaccactttaaaacacaaaagtggttgcctctcagtgctatggcaaacatagaattttgaactttttgtatgactggtatttttttaagcgactatattttaataacgagctattgcatgtgactttactatgatgctcaaatatgttctatgtatgacggggaggaggaatgatgttaccatatgttggttctgaattcctattttattttattctcaggtggaaaaaagaaagaaaaaaggattcatcagcaatagggcaacttagagcggacacataggtactatggcagtgataagagatgagatagatcatcactatgcccttttcaattcttgggaactgtcttcgttaaacagttttagatgcaagggtaatttttttcctatggtgattgtagaaagaacacccagagattgggactagaagtcaggatgtctttagccttacttggttgtcagctaactgtgctgttttggacaatgcattcttttttggtattctgtttatcccactacaaaatagagatagtgagaattggattaccattgtcaatatgaagcacagatgaggtaagtgtgaatcacttgaggatatataaagtcatttaaaactttaataattataatacgataatatagttgttgatttagtttagtttcttacatatgatattctacatattcttatcacttcacagggaagcattgactggccaaagtaatggtgggtagagggaatcacttaccttagcttaaagagatgccaaaatctaggacctattcagagttatgaattatattttgttgagcagtgttcctccaaaattcatgtccttcctggaacctcagaatgtgaccttatttggaggtcacactggagatgagtgggctcttactccaatctgacttgtatccttataataaaaagggaagagacacagagacagatgcacacacagaggagaacattgtgtgcagacacagacacatgaggaagatggccagtaatgatgaaggcagaaattggaattactccgtaggaaggcaaggatcaccaaggattgctgccaactaccaacagctagaagactatggccatgctcacatcttgatttcagactgtgacccccaaaacagaaatggtgagaaaattaatctattaagtcacccagtttgtggttctttgttacagccgccctaggaaactaatacaggagtcaaggaggctgctgaacccagctggacactgaggggcatccacagaggtcaccaaagtggagtggccagaactagattttggaagccagatatggaggcaggaatccaagaagcagggagcctaatgaggaatagtcataaaaagagctcttggcagccgcctgttccagatgttggtgttgctgccagtttctatctgctcagtacccaaggcactttaatggactgagataggttggacaggttctgtttgaaaaaatcccttacatgcaaagtaagataaaaccaaaagccaaagtatcttgctttaccttgaagaaggaagcaactctccctgatcacagagcttccctacttggccataggatagcctcatgtgcacttagctcaatgttactctgagtttctttctactccgtctttctcgatataatcctaaaagttagggattcccaggaattatcatggaacaactggcttatgtcttagtttcctatcactgctgtaataaatcacggcaacctttgcaatttaaaacaacgtaaaacctattatcttagacttttgcaggtgagaagtccattatgggttgcactagtctaaaactagtgcaacactttttaccccctgaaagacatcaacactttttaccccctgaatctaaaataaaagttgaaattatttttagaaataaaaataaattaaaatgtttcgtaaaccactttggtttcctttctggtgtctctgaggcaaatgttttctgctcatttgagttgttggcagaatttaatttcttgtggttgaaggatggagatctggggtttttttgctggctgaaaactgagggccattggcagcttctagaggctactgtattcctagcccatggtgcctttcttccgtcttcaaagcctgcattcttctgcttctttgtccttttttaaagactcatgtgattagatcaggcccacccagataatccaggattatctccctttcttcaggttggctgctgaacaacctcaattccacctgcaacctaattcccttttaccatgtagcctaacatattcacagctctggggattaggatgtggacgtctttcaggagccatgatccttccttccacacattaactgcagctaagcaacatgactccccatcacgacagagtagaaggagaaactgaactgtgagaggggaaacagctttatcaaaacatagcaaatgtcaattataagcaaaaagagaaagtcaagctgcctataatatgtgcaatatatttattcttttataaacttgctgatatggaaattaaaaattaaatctacttaatggaaaatatttgatataagaacatcagacatatctttgataggcaataaattactttatagaatcgtttagcatcttatcttcagggctattttttggccctaactttgagcacattaattttgagttcctcttgtttctcttctatttgttccctcaaacccaatgtatcagaagttattttaacttaagttttccttgcctaattccatccacttatccccagaattgtttcatctcatgtatttattacactgttcacatatcaccttctattttcatgccccttgtaaacagcctaagaggcacattactggtaaagcctcagggtaaacaggcattgcctcccattttgatttcagctccatttaatgactttttatacccaatgtggacacatactcatttttagttttccaatgcagatttcagctatattttggctttattcctcttttttcatcctttttttctttttttttttttttttttgagacagagtcttgctcttttgctcagtctggagtgcagtgacatgatctcggctcactgcaacctccaactcccaggttcaagcaattctcctttctcaagtaatcctcctgaatagctaggattacaggcatgcaccaccacacccagctaatttttgtatttttagtagaaacgggtttcaccatattggtcaggctgctcttgaactcctgacctcgtgatccgccagcctaggcctcccaaagtcctggaattacaggcgtgagccaccgcgcctggcctacatccattttaaaatgaaaaaatatatatatatgtaatttatttgaagaaagtctattcatttacgtaacacttatcattgagcacttcgtaggtacctggcgttgttctagacactggaaacagaccactgattctgatgctcaagggccctgttggtggcattgcctttggtgcatccttttctttcacctcttatactttcgtgttaatacttccctacatggattgttttcttactttgtcatgtgtacactttccctacatggtgttttcttaccttgtcatgtgtacactttttttaccctttgcattatgaaatttttgtatcctgaatctcgtttggctatgactcaactttttaagctaactctatttggaaagagtctgattaaagaaaatgtcaccaaacggttaaatatgttatttctgtgcatgtttgttatttgtcaaggggtttcattttaacccaaatgaataactttttattggtggattgtacccatcctcgttagatcaccaaaggcagtatgtattctgatagggccactttgttgtgcctctctgctttcttttctctctctttttcttttctttctttttctctctctctcctttctctccttccttccttccttccttccttccttccttccttccttccttccctcctcccttcctcccttcctccctcccttcctcccttcctcccttcctccctcccttcctccctcccttcctctctttcttctcttgcctctttacctaatgtctcaaatggtaagtcaggccctgacctcacatgtgacagttaaaaagatgccagtgacatctttccccaaagcaatagaaaggatatttttcaactaacgatttaaataggtcaaagcaaacaggatactcacattaaaggaagaagaaactgcatgttatagaaagacctatgcattcagatacctttgcctgccctgaaattccatttttcaaattcatttgcctgttagctgaggacctttttaatggaactgatgttagtgatctcctagacctctgacagttcttgagagatagcaaaagctttccctgaagtgctagccatgtagcttatccctttaggcactctattgtagaagtctccctgataaagcttcctgtactcaaattcttaggggcagggaggagggataaacaattggaatacttttttgggatattaataattggttatttcaaaatctaaaaaaaaattaaaaataatcatttgaggaactctgttaaattttttaaaaagtgcattaggtttagatgtgatgaagcaacaaatgcaacagatgttgcaatgccaatcagatacttgactaagacaaaagtttaatgccaaactgcttcaccagaaatagcttcctacctgacagaggacactgaattgtgtcaaagtattagaggaggcaattggtaggtaaagataattaaagggacatccaacatgttttgagttctttctccgtatatatggagagagagaaaagggtatatttgtgccttggattcattagtaaaatgcattagctatagctgactgatttgcaactggtgcctgcctgaggtctccaaagagaggagatttacatttaggttttaagcttgggaaactttgaaagttcttataaaaaattagacagtcatttagaaatgtaaatatactgtatttctttctggattacacatttgctgaaattcaccttttagtttttttagaagggagcggtattggcatacgtgttacacttttttgcacatcacttttgaaatgaggttccagatggagtctcagccccagagtgtaacaaagagatcattggttacaacctccttcttacagactaacacactaaaacccagagaggttaaggaagagatttaaaatcacacaaatatttagcagcctggccatccatgactaggacccaagttaatcaaatttccatcatagtctttttttccttcccttcatcagcattatacttgcttgagtaaacatcttaaatatagaatgtttctccttttcattaagaggtcatctaaaatagtatgttctctattctccattaaacatagtttataagatttctttgcctttaaaatcagtttaattagggtaaaatttaatacataattgatcatacatctccaagttgaaacatctattctgtttttaggcttagtttagtcatttcccatttgtttgatttaaagtagggttgaaggggcacacagccccgggaaacttcagtgtaaagtgccatccaactctagccagattcttttatctaatcaccacactccctgaagtctctgataattatcaataaattgggtggtagataaatagcagtgtcatgagagaaggaaaaagctgaaggcacactagcagtgactctttctacctgtcagcaggatggaggagtaaagacagatctgtcctgtttgtcaggagcagaaagtatgctggcgaaaacgaactcctgggaagggaaggtgtcaggaagatgaattaccccaggaagccaggactgctctcccagtggagagcagctcacttggatataatttgccagctgtccgtcttgtcctcgtgcgtctctgtctttttcctcctttgcgctgccagcaacaagcctgtgctgtgtagatctagtgcagccacagaaccttgggactagctgaagggccgctagacctaatggcaggggtaactatttttgcaattgtgaatattcagcatgcacaggcttcctatcagctctcccaggagctctctgagagatggaccctgtgaggaaacatctttaaatgaacaccttagtagagaatgatcctgttaggtgaataaaaggctgattacatacccagaggtgagccataatgaggctcagagtaactaaatgcagcaatctgctgcactttgtatctggacttgagcctgagcatttcaaagtagcatctggaaaagaaaaaggctctggggaaaatcacacagtagacttgaaatatttcatttttttttctccaaagggaacttagggtagatttcttgggtaacggttttgaagaaagaaggcctggtgtgagaggaacatgttgtgttggcatcaccacctcacataaccaaactaacactctcctatcattgttgggtgctgagagagctggtggtccctgcctgtgtctttaaagtgacaagggttgcctagcctgaagattctagcacaacatcagcatcttacctacataaactgaagattcctcaagaatgttgaagcaatagtcattatgtttactacaggagtaagtgaggcatcaatctaccttctaccttgtgagttagccacataaagcagtgccacaggttgaaacaaaccttcttggtctggtttataatttaaattctccatggaagtagctgcagcttggaagctcattccattgaaaagttcactggctttggtgattcacaaaggagcatttcttatttggtgaattagtatcctaattaattcatttcatggagcaagcatctttgtgattctctcttctgctgcctactttctccctggcaggtacaggtaggattctaaagtataaagaggactttcacctggaaaccagaaggttgagttcttaaaggggtcatgatgcttgctagtaatgtgacctcctgctattcaatacttctgagtctccttttactcatctgtaaaatggggagaaaaaaaaactgtcctgccttttacccttttcttagcatacaagagttactgagaatgcttcagaagctattatgaaccactgtagcatcagctatatttatttaaggcacctattttgtatgttaaaatattctagagtatcttataactcttggttaatgaaactaaggactttctcactccttaggtaaaaaagtagtgtttatttcagagcaagatgttcaaaagcaagactaaacaatttgattcctgggatcatgccatcgggctgtcttgactctctctgattgctttcagtatttttattttattgggtagaagaacttggtaaaatgttaccctgaggctaaagagagctctttaaaatgactttagggatctgaatagaccagttgccatttattcccttaatatgattagtttcctaatagtcaaaggctgagatagcatttatttctcctaagtttcagtctaagccaatgtgggtgcctattagtgtcatagtgatgagtggcacagatgagcaaacagataattaaggaaaaccaaatatccttcccatcccccacctcacacccatttagtagttgactttggtgtaaaagtgtcttcctgtttcagtaggataatttggtgctcatctgtcagatagatggaggatggcaatgctaatttgtttctccaggcatacttgcctcagacttaaggactaaggttaccatgtagctcagagctgaaaggtaagagtcagaggcattcaatgattaaatagtcaatatgttctgacttctctgctaatttagcaaaaggaagaacatctcaattttgtcacttattaccagttgtttagcttgtcttagaaacatgccttgatttgaatagataaactacttttaaagcataagtcagcagccttttgttttatgaaatagtagtcctccatttggggcaattaaaatgaccatttctttggaaataaaatgttaaactggtgatggtagggtgaggtctagggggtgataggagagggaagttgagatttcaacagctaagtgcaaaagaaaattttaaaatacttagtattaaaatttttaacttgctactactttattggtctcatataaggacatgaacacctggggaagtaattggaaagggaaggaacataaaaaatattttatattctgtgaggtaaaaactgaggctaaaacataaataatttggcccaggtcatatggcaggagaatattagaatctggatttgatcctgcttttgtctggctgtggctgtgaaaattgagtccatcagttttcatcccatggcatctggaatcattgccccttgccacgtctttgtgtgtgtgcgcgcgcacgtgtgtgtgtgtgtatgtgtgtgtgcgtgctccaagttcatcccgatttctttaatctagccttgttaaaacacattttaaggtcagtttttaaggcacaaaatgtaggatgagtgagttgataggtagatatctattagcttgaaattgtattcaaaacagaacctcattcttaaaagtttaaaaatctatatcaattacccagcctcaaatatagttttcttctctttcaaatgttgtagaaaaatgcttcatattttctggctactgagcttcttaatattagagtaccatctcttcctacaattcggttacaggttgctcacttttagcgacattggctttctagttggagaaattccttagatttcaggtaccacatcagaatttctttcagttagggtgacagatccaatatactacatgtgtgtgaagtatagatgaaggtaatcagatctcatgcttcagggaataaactgattacccgcgatggtcaggaaggaattttcaccattagcatcctgcaaatacacaaacccaagtgcaagaatccaactttcttctatgtaaagttttcttgtagcacctcatcaagtgcagggcataaaatctaaacctatgacataatgtgctatgtataattgttgtcatacatgcatgactgtttattatgcaccaaaataaatactgtagcagttgagacagagtctagttagataactgagatagtgattcattaaatataaactacttaaaatcttttcatgtttcctccaggaatctcaaagtaccttcccaaaatgagctcattaatcctcatgaatattctgtcacataaattctgttacatttctctgaaaacataggttagtcaatcttactaactagtaagttctagcagcaagtcttcacagcactccaacacctttattgccttgaaatctcattagagatttagtttctaacactgttaatctagatggaattctttcatccctagctcattactacatttacccttcaacaaacatgtggtgggagtcaactgtgcgcaacgtgctgaatatgaaaagttaaatggggctcagggttcactgggaaagtgctggtaagttcattcacatgcactccagtacaacttggtatgcccagtgctgcctagcctagcaagaccctctttaatctactgttgccttcttgtacaggtctttatatcatgcgggctttgacacagataaacctactgtaatccgtgatttggttctaagagcctataatgaactccagttaattcagatgccatttagagaaacttggtcatattctaccttagaaaactcttggaataactttagttcttttgaaaattgcagtggtccagacatttttactctagtataactgctgtgtgtgtgtgtgtgtgtgtgtgtgtgtgtctgttgatcagaaactttataacgaggattagacttaaatttggcaagcttttctagataaattctagagaaaggtcccatgatgatcctagaaaatttaattaagagtaacaattaagagatccttttgaagtgcccatgtttaagttttatttgtttggttttgtatttttttctaaatattctttcagatcaaaccaagtctaaactggttactatttgacttaatgaaaggcctgacatgaaggaaggatgtaaataattttgagagaaaatacttttgaaatgttaaaacatttcttttgagcaatgttatttttattataaaggaaatagcactttcacctctgggagtgaataggggcttctcaatttgatacctaaaggatatttcctctcaagacaaacaaacaaaaatgtgcttactggggctgcaccttcagcccagcattggatatgttaattgctgacatacttgaggtctcactaagagaaaaatatcattagactgctggttcccaaaatacattcccttaaatatcagtcctatggagtggtccttgggaataaaaatcagggaacatattcaatggtaaatatatatatatatatatatatatatatatatatatatatatatataatatttatatatatattatatatgtattatgtagctctttattattattattattatttttgagacagagtctggctctgttgcctaggctggagtgtagtggcatgatctcagcttactgcaacctccacctcctgaggttcaagccattctcccgcctcagcctcccgagtatctgggattacaagcacctgccatcacgcctggctaagttttgtatttttagtagaaacagggtttcaccatgttggccaggatggtctcaaattcctgccctcgagtgatctgccttcgacctcccaacatgctgggattataggtgtaagccagggtagctttttaatactgctccctctctcttaggtattcacagtgcatattagcaaattaaatgttctgtgaagtcttgtattaagtacatcttttaatattttatttaagacttcccaaattcacttgaccattcactttgtaatattccttgacagaatacttgttaatatccagctcctgggaacacaatttgggaaatactacactaggaaaaaaaatctaggttggggaaatctaactaaacaagagtgtttatttacattagtaagttactttgtactttatgtgagtctccttttcaagtgagtttctcaagtgtcttaaaatactattttaaataatttttaaaacattgatatttttttgaaaatacattaagtatgtttttagaacttgaaattgaatgaattcccccttatcccttgtctgccagttctgttagtcttctcttcagtatttgatttatgagagatcaattcatatccaacttttcagagcatgtctcatgtcatgtgaaagacagcatacctatatttgtgtaagaaaggggagaaaacctacttctgagtgtaacataaaaactatgtgacagtcaagtatgataaaaggaaaatactggttatagggtcaagcaacctttatctctttttggcttactgtgagatttgggccaacaagtaacctctctgatcctgcctggataattgaaatgactattacttccctccaccagagagtgaatgatgtgtggattaaagtctgacctttgggcaaatgcctcctagtgacttgaaagaaggtgccctcatttctaacccacaccttacatctgtgtctatgatcccattcacagactggttctgaattaattctgtcagtcttgcattcttgcacttgccttcctgtcacctattcacttgcattctctctctacagttaggacattgtcaacacagattgtgtttgagtaaaaaagttcactcagagaaaaataattatagaaaggaaaagcatagatcaggagacaagtaaagacatacagtgaatctttaatccagagttgatttactcaagccttattgaaagataatcatgaagcaaaatgattaggtatggatgtgtaaatctgtaatgaatgactctgagtaaagattgtactcatcatcactagatttctctcataagtgcattgggttaaaaaaaagaattacctaagatcatttgaaattcagtaataagattctcttcagaagatcttttgattctgtagagaattaacatatctaattattatctgaagaccccaaacaccagatcctccaaaataatgttccttctgacattttcaacttgtataaaatttggttatctggaaatttactgcacataaggtccagcaagagaataattacactttattgatattttctcacaatgccatgagaaaatctggctgaagctgtgaaaaatgagttatatttataaaccagagatgttagctttccaaagtagtttcaaatccagacacccaatacacacacttccactcaccttcacgttctcacaaacttatacaagaaagtactcaatgatgtatttctaggcattaaatatttatatggtgtatataggtaggtatatatatatatgtatgtgtatttatgtgtgtgtatatgtacatatgttcacatacatttatgtatatgtatgtatatatgaatcataatttgctgataagcgttagacactattattataaatttcccttaatacacaaatttctcaatatcttagaagaaaattttcaagtatatgagagctcttctttctatcagcataggtgatagcattaaactgaatattaaccattccccagggtagagaaattatatctcagggtagaaaaatatatattttttgtatggaggttacttcttattgaagtgtgttagatctggccaggcatgctggctcacacctataatgtcagcactttgggaggccgaggtgggaggatcacttgaactcaagagttggagaccagcctgggcaacatagtgagatgctgtctctaaaacaaaaatttttataattagccaggcatggtggcacacgcatgtagttccagcagctagggaggctgaggtgggaggatcactttaacctggggatcaaggctgcagtgaaccagattgtgccagtgcactttagcctgggtgatagagtaagaccctctctaaaaatatatatatttttaaaagtgtgttagatctgcatattataaaatgacatgaattaagattcttcctccgtcatttatttctgttaaaaaaattcactgcttgcaaacatgtacatatatataaaccactgcacactaattatactgtatggtgtcacaagggtgttttttttttttacttgtaatgttttgcctaactttagagaaagcttgaaaagttaattaaaatcaacttatgtctcaacattttgttgcagtagaggaatttggaagaagggaaaagagaatagcaatgaattgattggataagaggcagacacatgtttttaaaaaaggatcagagcttgcccagtttctatttaaagtattgtaaggacctaatagctagctatagtgatacatttaagattaaaatgagcagatttggcggtacaggggagatgatggctagctggggatattagaaacagagctataaaaattcaacacaacctggaaaaatgcaaatgaatacaaccaacagtggggtgcagggttggttgcgggggacaggtggattatcttaggtgatatgctgtggaaggcatggagtttggctgcagggctgggtggtcacctagtaagaggaatgctttggctccttcccttgtctcttggaaatcagaagagacactgggccttttctcctttactccaagaagaaatgctcttttttcatatatctttattgaatacctattatggtccatgtgttaagagatggggaagcaaagagatacaactcatccaccctaccctggagaagcttattgcaaataccgtcaaatgcagtttgaaggaaatagtatgagatttgaattaaggacactaagattttattcatggattaaaatccgtattctgtttcttaatgattttgtgatcttgcacaggtccattaacctctgagcattagttatctgtgaaatgggagtaataattgagtctgcctcatgggaacactgtgatgactaaatgtgaaggtttatgataatgctctgaaaataatcaaaagtgctaaaatgatatggtttttaattatgaggtatttttaaatccaagcttgatagtagagtcagattatatacaaagggatcagagaaatagataagtatgggaggaatgataaatataggaagaacattatatacatcacagatgagttcaggtgcatgggggtcctggacttacaagcgggtgtgcttagtttaatgctctcctatcaccaccttgaaagttttaatattttttaaacaaaaggactcacttttttaatactaggcctcacaaattatgtagttagttctggttgtagacatattgcgtgtataaatacttagattagttacatgcccacaatattaatcattaagttatttgtgtatacatttaacagttacccatctatttatctatccctatagagacatattctcccatgtaggatgtgaggcacttgaggagtgaaacttgcttgaatggatctagggcccaggagagaaggcgaacctgaaaaacagttgttcggtctaatagttatcactagttggaagtcttgtacgttccaaggtcaagcgctgtgatgtgatacattacacacacacacatataatatttatttatatcatggaataaatgtgtaaatattactatattactaatgtatcttaattttcttttttacaaagatcctataatatcagtaggtctagaattaggtcaagaatctgcatttttaaaaaggcattccagcggcttctaaggcaggtggtttctagacaaactttccaaatactgagtgaaaagtttattcatgttgtgtttccattatttatgtgtaatttggagaactgggtgatcttttctccaggagcccctagcaacagatccagagaaagaatgtcatagctagcatttctttgtgttatttgggaccaatttcaaagttactgcaagatgtttgctttgccaagagatatcccatatccagtccaggccctattggatgccaaataactattagtgtacagaagcccccacttttccatgggggaaatgatctaagacccccagtagttgcctttaactgtggatagcaccaaaccctatatatactatgttttttccatacatacatgcgtatatacatagttatgataaggtttaatttgtaaattagtcacagtaagagattaatgacaataactaataataaaatggaaaattatgacagcatgctgtaatacaaacaatgtgaatgtattatagtctccctctcaaaatattttgttgtactgtactcacttatttttggaccatggttgaacaagggtaactgaaactgcagaaagcaaagtcgtggagaagggggaactactgtacataaagaaatagtggataataacaatgagaagatagattggggcctttaattctggataaaggatctgagactcttctcagaaggcaatagggaaccactggtcatacagaattaaataaaggagaaggaaacaaaaggtaaggagatcacttagaggctattacaaaaaaagtagagaagaggtaacaaaggccaaaagtgggcactaagagtaaagattaagaaaaaatatctttaattatggaaaatgtatggagattcctcataaaactaaaaatagaactcccatatgattcagcaatcccactactgggtatatatccccagagcttgaaatcagcgtgtctaaatgatatctgcactctcatgttcattgcagcagtattcacaatagccaagataaagagtcaacctaagtgttcatcagaggataaatggatgaagagaatgtagtaatgtggtatatacacaatcgaatattattcagccttaaacaagaaagaatttctgccatttgcagcagcatggataaacatggaggacattgtgctaagttcagaaataagccagacacagaaagactaaaacagcatagtttcacttatgtggaatccaaaacaatcaaatttatagaggcagagaatagaatagtggttaccagaagtagtgggtagggggaatggagagatgttggtcaaatggtaaaaaattttagttagaaggaattgatgataagtatttaagaaaatggatatattaattagtttgagttaatcattctatactgtacagatataacatcactgtgtaccatacaaatatatatatatgcaattatagtatgcccaaaaataatctctaagtcttctttttaaattttactttcataagaatggtatccatctgattgaagaccatcttctttcttctccatatgcaaatgtattccttatagaaaaatgcactcctgcccccaccccagcaaccatgcttcaggccccaaagaagttttcctccctgttaccttgcaaaggtagcctctcttgggaatcgctcactaattcaccctggaatactcttatgttagtttcccttatggtccctaacagcctttatctgttattcatctcccaggtactcacagcttgctgaaaggctttttctaatcagcattgttttgtcttctttaaaatccttgatcatggccactagcatccttgacagtctctggacacttggtgagaaaagaataaactcaatgcacaccagtgagagatcatgcccttttcttctgacaactttgtggcatctttggctgccctttttatgtgcttgtctttgtgctcccctacatcaatctcataaaacatcctttttttcatgcttgacatattgatatcatcccaccgcagataaaacacagagcagtgtaatatggacaggtgttggaattatttgcaatgcacagaaatctctgctgatgtttaagactaggacaatattaaacacattactttccctgacaggcattttcattacacccatgccatgcaggtgcagaatctagaagtgatatcttgttttccccaatagggtctatgcaatacaatttaaaagtgtgtttgggtgtgtatgtgtgtgtgcatgtatgtgtccttccccctttatatctttatctttgcaacatccacagcctcttgtttaaatcacatctgaattcacttggaggaatgacacaaattccaaagaacctgtagttaaaatagttgctatttaccagatcagtattcttatggttggtagtgtcacatggtcaggtttagagggcaactctgagataggacaagatgaaaaatagcctaggaaagatcaagaaagaccaacatcagaaagccacatagtcctccagagtgagttactatgtagcttagtttcatcaaaaagagaatcatggccaaggtggctgtattagtctgttctcatgctgctaaaaaagacatatccaagactgggtaacttataaaggaaagaggtccagtggactcacagttccacatggctagggaggcctcacaatcatggcggaaagcaaaagagaagcaaaggcacatcttacatggcggcaggcaagagaacttgtgcaggggaactcccatttatataaccatcagatctcatgagatttattcactaccacgagaacagtatgagggaaactgcccccatgattcagttatctccacctggccccacccttcacatgtgggtattattacaattcaaggtgagatttcgatggggaaacagccaaaccatatcagtggcaaattcaaatggctacagtaatgaaaacaacaataacagcaacaaaaggtaatattacttgaggatttatcttgtaccagaaacttttacatgctttacattcatgttgaaaattaaatgctggccaggtatggtggctcacgcctgtaatcccaacactttgggaggctgaggcagacagatcacttgaggtcaggagttcaagaccagcctgggcaacatggtgaaacctcatctctactaaaaatacaaaaattatccaggcgtggtggcaggtgactataatcccagctattcgggaggctgaggcaggagaatcacttgaacccaggaggcagaggttgcagtgagcagagatcacgccactgcactccagcctgggtgacagagccagactccatctcagaaaaaaaaaaattaaatgctcaaaacaaccctatcaggtaaatcactgtaattagcacctatttatcagatgagaaaaacaagactcataaaagtcatgtaacgtgtataaggtaacacagccagtgattcaagcccaggtctatctgactacaaaacttgggctcttagctttttgggattctatactcatggagaggtaaagctcagatcctagaagatcagctggagaagttagtgtatgaagtaggcaagccagatctgaggccaagctaagggcagaaaacaggagtcctgggccactcagcatgcatgctggctcaaaggagtgtgtttctgagcctagaatcttcactgtctcctgctcctgctaaatgttagagacctctaaaataaataattgcagtagctttgtggcgtgttttaattggctaccctctgggttccattagtaggtttacttactctaccctggacctaaagctgcagtgagggttgttacctccagcgaggagagtatttatcatgccctctccagaggtaactgcaattttgcttaagtgtactaatggcatctgctctcagctctgtgtttttcctctctgggtcttctgataaggtcattaggaagtgtgaggcagacaacctgagggctaaagtctcattcagctccatcagtcagattctgctgggactgcacaacccaaggatcctgttacagcatctgcctggaagattcttaagaaggaacttgcagttcattcattacatatgttctatgctgaggcataacagtggaggctgttttacagtgtatcatgccaacagtacatctgctgctggcaattatgctactaacatacaggaccttaagaactcttccttcccatagtttcactgagaaaaacaaaatcccagaagaatattaattgacattaatatgacacaattaaccatttattcaattggcctttccacctagaagtttaagcattcatctttcctgtatttcagatgaacaaaatgagataatgcattcatatactgattcagcaaacatttattatgacttcccatgtactgggtactatatagatatgcgagattaaaacaaagaaatacaatgtaaaaattcagattcttttaaggattccaccgtctactaggggaaacagatgcaatgatgtcatctataatataattttctgtgttgtgatagaatcatacataggacagcatccaaatacagcagataagcaactggctcagctagatttgggaggaggtcaaggcttcatgggggattcaatacctgagcagggtattaactaagagtgtaacctatataaaaggaatcttttttttgagcatttactatgtgttgaactggatgcagagtgctttatgtgcgttgtcataatcctatgcgtaaaacaatccagtgaaatctgtactatagccacatgtctcatgatgatggggatacattctaagaaatgtgtccttaagtgattttgtagttatgcaaaatcatagtgtgtactcacacaaatctagacgatatagcctgttgctatatggtacagcctattgttcctaggctataaactcatacagcatgttactgtactgaatattggaggcatttgtaacacaatggtaagttttttgtgtgtctggatatatctaaacatagaaaagggatagcaaaaacatggtattgtaatcctatgggaccatgatcatatatgcagtttatcattgatggaaatgtcattatgtagtacatggctatattattatcatattataaaatttccaagtgacaaaaaaaatctgaacccctgctctcaggctccagatcccagcttttagcagatatgccacactatcattaactacggtgtttcgcttaggaacatcaccaaacaaagctacttgttcttcaaggacccagtaatcatccttatccttgcacaattatcctggctctatcgtttgatgattttctttctgcaactaatgatttgggtagaaagaaaacctgccgatagtcatctttgatattgactggtcagtcccaagatctaggcattgaagtttctaagagtctctctccagtcctctatattgttctctgcatactcctccaatgtggtactgtactatgcagataagcacatggatgtgacctgatcctcctcaatcctatgctccctgacatctaaaatgggcccagaagcaaaacactttgcctgccgatttgtgcttttcagaagatgagcattttcttttacattctggacacacacataaaaaaacttttctatcattaacctgccacagccttatggaaattctgagaagtccagttcagcctcataacgcgtgaacgttatttatcttgaatgctgcaaatttggcatattggtggggggtgacaaggttaggtagatttattagcatcctgtcaggaaatttcccatgagcggtagaggtttgtcagaaaattcagtgtaattgataggagcaagttggactaattcttagtgctagatctgtactggctctgttcacacctttcctttgcagacaacaagatgtgctgaggagagctcattaagaagaccttcctgcaaacccattctttgcaccaggtttctttttccttcctttcttttatataattatttcagttactggagaagatataagcgtatattggaggcattactgaataggcaatgatttcaactcatttgtatgtatcttttaagtctccaagggaacacttaaactctagggaataaggattaacaagaagccgatatctgttcagtgtttcgctctattttcactaaaggattagaggtttcaactgtcgagtctaaaagccatcaaggcaggatataacagtggaaggaggttagcttttgaattaggattcttgggtcccagtctcaagtctccagcctgcgagttctttggccctgggacagttatttaaacttgctgagctttggtttcctcctttgaaaggtgaggttaatgatgcccatctcacagggttcctaataaatattaaatgaaatgaaaaatgtcacagctacttgacctaagcatctttcaatctctagttccagcactgctgcccctgaacagccttccttgatgtggccaagtaataacagccaccatttattgtgactttatgatgttgccacactctatgcaccatgctttgcatacttcatgtcattgactcctcagaatccagagagacagggagagaccatgggaagagaaagggagagaccatgggaagagaaggagagagagaagagaggagtagggagagagagagaagacagaggaaaggaaaaagaagagagagaaaaaagcgagatgagagagaagaaagaatgaatgagttctcatgtaattatggtcaagatattcatctttcctaagcctcagtttccttatcagtaaaacagtaaattatcacgtcttaactattttgatgactaaacgaggtgatttctgttacatgcaacccacagtgcctggaacataataaatccctaataaatagaataaaatattgttgtttctgatgataagtttcatttttgttgcaagcactcctggcacacattgcattatagattccatccactgattttccgttgtttatttcaatttcttcctcctctactagtctgcaaggaggccagagtcctttttaaaaaataatcactgcgatactgttcatcacacagaaacacacataaattgtttttaaaggaagaaaaaagggaaagaggaaggagtacaggcgcgtgtttggtaaggtgtcaagggtcataggtccttagattctactcaggtttttcttcataaagatgccatttctattggaaagtgatggctctgcctctgaaaacatttcacaaaaaccagaagaggaaaacaaaccaaaaagaaatattgctggaacactatagtgtgggcacttcaatgtagttttcctattccttatatttttccatagttggaattgacactgtaagggacacttttcacaaagtagcatattcccatggctggaacaaaataaccaactttgcaaagggagttgaattacttccattccttgttaggctaaaagccatttggcctagccagggataattttggcctggaaagctcagatttctaatctagcctgactgacctattcccagttccaagattttccacatactttcttccctcactcatggagcgattacatggagttaaatacaatacccttagtggaattgtttggtacaaattgtggtggcattgactctgtccgaggttctgcttacattctgtatgcctggatgctagccgatcctctccatccagtggaatccagccttgtctttatctagcataaacctcacccttcccttgtgatctccaaacatgtgaacagcctttttttaacacacacacacacttctctctcttctcacatcatggccttctttaaatgtcaggtgttttgaaagaagttagaggcctttagaaagtgcaagatacaagttaactctgtttaaagtttaatggcaaaaatcagaataaagcaaaactggatcaggtttacagatgatgagttttgttttccctgcaacaaggttaaaaactttttgagacaacattttaaaattgaatagtgtagataaaaatgagctgtccatgaaaattattagctactcttggcaaatcagaagacattgcaatactagacttgcattcccatgtagcaaaaaatttgctagtgattattagtgattgttttggacattctttgggtatttacagtccccaccattgcctatcatcccactaacaccaaagccaactgccagttctagtaataacaaccaaatatgaaaatgcttgagcaccagaatttgtaaacccagcccatgaatttgcattacctgcttgacctctggggtcgttggttttgcaaaccatactgtaaaggaaagaaaaaggaaaaaccaagttagatgtgttacataatactatttcattatattatctcttttttctcccttctacacttttcatttaccaccactccccaccccctgctacctaaatatctttatcccaatggaagatgcgttaccaaagattcacagtttatggaccagaagaaaaatgtggcttctaagtaagtcctgcagtcttatttctcacttctgtcattgacagccactaaatcaagaagaggttaagtgaaaattagcaaaatatgcattgccatactaacaggcagtaatagaacaatctgttcatgtccccacttcacaagtccactttcccaaaactaatcaaactcttccatctgtggaacttgccacagcaggtctttttcagcaaagaaagagcaacaagtttccctgcacatattttccctggcagaaatttatcaccttatttttctacatttcaaaaataaatattttccccttatacctttcccaatcttattttaaaatggaaacagccaaaagctaggtagttgtcttattctcttttattttcattgaaatcatttcctagactgtatacatacacattatgtatgtaatttatgaagttttgtttatatgagaaagcttcttttattttttaacatgcatttatgttgctttttgggctaatgtccttaaccttttcaaaacccaggagtttttccacctctattcttctgcatcacaagaccttacattgtgtgtgtttactggccttcataaaaaaattaaaaaaaaaacactctaaattcacatttcaccacttgttatctatcaccctctctcatagcttgtgatgtttacaaatgcttctgaagtattcagtccctagagtgagctttctttgactggtgggcaccagtacgatcatagttcacagcagccttgaactcctgggctcaagtgatcattttgccttagcttccaagtagctcagactacaggcgtgaaccgccatgttcagttgaagtccacatatgataacatttctgcctccacttaaaaccctccagacagcccttcaatgacctcggcttacaatacaaatgtgttatgattttccaggcccttcttcatctgctctcccttccttttgagcattatcccatttcatgcccccacacagattctagccataccccatgacttacaatttcccacaaagaatgcactgtggctccactccaggactttgcccatgctgggtccccttcctgaaatgccttctagctgttctctcttccctgtttgctgccatttccgtggacagactatacttgtctttctgttctaattgctctgaaatatacctctggccccccagctttcctgctcccccatcccctgtagtccttctagttttcctgtgtccccatgggacttctttatcctttttgaagcacctatcacactgagccataactgcatacctttctggatgtctctttcagtggaccatagttgcacactctcttcaggaagtgcaacttgtttgtcagtgagtcgccaatgccttatactgtaaccaaaatgcagattcagtcacttgccacctgccgagtccaattcacaagagcaagttctagtataaagaaagtgactttttattccaaagctagcttaagggaagaagtataggcttcctgccttaagagtactgcttacttttggagcagaaagcaggcacttttaaaaggcatcttggcatgaatggctcacaggggagggaaatgcaggtggggtcatgtaactcactgcagtgcctaatctactgcgtggttgagctggtgacagctggtgccttcatgggcagaactaggttgtaaacgtggccaaaactctcctggtgggagacagttttgtagcaggcacttcaggttgtacattgactgttgtctctcgaggtgatctcctggtgagagggagttctgctctggagcttctaagcacatagttagatgaacttgccctgtagggagtgtctggaaaaaggaaggtaaaaggttataattgcatgtctaaagagctaagtaggaagtagggaaaaaagaaaagagaaaaaatacattatctcttataaaaatgggggtactcattacaaaactgtgtctggcacatgaatgttcagtgatgttgactgaccaaggagagttacaaaacaaaaacttggaagtgggaggggcatagcaatcagggtcccaaaggaaagaaggcatacacaaaatggttacatgaagagaaactaatgaagggatttatttcccaggtaagaaaattagcaagtgctggtgaaacacttagggatgagaaaatgtgaaaagtctcaattgtccctaggtttgaatggccacagaagacaattggattccatgaacatggctggtgttgcaaccttgtgagagaggcaactcggttatcactttggtcctaaataaaataacccagctactggcacattcataacacatcagggagggttctggaaggaagaatgaataaatgcccaatgtttctcttattgagctctccactgccaaaatatacaagaagccagaggaaaaagacagtcttatgatgtgatctatacagcttatagcagtcagcctttctagtgggcagagaaggaaaggaagtgaatctgggatgaaagtgagaatatctaacccagtgtacctgcctagcagcagaggggaatctttgactataaaaatgtttcgttgttaaattttgaaataataaatgactataagcttttcataaagtatatacctgtattattaatgttcttatgctaacatatctggttattaaaaaatggtgcttatgcactaataaccaatcagtatacagagagctgtcaagtcactcatctgtaagtgctaccagctggggttaataagcagaactgtgacatgtgaatatttccttcatgcaaacataaacagaaatttgttttattttaaaagatagaggaattctaaatatatagtaaaaatagtaagtgtgtattccagaaaatcttagcaaaaagtcagaactaagtaaatgaataataaatgagtgaatgaggtaatataattggactacagagactaggcaatgtgaaggagagaaatatgatgtaggctttgggaacatgaaaggtagagtttgcttacactgaaagaaaagatagagaaaatgtgaacaatgtgacaaggatggatgttattaaattttcatcctaaattgtaagattcttgtcctcagagaaggaaagagggaggaaaactagtatttattgagtctctatgatatgctgagagcttttacaaacctttgcttgtttaattctcacaagtcactatgagtattattatctcatttttacagtaaggaagccaagacacaaagcagttaaagaactcactggttagtggtaaaaaccaggaaataatcccagattcatctctcagaagcccattccctgtttgcataccatgcaacattcaagaatctagtgaaggaaataacacacctatcaataattatatatccaagacagaatgtaaaaatactatgccagaagtagacagtgccttggtaacacacaggacagagaaactctaatcaggaattctgatccaatttcatgcagtggtggcatttaaataagtctttgagagatttttgaaatttgaatatctgatagacaacatgacttaaaagaaagaatcattttatttatttttgacaccttggtacttgacacaatgtccatcaaatagtaagtttcagtaactcaatcaaaaataaaaatgggaaaaatgacatcaggtgtgttcagggaaatggtgatttgttaaaggtctggtagtgagtatgagggatgggttagagtgaaggctacagctgacatgataggacagggctagtttgtagaggattttgaatactattatgcagagttagaactttccataggtgtgaaataagtagccactgaaggattttgtgcaaagcagtgaaattatgtgggctgcacattaggaagatttctccggggaaatgtagcaggccctattcgagaacagtgttggcagctaagaactgcattagtatgccattgtattcattcaaagaggtactagggaatgaacagcactctgagaatgggaaacaggggccgagctgaatgatgctgtggagatagtcatttctctagtttagatagggagagggaagggcgtctttcaagaaatgacttcagaattttgagcctgaataaatggaaaaattatgatgtcattaactacagtatacaacgtacaataagtaggggtaaaatgaggagtgaaaagtaataaggaaaatgatgagtttggatcatctgtagaaagaggtccagtaggtggttatggttcggattattggatgacatcacagatatagatctggggttcctccacttagaggaagtagctgaatccatgggaggattcacaggtggtgaacaataccattgaggatagagctcagacctgggagagcacatttttaagtgacgggtgataggagaaaaactaatgggatatttgaaaatgagaaattgtcaggttcattgcactattacccccatttttctctcttttattctctcttttctttttgtttcttttcttttcttttttttttcagggtcttgctctgtcacccaggctagaatgcagtggcatgatcatggctcactgcagccttgatctcctgagctcaagcaattctctcacttgagcttcacaagtagctgggactgcaggcacaccatgcccagccaattttttattttttgtagaaataaggtcttcctatcttccccaggttacatttttctctttctgatagtacctttatctagaacactaagtagctaatcctttctacaaaattaaagatagttactttagttgacagttaaatatcctattgtacttaaagttcttgtacattccgacgggttaatcagatgcctccaattccacctctttcaagggtggtgtatctgaatgtcaaggtgattggcataacactaatgcataataaccagaaatcgagtttatcttccaagatcttaatagaggatcctcctcaagagaaaacctttcagacatatcagccttacaactggaatctatttacttttcatttgtttttcaccctatttatgtcattttcctttttaattgccagggatatttatatggaaaagagttttcctcttcttatttctgtcagatcttgtagttgacatcttgtttcattctgtcatgccaatgattaaagctcagtaaaatgtccattttgcatatatggctttctaaagatccatttggaggagatcagatgttaaaagagaggatgtttgttgggggggtggtggtgggaggtgggtagggatagtactttagaaactgtttcagatctaagagggaattaacaggatttcagagggtgcgagaaaagtgggataatgttaagtattacattgaaagcagcgaatgagacctttccaaagtgatgacaaatacaacagaggagtgagggctggggcagtcagcaacacaatttttccactcacttgtggagctagaacataccttccctctgttttgtaaagatgagcctcctccctttcttagaacatttggagaacttcataactttcaatataacattcaagacatacttcaagagttgcccagccacatccattagtctaggtggcacctatgtggttcagtcacatctgtatgaagacttgaagactcccaaggaacttacatcagaaggagagaaaatggggttcttcatggaaacttgccatggatgaaggtacaacatgacccattgactagaccaagtagcgtgacctggatgttgagggaaggaggtggttccaggtcaagtttgaaactggttctgaacattcctagatctgttctcctgccttgtctgtgtgttttggggaagagattgtttgcaaaagaaagaatcctgtcacttgtgtctttactgttcttctgtgggaaagggctctgaaaggattgcgttttgacaggaggaaggtgttgaaccactactcgtagatagacagggaaccctgtgcggccatagtttaggtatggttgccagttctgtggggaatacagtaaaagctttcaaggacaatgacatacgtggcctccagagcatgaggctagaaatctgacatatgcgagaaggtcctctctcacccaaaaacttttacagaaaataactagggagggacatcctagagggcaaaattagacttcttgctaaccaagtgtattagtttcttcttatattgctactcttattcttcttatactacctgaaacagggtaatttatgaagaaaagaggtttaattgactcacagttccacatgtctggggagacctcaggaaacttacaatcatgatggaaggtgaaggagaagcaagcacattttcacaaggcggcaggaaaagaaagagcgaggcaggagctgccaaacacttttaaagccatcagctcttgtgatgaactcactcactatcatgagaacagcatgggggaaaccacccccacaatctaatcacctcccaccagatccctccaacatgtggaaattacaatttgagatgagatttgggtgggaacacagagccaaacgatatcatcaagcaagtgggtgcccaaaacattgaggcaaattgtggagtttctttaagtagaatacatttgtaagttcatagtttcagcttatgaactagctcttatttgatcagcatgagagcatctaaaagagaaataataaaacaaatggatccatctctcattatttccattccatggtctaacttatttttttcttgactacccttcttcctataagaagaagaagagaaaggtctgagaaaaatatgtgcccccataacactctggggcaacctgaaggccatcttccaaaagtcccctctgcctttctcagagaagagattgttaggctgatccatgcttctgtaacacacagtccacaagaatgcatggcatgcagtgacaaaccaagaatattctgataatctcagttgaatctaagcattctatggcagaaactcgcttttagtaatctgctatctgttaaagaaagaacaatttggtctcaagcagtggggaagatcagctcatttacaagactgtcacttaatgaagctccttggtgacttttctgtgatgaatttagacattgaaaagaaatatttcacctcttcactctgctccataggctcaagcagaaaaaatgggagacattgtatttctagtttctttcatccaaagctttgctcacttatgttgacattgtgctgaacagctgacgaacatgcgggcaggccaaggaggatgctgtcttactgttggactcttctctgggcaaagttcattattgtgctggcctcagaccactttagctgccatcagttgagaggaaaagaaagaactgcattaaaaagaatgtcttgcattacaggctttagaggggaaactagtgaaaaaactgctgatgctttgggaggcaatttcttccctccctgcctgcctccctccctccctcccttccttctttccttctttccttctttccttcctttctccctttctcccttcctccctccaactcttcctccctcccttcctttcttccctcctttctagtagatgtctctgattctacctcttttttcaattgatttatgtgcttttgcttggcaagtttgcgctaactcccataattgcttggaagggcggtgttgatttaagccttgtttcattgaaggagaatagcattccttctttcataacagaccaattaaagacgacacaatgacttcttctttctgtaagctttccttgattccctgagccaattttgaaattaaactcttcttcagtcctcctaaactcattgcacagaaacaatcacaaactcacactgtcaggagtggcccaggccatctggttccactgtttgcaagcctccatagtgccgtcatagaggcatttccacagtattctagagacactgtaaaccttctccataataggccagattttcctagcagggactaatactagctgatgatagctaataggtactgattgcttaccctgcctggtgttttacagatagtgtttaaatggcagtatagggttaagagtatgacaaccagagccagagatattgggttccaatcctaccatttaatccctgtgtgaccttgggcaagatgttttacctttctaaaccacagttttcttctttgtaaaatgggaaaaaatttagctactgcaagttgttgcattaaatgagataatttaaagtagaatgtgaatcgtaatacccagaatgttctaaaaattaatgttaattatcatccttattatccattgcttatctccaaatgctttagtgtaattttcaacatggtgctacatagcgaggattatgccctctgaaattgtcacacatcaagactggtggctgaaggccagcaaaatggtaattgtgatcattatctagcacattttcttctctagaagatggattttaagtctctgctcataagctgattggtagtgctgccttagattggtatcttctgttttggggaaagaaggtgattttgccagatttcctcagttttgatcattgggaatatacaataatggaaatttgccatgggaggctgggaacccataactaaacagtccatgataatcctatatccaactcttggaaaagggaaaaacaacacttcatctcaggattgcttcagggtgaatactgtgcctactacccatattaaatgcatttctttatgtccatccctcctctctctctctgtctctctccctctctgtgtgtctttctctctctctctgtctgtctgtctctctgtctctctctctgtctctctctctctctctctcacacacacacacaccccccagaagagcattttggccacttaaaggaatgctgtgaggaattacagattttgactgcgtaaaatattgtgcgttgttccaagcaaaggtaaaattctcaaactgttgaaattgtttttatcagcactactcctaatcataattactgttgtcattagtcagtgttgggtaccactaccttctgtgataacacttaacacattgttagcaattacacagaacttcccaattctgccagctccatgctacatcatcaataccatttcctgtagtagagtgccccctagcacctccacgcttctctcagtttaatttgctttttgagccccccaaagagagactactaaatatcaaaggcagctttcactctttagggacttgggctttccaagtggttaagtgcccagcattaatctcctgagatttgttcatctgacttcacagcagctggaacagggacagagatcttttggacagcctgttctgccagaagcagagcaggtggctttctctcgggtcacaattgaatttaaaaatcccattaattttgtcaagtcaacttaattctcttaacctgataattatcttcctttggaaaaagaacaataaaagagtaggcagacctctgttaagcaatgtttaaagtgtgtgtgtgtgtatgtgtgtctgtgtgcacatgtgtgtgtgcatgcatacatgtgtgtgacagaaagagacagaaagaaaggctgcctgactgattataggtttataaggttcacttcttagttcatctctgaaaacaagagattttggctgctgtcttatttgtccttaaataatttgggtgatccacctgggcattaggtcacagccttgggccctctttttaaagcacttgcatgcctgggaagaaggtggtaggctcttacagcagcaaataagagtgtattgcttaaacctctctttgaaggcagggagggcgagggggaggtgtgagatattttaaaaataagatgtgctgctaaattctctgccaacctccgttcatgctgagtggagtgtaagtaacaagtatcagatagttcctccagatgtcagctatttaaagagtcacatgctagaagttctgtggatagcaattgtcttattcctggtggtggtggtggtggtggtggtggtggtggtggtggtggtgatggtggtggtggtggtggtggtggtgatggtggtgatggtggtggtggtggtggtagtgatggtggtggtggtggtggtggtgatggtggtgatggtggtgatggtggtggtggtggtggtagtgatggtggtggtggtggtggtgatggtggtggtggtggtggtggtgatggtggtggtggtggtggtgatggtaatgatggtggtggtggtggtggtggtggtgacgatggtattaggaggtggatgctgcctcgcagaaacttttatcagcaagaaagtgtgggaatgtgtttgtgcatttgagaagtaagacaaattagaccagagggaaaaaaatgacctaataactcaggaagatcatgatatcaacctttgtacaagtaacatttgatttttaaatgtataaagcaagaagaatgtccaggaactctcaattcctgtaaaattattgtattttccttaagaaattaacttataggccgagaaattatacaataaggaaaatgattcttattcaattttaaacttttctctactgctttacctaaaatagactggaaaaaaaaaagttgtgactgttctcttttgttatctctttgaatcccagtggtaaaggacttcttcctacaagacataatgaattgatctgtttaagttagtaatcactgtgaggaagtggtagggtcaagactgattagagtcttcagaatttccccaccagttcaaatgatgttttcttacactcatgcttaaaagttctgcataagggtcacaaaaattgttaagcttcatttcttctcttctcttctttatttaatttttggagacagagtcttgctctgtcacccaggctgggatgcaatggtgtgatctcagctcactgttacctccgcctcccaggttcaagtgattctcgattctggtgcctcagcctcccaagcacctgggattacaggtgcgcaccaccacacctggctaatttttttgtttttggtagagaccaggttttaccatgttttccaggctggtctcgaactcctgccctcaagttatctgcccatctcggcctcccaaagtgttgagattacaggcatgagccaccacacctggcccattccttatatatttttaaaaataacctgttcttcttcagtttctacaaattctggctttattcttttgcttaatttgaatttcagctgtgttaataaccagagggactccaaaggatgtagttttataatttctctgagggtcagttcttccagttttatatggaagagaaataagatagctcccagctcttggctcattgttggtgacaaactcaagtaacaaacactgcctttctaatgggagatatcattatgctcaattcctcctagtgtctcttctaaaacagatactcagataaaacacttatctctgggagaaacagataggcagagaaaagaagggtatgtgattaagtgaaggtagcatttctagaactgaaactttgtcttttccttcaacttccatggcccttttgagtaatagaacaaagtagagataggtttggttgtgtcaaacacagtgggatcagatgtccttcaaacagactttgagagacagtgtggtcatgggttttattttttttcctcactttttcttttctggaatcttctgcaggcatcccaggttgagacacttgcaaaaaaaagataagaggcagctatacaggggagaatcgcaacctgtgtagtcaccatgtgaccacttgtaaaacagtcccagcatcccatcttagtttgtcccttggtagggcaaggaaggttgtgagcttttgttcgtgatgttaaataaagaacattgtgtgtcaaaagaagtagacttccttatctgctgtttacagctatgaaagaggaggtgttggtctttcttctaagctctatcttccagcttttttttcctaccttctgtttcacatgatctcatacagaaaacttctgactttccaatgtagggcttgttctgttgtcagcatttgtagtcagcatttctctagtgtttttctaaaacccttatctgcagggaacgtcaacgtggttgtagcatcaatagaataaggttttagttatatatatatgtatctacatatatatagttatctatatatatagctgtatatatagttatctatatatagctatatatagagttatatatatatagctatatatatggttatctatatagctatatatatagttatctatatatagctatatagttatctatagatagctatatatatagtttatatatatagttttatacacacacacacacacacacacacacacacacacatatacacacacacttagcttttctgtttcaactttgagtcataatgttgaatgaaaactgagtccaagattgatattctggggtcatctacatggagcactgaactatcttcagtgcattacatgggaaggttagatattggtaagaaagttaggaaatcaatctaatttctcctattctgtctcccccacctttccttttaccgtccattgtgtgcagaattcaagagtgccattcactcagttgtgccagagcataattgctgataaagtagagctgatgaatttgcactatggaatgatcctggtcatatgttttcctgaaattttctcaagttttgcaaatttattttctatttcatacttgtctaatatttttgatatgtacaaatatgtatctaccttattactttagtgagatgggactcatgttctctcatacacaaatacatatatcttatgtatttaaaacatatccatatctataaattatattttataagactcacatatccatatctataaattctattttataagactctagctaaaactgagtagtgttttaagaattgttaaaaaggcagacacgtcttgggatgctagcaggtgggaagtatgatctgtccttaataaaacatgattaatctcacaaaaaaggaaaaactctcccatttaaggcccagagaactaggctaaaccagaaaacagagaggcttgtgttggggagtacttttgacagatccctcacccccatccgcacagccacccacaacataggtgtatattgtctctgtatgatttcgtatctggtgctgttctgcacttctcagtttgggggctgaattcctcagcatccttgccacattacagaaatagaaagcccaatatcatagtcacaccaccaccccacttgccacccacaatgtaacagaagagcaggcagccctcagtttccgaaagggttgtattctcaatgttactttataaattctcagagctcagattatattttccagagaaatggtatattctctttccagaactcaaacacctactaacccagaatattcccaatgtcctagtcaagagatactatagtcaagtacctggccacataggaaatgctttctaaaagggtatgtatttggaattttaggttaggataccaatgacatatttttcaccattacagatttgataacaagatctgggctacccaaacacctacttgctgtctgcaaagatcctaggctagttagttctttatccaggttcatggcaaagtttgagaggagattcaaaggtaagaaaggggctccagctggaaaaggacatggtgaggtgctggacttgatgtgctgggaaggggtgaggaggagggtgagatatatgtgaggggcataatgggagcagtgggaattgggagacacagggagaagaaacgaaagctgaaggagtggactttgagggttaacaaagaagagaagcagaacataattcaattcaattcaacatactttgttgatcacccaatctggtatgtgccagaaaagtgagcaaagttgaatgagatgtgttctccacaggcgagatctcctgtaagggaaggagaaagggacatatgcagatttgcattcttggagcagatctgttcggttccagactagagatgcagaaagggcacagagaaggagagatttatcctgacttgaagatgaggggacgtctcatggaagaggaggcagttaagctagacctgaggatgctaagtgcctcacataagtagggaaagaaagcataagtccagtctgggaaaatggtgagtgagatgaaatcccacagataagaaaggtgctgtgtgtgtgtgtgtgtgtgtgtgtgtgtgtgtgtgtgtgtgatggggtgggggcggggggatgacaacatgcctacagaatacagggggatgtgaaagaacaatttaccttccagaataaacttccttctttagcactatgcacatattatcttggcctctaatgagactgcaatcctgcgggcaagttgtggttctcatgggatagaagaagtgaggatgggagagggtaccgaggaggggctctgggactttgagaatttggcagtttggggctagtgggcaaggagatttttcccacttcttgcttctctagatcaactactacctggcctattgtatgactctcagatgctaatgtggtgggagtaaagaaggaagcatgtccttggagcccagattatatttcagggtatccaaggcatcagagaagggaaacacaggggaaggaaatttttagaggaaatgtggaggcttggaatgctccacatttatacaatgtttacacactcaacattgtataaaaccagtatgaaagacaggattagtctgaatttcatgaaacattctcttgggcccctcctgcccacaacttcttttaaaaggaaaaatgaagtgcccaatcctcacatttcttcccatgcaagtgaacccctgaagaatggatgctgaggttggggctgctctctgatcagcaaattctgagatactagaaaaaaagaaggaggaagaggaagagaagcatgaggaagaaaaagaaggataagaggaagaaaaagagggagaaggaagaagaaaggaggaggaggaagaaggaaaaggagaagaggaaggaggaggagaaagaggaggaggaaggaggaaggagaaaggaggaggagaaggaggagaatgaggaaggagaaaggaggaggaggaaagaggatgaggaaagagaaaggaaggagagaggaggaggaggaggaagaagaagaagaataacaagaaggagaagaagaatcatttttccaaatatttgtcaaaagcataatgcttctattaaaatgttgaagtgcatatttatgtttcaggaatttggggagaggacaaatgtgtacaaggaggcagtcactcctgtaagtgctgcacacatacagggccttcaaagcaaagagagagttctgcatttcagggaaggcaaatggctatggacattcacagaaacctggagaaagtggatggctcctgggtggatagcaacactgataggtacaaagcgaagaaggaggtgggtagctttcggactctactttatcatcttttagggcctgtgtatctgactactgctgggattgaatctgctggatgtctacagctggaggttaggggatttcacacttaaagtatgggtgtgtgcatgcatgctgtctgtggcctgtttgtttgacctcagtcttaatgatgaactaccaggaaaatggaatttgaggcactcactacctcttggccattcctcaagtgaaaggacacaaagactttatattaagatttatagcaacttcaaagctataattttgggtcttgaacacatcctttaatggaattcttttgttaaccacacatatagaaatctccatgttttcagccacagaataccacatctatataacagactaggcaaatattggcatatttcttttaaaagattaccaatcttaccatttaaatgaatatgctgaaatttaagtattatgttcatatctttacactttgaaaaacaggaagacatccctctgccctagctcaggagctcaggtgaaatgataaaatccggggaaaacatgttttggtactttggtaaatgtgtgtgtgtttatctcattcattagtaaccagagacaagcaggaacatgttaaccatcaaatcaggaggtgggagatcctggatctgatttttacttgtttctatccatttttgagcactatgcctttctaggatttgaatttctcctctgtaaaatgagggaggtaataaatggctcttaatgaaaggtaataaatagtaataaatgaagtaataaatggttcttcaacatttctgggtcacgaagttctttaaaaatataaagaaatctttggactttttttccagaaaaaaaatgcatacccaaagtaaattgaatatagttttggaaaggagtttttatcttatcctaccatagatattatgtactacacaactccgggggcacaattcacagactgtggtgtaaatgacaccaccttggaggtgggcaaagaggtgactctctttatagcagtaccttgaactccaagctaagaactcttttgccagatgagctttaagattctctctggatctgaatttcttcaattccagaaatgtcattattattaccaacaaccctatactaatctggttaggccatctttacaaaatactacagaatgtgtagcttaaacaacagaaatgtatttattttattttttatttttatttttttgagacagggtcttgctctgttgcccaggctagagtgcagtggtgactcacatggctcactgcaacttccgcctcccaggttcaagcgcttctcccacctcagcctcccaggtagctggggttacagaagcccaccaccatgcctggctaatttttgcatttttagtagagacagggtttcaccatgttggccaagctggtctcaaactcctgacctcaagtgatctgcctgccttggcctcccagagtgctgggattataggcatgagccatcatgtccggccaacaataggaattcattttctcacagttttagaggctggaagtccaagcttaaggtgtcacaaagttaggtttcttctgagatctcctctctccttggcttgcaaatggctgccttctctgtgtgtttacatgatgtgtgtgtgtgtgtgtgtgtgtgtgtgtgtgtgtgcgcgcgtgcatgtatgtccccaaactccgagtgtttctttgccttcttataaggacaccagtatattagattagtgcctcacccttatgacctcacttaaccttaattacctctttcaaggctgtatctccaaattcaatataggaattttaagagaacacaattcagtctgtaacaaatcccaaactgataaacacattgcagagagtaactagaaaaatcaaaacatctttcagatcccttctacatgcaaataagtctatcaaaaattagaatgaagtatgctacttttcaaaatgggaatttatgataaataaccagaatttatctgctactatgcttactaaaggggaaactgttacagaggtttatttagtattacatatacacgcatgtatatatctagtatatatgtgtgtgtatatatacatttatttaaaaactaacttgatgttgtataaaataaattaacttttaaattaactggccaaatgtcgtatatagtaggacaaagaatgagttaagatggaaaaaattttaataacctataaacattcttagtttttgtttttctttgggtcctccaagtgatcatcttcgtgtaacataaatcaaacaaccaaaaatctcttccacatctggtaagtgagggtaggaggaatgggggttgctcttttttttttttttttttttttttaaattttcctgatttttctttaactataatggaggatcaggggctgagaagaaaaggccaagagtttcttgtcatttttatttatgtatttattatttctcccccagtgccacatatagtaaccaccaccttctgagtaattcccgaagcaacaaccattctacaccccacccccagttaccctagtgccaatggtagctaaagaagagaaatgttcaagaagaagatttacatattgctggatgttcttattcttaaagcctcaccacgattctatggctgtatagtccattcagcaatgagtcaagcctgtgagttagcagtgttacagactcaccaagaatgtatggcaccacccaatagcatactgtcctttcatccttttttgctttgcatgtactgacctttttctctattcatcttctgtacaccgacaaggtatacattttaggaaattacatctatcaggcacaatgactccctctgtgatgtttcactcccacgcaacactcccttggatgaaatggcttgctctctgcctgaattgggctaagatatatgcctgctgagggcttctgccctcccatctctcttctaccacccctgccttgtgaattatcttctttattcctagggaatctacagtaaatactttgtcatctatagtcatttgcttgaaattaacaggtgggtggttggccaagcaaggcaggagagacgtgggacaggaaaaataaatagtaggcacaagcataccagcaggtgttattattccaaagctgtgtagctctttagcccctgtttctattataaaaattaaaatttttaaaaggcacctgggaatctataggagagagtcagtggttaagtgagttgcctgatatctggcaattaatgtttgagccagggactaaaatccagatatttttgattcctaaagtgtgattaaaatatgtctcaaccatgacatattaaactattggaaatcatacgtaatacagtcctttctatattacttcaaaacctggtttaaagaaacaaaagtatgatttttttcatgacttttcaaaagccttctgattttctccagctataaaggttatatatatatataacctttagagccaaatatatatgctttctcttctttctcttaaaggtaagctttatgctcattattgggactgatgttattgatcatatcagacttctcttttggaataatgtttccaggattttcactttgagaggatcaaaacccaaaaaacatcagatgcatttttctggcatttagttcccaggttgggcagtacattttcaaagtataattgattttgtcaaggtcttgagtttgggagtgaagactggagtatcaggaaatgtacatctctagccatcaactagtaacaagaatggcgtaaatgttctagggactcactctgacatccaaagggaagggagcaacttctgagattaagagacctttggttttgtgatgggaacacaaaaagtaaacctatttgtccatatctcctaagactccaacaaattatatgaacaactgcaagttatctgaatatggaatgaattatggatcatcaactaatttaatgtaaccccaggttgcaattcccgtttttagagaggtaacacaaaatatttttaatctctaaattgtaaattgctcaagcaccatgtaataaatatcaatatctaacacaaatgttttggtcatcacttaactatcatatatataattgaaagttgactgtaagtattgcacaggagggcacaaaagatatgtaaactaattattatccagtagtccacactgactatcatttgtatgtcatttgttttattttattgcaaagtaggcatgttgacacgtgtgttgggtgacctgttataaacatatagaaaaacaaaaggagagaaagagagataataatttgatcacagttctctttctaaaagcattgctttaatattctcttatatacaggtagtgataattaaggatatagaattattttctaaacacgcataaatttatagttaagagaaagcatctcatttcaatgataaaatgagagatcatttaattttttttttttttttgagacagagtctctctctatttcccaggctggagtgtagtggtgcaatcttggctcactgcaacctgcacctcccaggctcaaccgttctcatgcctcagcttccctagtagctgggattacaagcatgcaccaccacacccagctaagttttgtatttttagtagagagggggtttcaccatgttggccaggctggtcttgaactcctggcctcaagtgatccccctgacttggcctcccaaactgctaggtgagctaccacacccagctaagttttgtatttttagtagagagggggtttcaccatgttggccaggctggtcttgaactcctggcctcaagtgattccccctgacttggcctcccaaactgctgggtgagctaccacacccagctgagatcatttaatttttgatcacaactattgggagtattttaaaattgtaattgacgtagactggtatgacattggggactgatgatatggaatgttattgctgattcttcagtatgtggacttcttgcattatgttccatatattcttaaaagaatggggctctcatataattttatttcagatatgtccattatttctggactgttagttatgccatttaaattaggtatagccttgctacctttttccagcttatcagttttaagaaagatatggtaaatttattcaactaatggtaaacactttttctaaacattgttctaggttctgaagaatcgacagtgattgaagaaacaaaaacatttactcccatggaacatacattttagtgggttttttaaatcacagatttgtcattttttttagtcagtgtgtgctttatatattttgaggttatgttattaggtgatacagatcaggactgttacagctgatctagttaattgtttttcttcaggatataacgatgtttttagatgtaaagtctattttgtctggcaataatatttccgtatctgttttcttttggttaacatgtttcaagcatattagttagaatatttgtttgacagtatggtagttctgcttctctaggtcacctccagatccaggttgcctttttcttgttgctcagccacagcacattgggcaacctatcagttcagcaaatgttaaccagaagaaaacatgtggtaatgtccacatgggcaaagttggctcatcacctcatccacattccagaaaaggggcaaagagaaagcagaaagaaaacgtcagcctcttaaggtatgacttagaacttgcacacataaattgcataggatttagcaacagaatagtaatgccatttagaccgtagacacagtagataggtggtttgggttcaaatactggctctggcacctcctggctgtgtgagtatagacaagttacaatctatgcctcattttctccaattgtaaaacagagatacttataataatatatatcttatacacattaatcaagtattggttattattattacctttatttttcttctgcagtttctagaatgcctttgtttaatcacttcaaccatatttattttggcaatgtatttcagattgttctattacgtcacattatttgatcccttgttctaccattgttgtggttattaactctctctcatggtggactattttcttactaaatttttatttttcttattttattttattttattttttgagacggagtctcgctctgtcgccaaggctggagtgcagtggcacaatctcggctcactgcaagctccgcctcccgggttcacgccattctcctgcctcagcctcccaagtagctgggacttcaggtgcccgccaccacgcccggctaattttttgtattttcagtagagacggggtttcaccatgttagccaggattgtctcgatctcctgaccttgtgatccacccaccttggcctcccaaagtgctgggattacaggagtgagccaccgcatccggccctatttttcttattttgtactgaagtttatgatactgtaggagctatgcatgcctcactctagaagaaaattccagctattctgacattaatatagcatatgatactaaacaagtcactctcttctgtatctgagtttatcctaggtatctcctgaatagctaacatccttctttttcttaccggcgactgaggagagatggccttgtgttggttagacagagcaaagtagttctgcagtctgtcccacggttctcaggctacacgtctttatttagggtgattcatttttatttatgtttagcccaccatagttccatgctgaagaggtaaggaacaatagggtaagcaagccagccagcatattcttcccataccgatgagcttttcaccagaggaaaatgccctctcagatcacagaaacagtagctgtgtaggtgttgctagtggagaaaaaaaaatgtttggtatttaaaatagaaacataaaattgttaataagtctacagacaacttgtattgcatgcagaaataaaaaatgaagtcctagtacaacaatactgcttagtcttggattcattttacagaagtttaagattcctcacctcaatgaatgagattttaataaacagaagtgtattagaatatttgcagcatccaggcattgggtttgagcctcaaaataaggccagggatgacatttaagtaaattcagaagtaaaaagcaaatggaaaacacttttaatgatgtgtcacataatgtaaaatgtgaaaaataacttagaggttatatactccatcctcttgcttcagggtccctaacaggcatctctcacttgagcataccctgtgatggggagctcactgccttgcagtgaatctttgattttgctgtggctccaaatgttggaaagtgattccttatgagataattgcatattttggaggttcccccaccacacacacatacacagaagaaatgttctcccctatagtaattcaaaatatctcgatagtattgcacaaatatccattaagtgtctcctatgggcctaaaactgtggacaattggagataaggaatattgtcgttttcattttgcctgtgagaaaaagagttttcggaggctaggtaacttgtccaaggaaacgattgagcagagatttgaacttaagctctctggccctggaatttaagctgtctggctctaggactaggccctcattccctgcatgatttcagaattcatgattccatgaatcatgtagggaacccagatataaatcaactgataataacagaatgtggcaagtgtgaacagaactgtactttaggaagctaggaaagaacaactaattctgcctgtccagattggaaatagtaagttttgaagacatagacaccatcaatgccaaagtattgttatcataatgttgtttcacctattttaagaaaaatctgtttcttctacctatgacataaacttacatttcagtatcccccacctcacctcgtcatcagttttagaatgtgctaaattctcaatactactgagaaatgcccttattccccatattgcaaagatttctggggctgcttaataacactttgtaccttctgttcagagaacattcatcttattctcctctcaaattctctgttaagtaaatttaatactacatagcatcaagaggaaagtgaccatttattttagatctgtatctatcttagacgatgtacttttcatggaatagtgagtgagacagacacttgagtcaggtgatgtttgaactaggatgttcccagaattaaatggtagtctcttaaattggatctcatgagtactttagtatctgaaaagtaactacatggaataaattaaacagaggaaaactcctggctatgccattattaaacttttttaaaaatatggtctttatttgacatttctgagtatggcaacccattccttggaaataaagaatgtggcttccaacacatgagtttccccctccctctcccctcccctcccttaccttcctccttcttccttccccttccctttctttcccttcccctttctttcctttcccctttttttcccttcccttccctcccctcccaccccttaccttcccccttcctgtctccttttttccccttccctcccctcctctttcttccccttccctttccctggcctgccctttccttccctttctcccttccctcccttcctcttcccttcccttctcctgccgtgccttgcctttctgtatcccatggaatacctctcttttgcattggaagaaaaacttgatcccttttggagctctttgggctttaaaggtttaagtgccaagtgaacgctgggcttgtttgcctcctttaggaagccccgtgtggatgattccacccctcattgataatcttcttactttacactcccctttctctgccaatttaaaatcattcaaaatcaagttcatcataatagtgaacgtcaatttacaatgctcttttccaagataacttcttttcaaaccctcaaaactattctatgaggtagagatgattcatagttgtacagttgaggaagcaggctcaaaaagtttaaggtaacttgttcaaagtcatatagccagtggacccaggatttgaactctagtcttttaacactcagtttacgtgttaccttgtctatgaatccttcttgatggtccctgctttccctgccgtagatcagtagatcaattccattctctattcccctgtgtgctttgtttatacctttgttctagcacttatcacattgtatttgggaagcagtgtatttaaatggatttgtggctggtctaatttggtttaggtttttttttttttttttcctgttagtttatttacttcctaaggcctgaaatctcttcttcattatttgacctgctggacttcatgcagtgctttgcccatagtatgtataaatttagtgttcatggagaaaatgaatcaatgcaccaaagtgaaggacaggggctgcggtttctttgtatcctgagtggaacctagttcagaggtacagtcacaatcacttttaaaaaaatgttgaataataatgaaatactacataaatccaatagaaattcttaaaatatttagaaggcatgttttctaggaagaaggctaattattagaatttattttttattctagagaagaaagagagaaaataaagaattaaagaaataggaaagagaagtcactagagagccctttcacgtcccagagcagattaggatcttgagagctctaccctactctgacaaataattacttataaaacaattctggggtttcatagcctgcattacctggttccagggaccaatcatgagcttcgttgttttggagttggcttggaggacatttataagaaacatgtgatgaagttgcccctttttctgcagaagataggcaaagagaatcccatgagttgggtaacatgtgggacagattttgcattccgtgatttgaaattatgggtgggggccgggtgcggtggctcacgcctgtaatcccagcactttgggaggccaagacgagcggatcacgaggtcaggagatggagaccatcctggctaacatggtgaaaccccatctctactaaaaatacaaaaaattagctgggcatggtggcttgcgcctgtaattcccgctactcgggaggatgaaaaaggagaattgcttgaacctgggaggcggagattgcagtgagcagagatcacgccactgcattccagccagggcggcaatgcaagactctgtggccaaaaaaaaaaaaaaaaaaaaaaaaaaaatgggtgggagggagggtgtttactccctgccctggagatttgtataaacaggaaaagaagactgttttcttgtttagtcttttaaactaaagacttttctctcatctggagaaaaaaataataatggtagtaataataataataataaaatgggccgggcacggtggctcacgcctgtaatcccagcactttgggaggccaagacgagcggatcacgaggtcaggagatggagaccatcctggctaacatggtgaaaccccgtctctactcaaaatacaaaacattagccaggcgtggtggtgggcacctgtagtcccagctacttggaaggctgaggcaggagaatggcatgaacccaggaggcgcagcttgcagtgagccaagatcgcgccactgcactccagcctgggtgacagagtgagactccgtctcaaaataaataaatacataaaataaaataatttttattattgatcatttttgtgtgtcgggtactatttctagacaatttacatgtattaactttaaacttgacaacaaacctattagatagatggtatgattactcccatttcacagatgaagaaactaaactacaaagaagctaagatcgagccgggcatgatggctcacacctgtaatgccagcattttgagagtccgaggtgggcagatcacgaggtcaggagttcgagaccagcctggccaacatggtgaaaccctgtctctactaaatatacaaaaaaattagccgggcatggtggtgcattcctgtaatcccagctactcgggaggctgaagcaggagaattgcttgaactgggacccgggaggtggaggttgcattgagccgagattacgcactgcactccagtcttggtgacagagcaagactccgtctcaaaaaaaaaaaaaaaaaagaggctaagatcttggccacgttttcacagcagctaacaagcagaatcaggatttgaacctaggccgtggagcaccagagcccattctaaatctgaatgcactctcaaagtgtcttgcagggaggtgagcccagtctgtctctctcagacttcaagaccatttgcagtggtccccatacctattgcaatgattctgaataaagtctcctgtaccaaaaaaataaaaagtattctctaaatctttaatattttatcctagaaacaaatgagattattccttcttttattgtgataacatattatgataactcattttatttgattccctaaaaccggacagagatttccatggtgctgaggatacgaagtttagaccttcgatagctagtctaagcttagtggagatctgatatccaatctaagcttagtgaagacaaacaggttgtaaatgcccaaatctctctatgagaaactaattaagccctgcctttgagtaaaagagaaaaaaaaaaaaatgcttctatattaaaataacttcatttggagttcaaaggaagctaaataaggttttcacaggaagagttcatatttttttaatccttaaagtaatgtgtataagtttcaatgaagtaaatgtcccagctacattattcaaactcaagagattaaaaatattttttttccaacatccaaactcctgatatccctatttcagccacagggaggacaagggcataactatggatgtttattagaaggataagttaaagaggcagaagcagtatatacattctctaaactatacatttatacaaggatgccattgtctttttttaagcaaatacttgtagaagtgatgtctaaaagaataaagcttctcttctatatctccaaatagaaaatataatcaaaatccgcttttatgtaggatggcttttttaaataaataagcagaaggatgaattatgtggctataaataaatctactgacatgtaataaagcaaagtcgaactgttttatggtgtcactgaaacccttagatatatttatagccatgttaacagtccccagtattttttcaggacttttatttcatttcacattatgagagtttagttgtttgtttttctctccctaaattgccttctggagccctttgtagagatagaaagtaaggatctctactcttcatatttggaaaaaaaaagggtcttcaccgaaaaagcttagggctcacacagaaacagtcggttctgatgctttctggtctgcctgtttctgtgcagttcatatgagatgtgcctgcgaagaacaacttgacaggtagctcctgctggcagcaaagtggcaagtcagagtctatacaagtgaggagaggcctgtgcagagataaaatgtacagtactgtagaaaacaagcagatggacagagcaactttgcattagattcctgatgcctgacacatttaaatacaatcacaaggcttatttcagaagccaaagaatctccagactatcacatagccgaggcacagaccaaaacaagataaagggtctgatgggtaaagatgctcacaccttaccctgggacattctcttgcagggtgaggatggggggggggacatttaaaaagcaagaggagaaggtttataataccagttctaaagcctgaagtaatataggggttttttaaaattgtattccatttagaaatttcaggatccaaagagtatggttaggattccgtggggggtttattcaagtggagctaagcgtggttgttcctgtgaaattatttatatttttcaacttgaaatctgggtgagcatagtgtttctaaatctatttctcttcttttctatcttaaaagtggactctcattttcatcctgtagctatacacttgattcccaagtgttatcactcaagggacccactagaaaagccaactcaagaggaagaggagagcttttgatggtaggacaagggatgacaaatccttcagctggaactctagctacaggcagtatttagaaagtatcactggagctaaaaatctttaaaaatgtatttaatgtgttagactaatataggctctaaaagacctaaaaagaacaggatccagaaaagaagtcgaaataggaatgtgttaactagagggaggggcaggagggataagaaacacatgaaaaaattaacagtggggtaaattggagagggacattcattttattaggataattgggggttgtctctttgtagtggaagaagtaaaatagacctgtcttacatttgtcctctgaagagtcttctcagtatttaactgtgttcccaaatggaatcagccttaccaaaattcacggtgacttcttttgacattttgcaaaaagtaaataaataaattataagtatgacaagtgaaatgaatagttccagctgtgatgcaccagcagcatttccagattttgtactgcattaaggatttattttctctttattgcctagcagagaattaattggaaggtccatctaagcttcccacacatcctcagaatgaagtcaaagcagtctccaatgctcaatgccaattaaaaaaaaaaaaaaaaaagaaaaacagtaagtgggtaggtggtcagtttatcaactctggaaaagcttgtctttgaggattcacactgctaaagccagacaaacgcatcagcaaaattaatggcataaggaaaatgtgagtatgagattggcaattgattcactgagttcgttcattcagccagtatttactgagcccgtatgatgtgctacctattttttcacacacacagaaaacaggagaaaatgaagactcagccctcagagagcttataaccattttaaggagataaactatgaacaagtatacagataaaataatttcagacactggagagtgctgtcaaggaaataaaacaaggtaatgggaggggatgccttccaggggtggtggtcaactttaaatgaggaccagagagggtctctgaggaggtgacatttgaaatgcacccatcacatgaaaatcttggggaaaagccttccagacagaaggggccaacaatgctataaaggccttgggatgagaaaaaacttcccacgatcaaagcagaaagacctggggaactagagagtagggaggaatggggcatctggcaggagatggagctgaagcattagagttaagcagagtcatctaggccgccttaaggccaaaagtgcagtggaaatccacctggggactaaatcaaggagtggttgaattgagtggaaattatcatggatatttaggatattaagaattttttctggcttttctagcaataatagcataagaccctaaccatgtacttaacctgttcttcacctttttagagcttcagcttatttttctagtggacaaagaatattgccactgtttgtcaggtgctctaccagatactgtatattttctcattttaaacccccaacaacctcgagagggaggcatattcctcattttacagaggaggaaactgaggtttcaatggaatgtccataaaccaccccttccccttgctgtggtgtccctgagagcatgctgctggtttaagacactgcgtgggggcacacccaaaagtatgcaagaccttgtcagagggccatttcctggggggctgtggatcctggaccacccttacaaatgagagccagggcagttagggtgactgtgtgcatcatttactacgggcagcttgaagcttttggaggacaccaatttcagaaccagaataccagttcactgccataaattctgaaatggacttgatgtatgaccttgaaggcaaatcacctgtaggtttggtctttttgttagagagacataatgctgtttcctcaacacctccttggggtgtctcaaggatgaatagggctgtcttaatccctgttctttatcctcagggggtttgaaatgagagtggagtatataataggtgctataagctccttttaaaaaagcctcctaaatacaacatatatatgttttaaccagcaagtattgttcactcacctccccttcctccctgcaaatgtaatgggctttttacccaaggtgaatggtaggagggagtcaaagctagcaagacctgtgtggacaacaacctggcctgagagggcagcctgttgggtttgtccttcctgcgcatgagacatactggaggggtggatgccgcctagtccacagtgttaccgtgtcctggcagagccttgggtcagtcccctcctggagtcacagatggccacgacagaggacaggtgctgccattctggctctcccctgcgtgttcagtcgtgaggtaaacaccgtgctgtctttgatgcccagcgcccaggggacttcacccacctggggcagcccttctgcagccagttccggacaggcgccagtcacttctctttgagccagccgacttggccctctccccttctgaagttttttgatcaggactacaggcgcggacgataacctctggattttgaatcccaacagtgtcctatccaccaccgggggtggcagccaccttctggaaggactgccaatcacggagcccttcaccctttggagtccccaggccaccgctccaccttcacttttgggagtccggactcagattcccatcattcgccctgcgggaggggccctgggcattttaaccccgggagacacacgcgcctggagagtggtcgcccaagccaccgccaggcagggaggagcgcgcgtgcggcaccaccgcgtgcagcagctccagcgctcgcgctgcctcaaggggtttatttttatttctatttggagctacttcggccttagccgccgcccttacttttcctccgaaattgtgagaaggtgccttcatggctggagtttggtttcacgcgcctgggagaagagcagggcacgggtgataaagaaggcgcagtgtcggtctgtcggtgtcacacacgcgcgcacacacggcggggcgggagccgcgcgagcgagaggagggcgggcggcgtgtgctggaggctcgcgcgggtgtatacgagcctgtgcttgaatgggaagggccgggattccgggtcgctctggcccctccttcctccggagccagccagtccctcggcagagcgctggggctgcactgatttgctctcgggagtgcgctatttgcatatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacggtaggtctctctgctctttatccttttaatggggcatagcaattcgctaacccactagccttgcaggtagtgtcaaaggtgggaagggaatttaaaaaaaatgaatttaaaatgatgaaaagcatcgtatgtccatgagggaagcaaatttctactttctcataaaggttagtgttttctgcccctagcctccgacaaccatctccacttttctctaaagggttcttttccccttagctccctcattcatagctgcacagacaccacactctctcttttgcaaccttctactctctccacccccacggagacaggcaacttatcaggtgagtcccagtgctgtacttggagaaatattcattcaccttgctttcacccttctttgctgtggtcttgcttgggagctagtgggggtggggtgggaatagctgacaacaggaatcaggttttcagcctgaagttgattgaactgttataaagtagcctgtgtggtaatggtcagggaaaagtagccgaacataagaaggcagaaaatataattaacaacctgtggccatttgtgttgaatttggcagctttatgtttgtccacatatctagtggaaaaagcagctatctctaaaactacacatctactattgctatcagaaaggaagcaatatgtaagataaggctaagttcatttataatttacccaagtgtaaatgacagtaacttggattccccgtgtatgcaaatgttatttcatctttaggtagcagagatgggcttgttcacacaatacaggtacgatgggttttactccaaacaaccctccttacatggctattgagggaagagatctatggctctgaaaatgatactcagctgttagccggctgcctctaaaagggcgatgtctgcagctaaggtaggagcttgctgtggtaaactgttctaaagaaaggagcttcttaatttgtttactatgcactccactctgatggtaaggagagtaggacacacagaaatggagactggtcttgcttgggagctagtgggggtggggtgggaatagctgacaacaggaatcaggttttcagcctgaagttgattgaactgttataaagtagcctgtgtggtaatggtcagggaaaagtagccaaatataagaaggcagaaaatataattaacaacccgtggccatttgtgttggttttggcagctttatgtttgcaggaacagccctccagggaacatgagcgtgaaccatactagggggttcctgcccttgtattttgaagactgataacatccagaccctatttggaaagttgattcttcctgctgcctcctagccctgagctttggctttatgctgtctgtagtgtaagtggaagcacattgagaaaatgccagcacatactctggctctttttgactctgtctttaaattttatttgatggagttgtcaagcagctcacagcttgtaaggttggtggagggggatggtgaaaagaagggattgcttgatcttgatctggtggctcttttctctgtgactcctgctgggtctggtgttggctcccttaaaaaagaaagaagcaaacaaacctaggagaaaaaagagccacaaccaccaaaaaagcaatttcattgacatggaaacttagctcctaagggggagagggactggggggagcgggtaagacaggaaaaaaagagggagtgggagataggggaagccagagagactgttactaatagccataattaaacacggaaatgctcagagattagctaaattttgctaattactgtaaatgatcagcagggagaggaagattatgcattacaggttatgggtggcagggtcttgatatcttttgttcgggttgtaaacagttacagcagatactagtaagtgatggaatttgcagagcagtacttccctagggtccctaagtcagagtcagtctctctctctctctctctctcataaaggggttgagccttgcacaggttaaacatgaccctttatttagtttatttcttcaacgattggttgctcagtctcctttaaatctttttgactggtccccagtctagtttctcattaacctacatctgataaggttcagtgtgatggaaaataagaagaaagtaagtaaatggctagagaccccagaaaaggccctcagactcaccagagctgtagagtacagtgaactccatccagggtctggcatggctgagataagaaaactcatgaattcagctcttcagaatcctctttcaatcctgaagtcccaactcattgatttggggcttggagagtgaatgcatctgtattaagtagactccttgcatatttaattggtgtttttgagcataaaatcaagagaagcagcaatcaacaaaatatccctacctctggcttccatcctgcacccaagctgtgaccctttgcgtctctaactaaaaggaccagaagaccccacagagctttgctaatgcacttctcattcttacttggtgtacacttgctttttcctagtccaagacaaagacctagctaacagcaattgttttaaaaaatatttttggatggaggtggtaggaggcatggcaccaagagactgatggttgttattgatgatttactgccaatcttattccagagttaaaggcagcactctctgttgtctgtgaaaaagtaaatgcccttgattttggtatgaaagaaaactagagccttgagtccaagaatcttctttggacttaagagattgttgtttttttaactacacttgctcttcccttgcccatttcctgagaagccaaagtcctcaaagctgctgttcatcagttggtgctcccaccccctttctctactatccagacctatagagagattcatgctaagacagatggaagaaacagaaatcctccaaatagctgatattttacctacacttttgcctgtgcttggttccaagctttagaaaattggttatattatagatttgcttaaagcctttatcccaggacagcctagaggatgctgggattctttgtaaattagggagactaaggccacacttacctggggtgcccccaaaaaatctcacattaggattgtgtttcaggataggattaaccttcttcttaatgggaatctagtaggctcttccccattctgttagagtcctcaccccactttcatgctctcttctgttcaccagtcagtcaatactctttgagcacatactctgtgccaggctgtgggctactgctgaagatacagaaccgaataagacattgtggtgttcagctaggaataattgcaaaagtatatatatatatgcttccatattttaaaaagtgcaaggagtgggtggagatccaaataccaagcgaaattaatacaaaatcaaaatatcctttataaaatgaaggtttacattatcctgttatttaaaatatccctccaggttccttttcatccttggctttatttccatatgtaaatatcattttttatcaaagtgcaaggtagtttagtgattacagatatataaatagtaaaatatatttgtttaccaagctttaattacataagcaacttttgtatattttttccttctttttttccctctctctcttaaaggtcattggacctttaagaaatccaatgtgtctgggcatggtggctcacacctgtaatcctagcactttgggaggccgaggtggggggatcacctgaggtcaagagtttgagacctgcctggccaacatggggaaaccccgtctctactaaaaatacatatatatatatatatatatatatatatatatatatatatatgtatctccaatgtacatctgcctaaaaaatgcttcagtatttatagtttaaatgcaggtttctctaaggattcaaggttttatatgtaccttaaatgctattctctataaaacagcagactttcctgcctctgtagacgatttgtggggactagttgaggacatggaactcttggaaagctcagttttaaaagggaacacaccacgctatatttgcaggaagaactcttgctcagaaaccagggtgtgtgaaaagggggagtataaaagtcctattcaaaccatcttagcagaagtggtggtgatgggcccccttgtgacacatgatcctggagtctttcttggactcattccttgtcccagggatccacccccaaagttttttcagccttgggggcttgttttgctttgatctattgagtgccttcttctgctcagccagctgctttctaaccactttctttatgcctgccttcttgagattcagggagttgaataattcatagtgttggttgacagatcaaatgataagatttatatatctttggccttggtgatgaattaattagattggtttctccatctttggctcctctagatgcgttgtttttcttctttaaaattcactggtgagtggtgggtctggagattaacttgttcttgagagaccaccataggatgattataatatcctagtgtcaatttcttcaggactttcaacatggatcactgggtggtgtggagtaggggcagctatatcatagagaggagagataagatcatcagaacaaaaaacaagacgcacacacacacacaaaaacttgccgatactggctgcgggatgaaattttacagtaagaacttgattgctttcacctcagattttgaatctaaaagagaaatgtatttcattttacattttagtaaatgaacttatcagcccaaagaagtttgctttactagaactctgggtgaccagggagggaagcaaatctctgaagataaatcttgaacttactcatactttcctccttgtattagtttgctagggctgccataaagtagtaaagtactatagactgggtggtttaaacaagagaaatttgtttgctcaaggctctgtagagtaaatgtctgagaccaaggtgtcagcaggtttagttctttctgacatctctctccttggcttgcagatggctgttttctcactgtgtcctcatagggtctcaccttgatctacatgcatgcatccctggtgtctttgtgtgtccaaattctcccttcttataagaacatccatcagattggattagggtcctccctaaaagcctcattttaacttaatcatctctttaaaggccctgtcctcacatacactcacattttgaggtaccaggaataaagctttgacatatgaattttgaagagacacagttcagcccctaatgctctttctcctcaccgtgcgctgccccccaccgccccccaccatcccccgcccagttattgggaaagaagtaaaactgtactgttcagtgaatacccattggactcaaactttcacagcagaaaaataaaacttcagtgacaatggttgcaatttacaaaattcataagatagtgccctaagaggtaatgttgtgtttacagatatggggaaaaaaacagctattggttcagtgaagacttgtgttttctttcttctcagtttatcttctgtgactgagtccagatctttatttgcacatagactaattctgtctgactgcagacacatgctctaatgtccacacattaaagctttctttacctagacctgctacccttctgacccagaccctccactcctgccactgactcctttatgaactacagttgtttgctctttgcctttcctgaaacacaaattaccaactactttcacatctcagcctttggtgaaaacaagagaaaaaataggttaactaagtataaatttctcgtttttcaattttcatatttctcaattgaaaaatatgttaaataggcatcagtttaattatttttctcttcaattttattttttgaaagttcatctgaaaatataaatatgaggtaaattgtctacttcatgacatggttatgaagcttggtgagatgattgagagaataatatatatatatatatatatatatagtgtatatataagttctggttgttctaaatcctaagcaaagcattccatctttggggaaagggtatacctttctttgtctgtttgtttctgtgctcaaaatgcgtgctgatgttgataatagataaataataatggcattctggtggacagtgtggtgttaggtgaggtgggaacaactatggttggaggaaatagccttcaacctcaacctttggttctaagaaactttgtctctaagaaactaagttactaagaaacattgtgaacttaagtcacaatgaataagtcacttggtttcactgagactcaatttcttcacctttaaagtgagcaataataatagttaaccatacttatatcacagaaattgtatgagagattaaacaagttgtattttgtacattctaaaccaatgtgtacaggttaaatattttatgagacatattttcatgataaggctgccctctttgaattccttgcacaaagaggagcttcaatgttgatcatttgctggttggtagatagtggttaaagaacatgcatctgctggttctcctcattttcctatctatacatacacttttttgcctcctagagattatttcatttacatagtactctgagtaaatgtagatgagaaacactttactgtattttcatgtttatggcactagaacacagcatgggacaaaagtcagcttgtgatttttggtaatggtctgcttaggtagaaagtcatgccaggcaaattttagcatggaccaacacattatagcaaatcatttagaagctcagggattcagtaaagtgaaaagagaggactccaagaaatactctgagatcattttggaaattcagaattggatcccatttgcagtaaacctgtgcagaattcaaacattcctacatggttctcagtgtccattgtaaactaagatttttaatctggtttgtgctgggaagaagcaggtgtttttagggacaactaccttcagatgtggaagtgaagtacttcttttaatgcaatttcttaggcttactagggctcaaagtttgtagagcagataggagcacaatattatgccagaactcttagaattgactttgtgaagcctgaatttgaaacagaattcttactgagagacatggtcctgatacatagattttgccccagttttctccctgaccagctctgtaactttgaattataacattatatttttaaattatattcatcttttaacttttagacattctgtgtgataccttgatttcctaacctatattcttggctttacctgtagttttctgcatggcatgtagtatgaaagctccttaataccatagctggggaaaactttccttttcatatcttcatcatttgtacaatgagagatttgagtgagatgatctctccaaatgttttccagcactggaactgcatgagtctctgatttgtatgtctttaaagacaccactgtgcatcttaaacctatctgagttccacaagtctgccagtattttataggtctattttcttgactatcataataacttatgccaaagccataagccaggttttctcttttcccctcagacagaagcagcataatgtaccagagtggcacactgtgatgttataaagcccacaatccaacttcagtgcagtcacgctgagatgggaagaatgcagctttcatttaaacacaccttaataatgctagaaaggagctctatgttatgtttaaaatattctgctgtgtttagccatatcagagcagggggcagactagcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacacaaacacatcaagctcttttgtcaggaatcaagtacacagattgatgaagcactttgattaatgcagctaacacacctttccaaagcatctacaagactttccaattcctaataagtatttgaatgttttccaatctgcctgaacccgtttcaacccaaggagatagtaaataaaaggagcagactgatgaaacactcacacttgatatgtctttttttttgaatgaatgaatcaatgaataaatgattgagtgaggttccacatgatcaaatctcttgcactaggaaaggagggatgctagtttataaaagaagcaaaggcacaggaagttatgcacccttcaaaagcacaccaatgggctcgtagaacttagagatataagagagctcaatgttccaggtaggcagggtgaggactcaactaagagcatccagttagtgtcaggactggtcaggagcacagacatcatgactctgagtccattgccttttctttcctctacttctcagtccttcaagacactttcttaaattacaaacttgttccccatctctctttcttcagagaaatctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctactaaaaataaaaaaattagctgggcgtggtggcatacgcctgtaatctcagctactcaggaggctgaggcaagagaatcacttgaacctgggaggcagaggttgcagtgagccaagatcacgccattgcactccagcctgggtgatgagagagaaactctatctaaaaaaaaaaaattaatcatgagaatccttctaataggttcctggctttgtgtgccaaggtagggtttcttggtgtgttctgaaggcttcctttgtataggaaacctcagtgtgaaaaagtgctcagattcggggttctgtgaaagatgcttcctgtcctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaaaaaaaaaaaaaatagccaccacgctggttgaaaattttaaaaatgcgtctatgggtcatttaatttcctggcctaaaatcccagatttatcatgagcaagcggtgataggcagcaaaagcattgcggcttctttacaattgataactaatagaggaactccaattgctttgaaaccctggttttaataaaagctgaaagtctcttataagaaaacaactggatcacaataaagcaaaacctcgtcagactctttgggtccattctagccactttctgatacatttaaaagtttgaaaagatgattaaagggttaaaactcagctgtggggagaatttggtctcatgaataatttgggcagagagaggatcctgtgatttggatagccaaagttttattgtttattttttccaggagccaattattatatatcttttttcattgaatcaatatctctgcataatggaatggtcacctttgaatgttctcttttcttaaaacaaacttcttagataagttaaacacaagatgataggaaacctctattttcataagaatgacaataacatctactttggtttttattatagcaattgatcactttttattatgcctaacatttttgcctttcaatatgcctgacatttctataaacgttatagttcatttaattctcccatgaagtaggtggagttgttttcccattttttaagttttagttatttattttagcagagatggggtcttgcggtattgtccagaccagtctcaaactcttgggctcaagtgatcctcccaacttggtctctcaaagtgctgggattactggcatagccaccatgcccagcccattttcccactttaaagaggcagactcggaggcatggaaagtttgagtcagttgcctaaggtcttataggtaatataaggcacaatcaggttgggtatttaagcagtttgaacctgtcctgttcaaactgcttaaatacccaacctgattgtgccttatattacctataagtatatactgaaattatactgaaaacagtatactgaaaacagtacaatatttcataaatactcttaaaatttcagtatttatgaaatattacctgaatggtgggaaaaaatttcaaagtggtattcttaaatggaatactgggccatttttaaaaggacctcttagggtctacctagatacaggataaattatgaagacagaatattttctaaacaggtaaacacctacctcatatgaggtattctaacaaatactttagcttactgcatttaatctttactgaccatccttcaaggtaggcactattgttatcatgaatttacgggaacagaaactgagccccagagggttaagcaactcactctagttcttccacttactaagcagttagcctatagcatctgttgaactcttaggtcaggtaatctgtgcaaatgtagaacagttcccggatactgaaagcaactaatcagaatgcttccctagattcacaaattctattacattataggagaggcttttcaaaacagcctttggaaactcacaccagttccagaatctgctggcaatgaatagttacatctttacatcttcaatcaaggacccaagagtgagggaccccctctcctttgacagggaagcccattggtgcctcattctcctcatgtttaattcactctaagaatccgtttttttcaggaagtttcttttccagtaattacgataggctttctccccaacttatgattttaggcaagcaaccaaactttcctgattttaattctctcacctgaaagacagggaactgtgaggtggcctgccagctttgctttcaaaagtgtggcattcatctttcattaatgccaaaaggcaaaattccaatgatttctaaaatacttcctcacccttatcagatcttattagatcaccttgaatctacttttaatcttggcccttcatacatatggtagtagttctttaaatatgagggtgaaactaatgaatacgttaagaggggcagtgggtttccaacttgagtgaatatgtgtgtgtttgctttcacatgtaggtaaatgtgtgaaccaaaataaacgatgtaacagaaaaccttcatagcagcccaattagttcctagcttagaatgtaaagatcagacatgagaactaagtctgccgtgcattacagacgtagggaggtttcagtacctgcttcttactgctctggtatcatttatcagtgcagtgttgtcacaggctcatgtcaacatgtcaataataatctcaggagaggatagcttttatgtgaaataggaaggtaaacctagagtcttggccttatacagacaacccccttctttgggatgactagtgttttcatgtttcttgttttttccatgccagggagccattttatgtgtgtgtattggtaacctcatcaactgttagctattaaagactggttaaactaattattattaagaactctctttcagaaaatcctgagatagttccttttacttcccttcacaaagtaacttgatattggtccctgagaaatagatccacaacctcatcaccaagttctccaggccctgaggaatgatcatgcccctaaaataatgttctgatgaaggactttctttggactcaaaatctgctttgcatttgtggaatcatcaaatgcgaaacctgcaagaggtctttagaagcccttttcaatcaagttatttttcatgtgaaaaagctaatagaccagaagtttgtgaatagttttcccaaatcacacttttcaaattagaggcaaggcgagggcaacgtgcaagctttcagcttcgctgtttagtctctttctagtctctttctactgcatcacaatgttagcactcaggctttccaggtgtcatctgttttgctgtggactgggaaactgggattgtctccagcaccacttggataacaaatgagcacagaaggagcagagagcagcatgacaaccaagatactccaaacactcgcactgtttcctgtaattaccatccagagagcagctcccactccgtgtcaggcatgtcaccccctcacggggtctcctgctttctctctgccccagcagcctagaggggaaattcagcatgctgcatttcaatcaaactgtttgatgagagcttttgagcctaattacatggaaggttttatccagtgaaaagaaagaggaaagagaaagagagaaattaaattgaagtataaatcagtcaagagcttagatcccgcgcttgctttctttttaatcaagagtgaaatgagaggagagttttaaggatcatcacaagacaccattaactacccaaggagctcttggctgaagatggtttgtcataaaaagaaaagtgtacaatctgtccataaagaggaagtatctgagggtcgtgctgcagtttaggagcatgacactaaaaggaaggacgcttggtttttccgtgattattttatctttatttcccctagatacctagcatattttctcgcacacattaggtgttcttgttctgtattttaaatcaatgacttggtaaataacgtagtgtgttaactcaggtaattattacataggaaagggtatgttatcaactcattcaatattagatacaacacatgaaatcagtattcaaagttttggccagtttccctttgtggttgatgtagtttgggcatatccctctaatattactgttatttatagaatgctttacagtgttacagagaaaattcacggtaattatttgatccacagcacagccttgtgtggtaggaggacaggtagtatgattgttatttattccatttttttaagctgatgtaatcaaaaccaaagaagcataaatgacttgatcagagtcatccaagtattaagtgacagagcaataactgctacccagcttctattacatcaccctgtatgacctagaatcttgtacagaatttctgggttcttcagtataagaaggataggtaaacagcagagaggagtgtttgcaaaagaaatgcattggaattcatactttattattgagtacttatgatgagcaatgcaaggcactggtccatgctctgaactggaatgtgaaacatgagctttgtccccaaaggcttacagtgtggttacaattcattaaaatgatacttagatctatcctttccatctctattgcattttcaaccatatcacctaaacagttgtgacaacctcccttaacagaccttccttagcttctgtttttccctcctgtccatgtttccctcaccattggagccatccatctgaaacaccagtctgatcatgccgctcttccatgggctcttcgtgtcatttcctctgtactcagaacaaaggctggccccttatctttatgatctggcccctgtgtatccccaacttcacctcctaacatatttgactaccttggccttcatctttttctttttccttttttccccccttgaatatatcaatcttgctactaccatagtgcctttatttgatcagttccttttctctgggatgttttcatccagattgccgtatggccactccttcttcttatacgtcaggcttcaacttcaatgttatcccctcaagagcccttccttaatgacccagtctaaaaagcactcttttttagaaggatcaagattatatgaaaaaatttaaaaaaataaaaaataaaaagcactctttcaaatgtctctccagcataccaccttgttttgttttcactgtagcttgaatatctctgttacagttccttatgtgtgtattgcttccattaacccactagaatgaaagttctgagagcagagaccttgctgatcttgttcatggctggactcccagtacctaaggcagtgactggcaaagactgagttttcataaatcttgctgagtaaagggatggatgaataaatggcatagatgcttcacaaatatgggctcccacctagcattttaacctcaatactcagtaggccctttaaaaacatcagttttagtttgtacttttcccttgattgagaatctctcctatttggtagactgctactaatttttcacgttgcagctgactccataatatctggtctgcaaagttttccctatctcccactgcacagtgagtttcccagccttctgtgtttacttttttcgctatagaagttttctcattgaataacaaaaattattaaacatatattcagtcttctactgttttccaggcactgtccagggtgtcagactcttaaacatacatcagatttgggccttgcctacaagaggttcacgccttggtggaagagctcactctcattttattaaacatgtaacattgcattgctgttatttattgatggtgattgttttcctcattaggctctgcctttcttaagggtaaggaatgagtcattcatttctatattttgattggctgacatagttcttcttttacaaaaggtgcttaatggcactcattaatgaaaaaatagagtgagtgggctgaaaaggtaagaacatacagtattttaatgcacgttgtagtgtgacaaacatcatgagataagtagaaactaccgtggggatttagaggggaagatgtcacaaccaattaggtcattaaaaagtgcttcatagcagaaataaactttatatcatgttttgaagaattatttccacaggcatgcaggagatgggctgaaatatacttgggaaaaaaaaaaaaaccagatgttccagaatcagtgactccatttgctgagttatgggcttgtagagctcagttgtgagaagggctggtgaaggagtttggggctctttgatggaggacgttgagtaataactataattataatggacatctttggcatttacagtttgcagatcagtaatgtaaatactatatgacttgtccctttcaattgccctgtaattcttttatcatgatcactatttacaagagaaaaaaagggtcaaggctgagaagttgatgcttaaatcttataggatggtgctgtatcttttcaaaatgtaaaactggttttgtaaatccctggcttaaaaagataaaacaaaagcaaataaataaataaattaagcctctttcttcactgtttccagtgccctctaaatcaagataaaaatgtttaatgtggcctagcagttcctgcgtgatctggcatcactagcatagcacgtttagcctcatcactcaaaggtccttctgccttcttgattccagcgccctggccttctcccaaccattcatattcaccactacagacttgcctttgcttatcctatttaagcagaatcctcacttcttcctttgatggtcacctactcagaactaagaactcttctttagtgtagcacctcctcaaggaaatccccctgccatttctttgagaaattcaaattcccaggccataggttctcataaccttctagaactctctcctgttgctcatttcacaattcctttttatacatttggttgtgagattatttgattaatatccatttcctaagtagattccactggggttagacagggttgttagaaaataaaaatgcaagacagccaattaaatttgtattcagataaataactgactttttaaaagtacaggtatgtcccatgcaatatttggaatatacttataatttaaaaattttgttgtttatttgaaattcaaagttaactgggcatcctatattttatctggcaacctatattttatctcatcagagactatatctgtttttttcttctagcataatcactggggttgtaacaaacaggtaatcatctaatgttggatggataaataaaatgagtttaaaaaatattctggcagcgcatgtaggctgaattggaatgacaagagactgaatttggaaggactcattagcaaactttgaaaatcatcaaagggaaagttaaggacagggtggtggcattgaggctagatagatggagatgtatagaaggaacatttccaagtggggctcagaatttgcacaggtgttattgggtagcaacccagcactgcgaggaagaggccaaagggccatttcaaattattagtgatcaggattaaaaccagtaacggagagaaaaataaatataatgcctctcatttatatagtgcttcacaacttttaaagtgctgttttatgttccccattatgccccttggtaggagagtattgtttctaaaaagacagccatttaattatcacttttctttataaattcaattacatttcccagtccatgtagttcatcagttcagagatgtttgtcttcatttctgtctattttttaacaggtttcttttatttaagttcctcatttctcagtcctgaatcctttatttctgaagcaccaggtaattttgtattacgcataacaaatctgaaatttatttgtatgagcagattgattttatatccatcagattttctaaaaatgggctataactggcttataatgacatgaccagccagaggctaatttctgtggtatttcttcctgatgccagaataggtagacaagtcagaagcacccacttcagataataaagatataattccagttattcaaatttgtgttgaaagcaaatcctttcactgcttatttttcaattagtgccaagtgtggctccatggcttctagctacagaaggccaggtgatcgagcattcttaaccagatacatgaatagggagaccacggttctgcagttgacatttcttcagctgctctttcagaggtcttaacattttttctcaccagatacttgcctgtgagctgctatttgaaagataaggtgtgctgagtaaatgattaagcaagtgagacaataagaagcaacgtaatctcatcagagactacatctgtttttttcttctagcgtaatcactggggttgtaacaagcaggtaatcatctaatgttggatgaataaataaaatgagtttaaaaaatattctagaacaggggagaattctagaaggttatgagaacctatgttctgggaatttgaatttctcaaagaaatggcagggggatttccttgaggaggtgctacactaaagaagagttcttagttctgagtaggtgaccatcagaggaagaagtgaggatgctgcttaaataggatgagcaaaggcaagtctgtagtagtgaatatgagtggctgggagaaggccagggggctggaatcaagaaggcagaaggacctttgagtgatgaggctaaacgtgctatgctagtgatgccagatcacacaggaactgctaggccacattaaacatttttatcttgatttagagggcactggaaacagtgaagaaagaggcttatttatttatttatttatttgcttttgttttatctttttaagccagggatttacaaaaccagttttacattttgaaaagatacagcaccatcctataagatttaagcatcaacttctcagccttgaccctttttttctcttgtaaatagtgatcatgataaaagaatcacagccatgtagaggacgaaatgtgagcttttaactccacatacctgagtgtcactgatcactctctcagtaggtcacccagaggttagcaaacttttcctgtaaaggaagagagtaaacatttccagctttgcaagcaatatagtctctgcctcaacaactactcaacactaccactgtaatgtcaatgcaactacagacaatatgcaaacaaatgagtgtgagtatatcacagtgaaactttatttacaaaaacaagaccacctagtctgcagacccctgcccccagatttcagcttcctgttatgaaaatggccattataaaacctatatggcacagttgttgtgattaaacatttttacatacccaaaaaacttagtaaagaatcaggcatattaatgagagttcagtaaatgctaacctgtatcatgattataagttttagggctgcaaggaatcttgggtgtgacagacaattttctcctttcaaaagatacctagatggaggattcaagaagtatagggacttaaccagggttacaggatctattttcccgcaatcctatttgtataccacttccagaaaccccaagaaatatgatggcatgaagccaagctatatattgcgggatatttgagcatccattcagcatgtatgcattgaatgtcagccatgtataagacattgtgcagtatattgcaagtgacacaaagatcaataaagttcctgcgttggaaaatctaacagtttaagtcaccctagtaactataatgaggtggaaagcgacaagtatcaaaggaatgagtgacccctacgtgccaagcactatgttgaagtgcttacatgtgttgtctcatatgatcccccagcaggtggatttttagcatttcatcctcaatgacattcaaatgttaagtaatctgctctaggtcaaaagttactaagtgatagaacaaagatttaaactcgtttctctaattgcacagtgtgctttctaccagacgctggggaaatcctcatacatgaagtatggtttagttagctattgctacaaaacaaacaacactaaaaagttgtgtttaaaatgggcatgttatttgcttgtgattctgtgggtcagcagtttagacttgactcagctgggtagcttggatgatctcacatgaggtccctcatatagctccagttatctggcagatagacgggggatgatgatggtctaatatggtctcacacacatatctgccagttggttctggttattaggctgaggagcctcacgtgatatctctgtgctttgtgacctctcatttggctaatgttgactgcttcacttggtggtctcagggctgcctcccagagaggtatataacaggagcagcaactcttgagagcttggaaatcatacaagaacactttcgctgtattctgttggtcaaagcaagtctcagaatcaggctagattcaatgggcagggaaataggtgacgtgtcttagtgggaggaacagcaacatcatactacaaaagggtgagcgtgcaaggatgggagggtttcttgctgtgtttgccaacaatttaccataaagtgataactgagttggaccttcacagaaaataaagatttgggaaataaagactttgccagagcagggattataaagaagagcattacttcagattagctgagaatgaggccacacgcctatattgcattattgaggaaatttcctcttgcctttgctccacaagcacattgcttctactagttgcagggacataattaccaatttcatatatataatacttctaacttttcagaggatttttatttctcctatataacgtttaatatgctatatagttttgttgcattgttttactctgctcattcctttcctctctgtaagttggtgtcgtcattgcaacaaagcccaggttcccagctcacttcccaaaagacaatcatgtggactatctgctgtgattgactgtggctgagtgtttgccctggcagcttttttgttgctgaagatgaaagtttgatggactttaagatggaaaggaaggaagaggagaaatttgatttcatcggcagctgtcttactcatcttcattaagatgggttgtggacacttcaaggccattctgaaccagtggtcataaaactaataggtgccactcaacctgcgctgctcgtattattgcctgagacctgtcatctcggtagttattgcaaaaggagaaggaatctactgtagggaacacaatggtccttgtgtgacagaagtgaaactgaaagaaatagatttttctattagctgcaaatcaaacccttgcacatcatcccttggaggtgacagtgcctgattctctaaggcagggttcaaacaaatcatttgggcttgcagaaaataatatgagattaatatccaagtgtgtgtgtgtatgtatttgtggggtgtgtgtgtgtgtgtgcgcgcgcgtgcatatatgacaactacgtggctcctcacttgaagttttggaattagctactaatatatgtgtatgtttaagggatgcatttgtggacttgaagttgaaatagggaaactgagatgtattctgaagagggaaggagaagagggaatccagtcctgattaggggaatattgaaataagtaggtgaataatattcagtctcccaggtttgtggctatgagctcttttcttccagaagtatttgctgaagggagggaagaaaacactccttttcttctgacaatcaaacttttcaaatgtcagcatgcatgggtgtttctctctattcttgaggctcctttttgtttcagtctaacacctcacatcctgtgggttgtaataataatggtagcagttaccatttattaagcccttgtcatatgccaggtgctttacatatattacagtgtttgtaatccatacaagaattattacaagatagatatcactatgcccaggtgtgttagtccatttgtgttgctataaaggaataccggaggctgggtaatttattagaaaaagaggtttattgggctcatggttttgcagactgtacaagcatggcatcagcatctgcttggcttctggtgaggccccaggaagcttttactcatggtggaaggtaaagaaagggcaggtacgtcacatggcaagagaggaagcaagagagataggggaggagttgtcaggctctttttaacaatcagatctcatggtaactacagagtgagagctcaatatttcaaggagggcatgatatggttcgactctgtgtccccacccaaatctcatcttgaattgcaatccccatgtgcagagggagggacctagtgggaggtgattggatcatgagggcagtttcccccatcctgttctcatgatggtgagttctcaggaggtttgattgtttaaaagtgtgacccttcccctctgtctcactctcctgctgccatgtaagatatgccttggttttccctcaccttctgccatgattgtaagtttcctgaggcttcccaagacatatggaactgtgagtcaattatacctcatttctttataaattacccagtctcaggtagttctttatagcagtgtggaaacagaccacacagaccaccaagccattcatgagggatctgccctcaggatccaaacacttccctccaagccccacctccaatgttggggatcacatttcaccatgaaatttggaggggacaaacatccaaaccgtatcaacagggaactatagctcagggaggttaagtaacttacccaacaacacacagcttatatgttgcaatgtaggaatccaaacccccaaagcttgtgccctcctactgcgctaccctgcctcttccaggcttggggctttagggaatgccctttacaagcagtataaagacgcatttaggaatttttcaatcagctcttgtctagatcttctttggaaagtcttcttagttactggcaggtcaaaataccagctacttgatctaatagtgttatcagcaagaaactaaaaatcatgaagcaatgcagactttttgaatcagataggacttactaggccatcttgtgattctaatctaacatcttatctggccactttttctgccttgtgcaggaagtgaggtctggataggtcaaagggcatgactagagcattggagttaatgggaatggggaatgccttctttgcttcttgacatttctcctccacaacactgcacatcccttgtgaaataatttactattttttagacatcatgtcaaagactgaagtgaaagccaccctcttgtgatcaactgaggtcagaagttggcaaatttttttgttgggggtggggggctaaagggccagataataaatatttttggcttttcacaccagaaagatctccattgccactagtcaattctgcatttataactgagaagcaaccacagacaataagtaaagaagtgggcagcactgtatccagtataatattatttacaaaaggcaaagagggctggatttggcttcccaatctctgccttaggcctttaaagatatagcttccctggggaaatctctacactttgagatttatactccagtactaataacatagtaagagaatagtaatggtggtggtaataatagcagtagtggcatcagcagcaacaacaatggcaccttttaacatttgcttaatacgttaaggtttacaaagtctttttacaattatcatctcacataaaccttttaaattcctactcaagaactacacaagcaagggaaacgtgctagctgagcagtgtggtacaatgaaaagagaatgggatatactgcatttagtcatagagattggtggtgtgggatgaaaatgcctagagagtaggtgtgtgtctcctggccccattaggggacagttcattcagcagcagggtgagtgtcggagttcccaaatacatggctgctaatcagttccctcactctgtaggcattttgcatttaaagctgtccagaaaagagaggcttggtctaagaggttgtggtgtaagaaaatctctacatttccacccattgccttttgggatccctgtatgttagtgagcaacagtaaaaagtgacctgtgttaaaaaggtaatggaagcatggtacaattttagagttcatttgagcaaacagagattcatgaattgggcagctccaaaccagaagtggtatggggattccaatgaagaagtatgagaactaagctattataaagagaatgcagacctaatacaaataaaatatttgattgattacagttataaagctgtctttgctgggaaattcctagttatgtaattataagtgtgattggttgagcttaagttctgtttgtcattattataggcatttacaagaaatagctcaagttaagttctgctgatgtttgcaattcaagcaagtctaaggccacttatgaggcctaactggctctgtctgctcaggaattcttgcaccattgaagcattcttcaaggtctccattttaatttagtttaacacctcttaacaccacgccttcaataacatttatttaacacaggtctttgcttcgtgctaaaggcaaacatgtatatgagactctgtccctaaagcatctgtaactctccaaagacatacccctaggaacatcctgaagattctgaatcttgcagcctgccagaagcacagcagtgctgttggcatctctagaccactgtctgtgattgacttctggctctgctacttgtcagctatgtaaccttgggcaagtttctttttctagtctctttgtcatgttcttcatctgtaaaatgggtattttttaaactacccatttatgtagtctgtgatgatttaagagctaatatggtatgtgtagtggttatttatgagctaatatgtgtatattagcttaatgcctagcattcgtaaatactcagataaatgccagtcattattattatcataattgctggtgaaattaacatacaaagtcctgtgcaaaccttaattttctcactatggacttcatacattttcagaatcctagctacttggttctcagaacattcttctaacacctagagattccacagccaatgtatctttgggaacttattgactaacacagagctaaatgaagtaagcagcatttgtaccctgacattttacagatggaaggaatcatagaggtcatctcagccagaaacacattttcaagatagggaactgaggttcatagaaagtaaatgactttgccaaagtaatacactcaggacagaatgagggctagaaccccggggattagtttttttcctctggcctcaaaactcttccttctgccatttttaacttaccaatttcacctaataccttccacatatttttgtgactgtttcaaagattccactagctaccatagaagaagtaatgaactaaccttataattccatcccagtggcttcacctcacctgccctcagtttcctcacctgtccagtgaggcaaacttacattggaagatccctaaggtggttcccagttcagataagatacaatcctaacaaataaagtggggtcggagtggaatgttcttgaaatcctggtatcaatgggactgggatattactctaaatctatggaaacttcaagaacaatatatttgttttaacctgaaaagacagttgcgttccagtgtgaaatagccaccaggctggatgaaaatgtgtgatgtgattccatcattgaaatgagcatgtgttgaccgtaagttcttctctttctctctggggacatttgcagtgctgcagagcttctctgtgagctgggatgctctgtcagcttaaatcctttccagagtgataaatatacattgattttatttgatttggcccataggtgggggataaaaaacaagacatcacagccacactatactgtatattcattccccctgaagacaacgcacacatccttgttgaagtctcctcatttagacaactcttcctttttatgcttcattataatgccactttcatgtcccttcccctcaacatcgtgcaccttgttccacatccagcactctgtgtttttaaattaagggaaatgccatttaaatatggtttttctctttgtaatatactcacctataaaaagtctttaaaggtaatgctaactgctttggcagaaattcaggcatatatatagttattttaatacaaggctatttgtttgcttgactgtttttaatgactactcattaacaccatgatcttatcctcatttcctctgcacagagcttgagaggtgctgttcacagcccctgctgcctgctttctgaggtctccaagatgctagctttctacttttccactcagccctgacacctagttcatcatttgagataagccccagttgtcggcaaattgcaatctcatcaggtctgcaagatagcatcttgtttgactcttttcaacaccttccattaacactttgggactaggtctttgggaagagccaggcctcaccacatgggcgattgtggttgatgaacagattctagttttccccattattgacttcattaaacttgacagcctttttagtctccagatagggtgaaccttttttcactgacccttattaagagctgtctccttaagaagggtcattcgagaagggatagtgggggccactccttctacttccaggaaatagctgattttggtaaacaactttgatttagtttttagagttctttcacctccctaattaggacagccacaatttatcaaatgttagcaatgcaccaaagcctaagaatgatcttatttcttcctccttattcatgggttttattactactatcctaatttcctcatatggaaatgagcctcaaaaacattaaataagttactctaggtcccatatcaataaattgacagagctggaattggaatcaacttaagtctgacttcagagcttaaggttttaaccatcatattctaccaccttcataatacctttagttactttattatattttaggtttaccccttgttattggtcttcaaaatccatgagttcattctgattttatgaggtgtattggtaatctattgtttcatgaaaacttaccccaaaacttagcagattaaagcaataaacacctattatctcattcaggctttgtgggtcaaaaattcaggagcagcctagctgggctcagggtctcttatgaaattgtagtcaagatattggcccaggctgcagtcagtcacctgaagccttgactgggctggaagatgtacttccaagtttcactcacatgcctggcaagttactactcattattggtagaaggctttcgttctccagcaatgtctgatcctaattttattttaccatagattagtgcagtcttcacatgaggtttcatttcacctctctttctctctctctctctttctctctttctttattttttttctctctctctctcttttcccctggcagtcttcttttggtcaagccatttgtattagtttgctaggtttgccatatgaaagtaccagtggcttaaacaacagaaatttattacagttgtggaaactaaaagtccgagatcaaggtgtcatggagcattgttttctctgaggcctctgtctttggtttataaatggtgatcttgtctctctgtcttcacatggactttcttctgtctctgtgtcctaatcacctcttcatataaggatactagtcatgattgaggctcatgcatctgagctcattttcacttactcacctctttaaaggccctgtcttctaatacagtcacattctgaggggtgttaggacttagggggttaggacttcaacatatgaatgttgaaatgaagtaatttggctcataataccatctttgtcctttgtatgtcttgagaatttccttttacactgtcttacctattacttatgtcatttctccattcttaacctctctttgcctcaagttcccaaagctattgtgcagccaactttaagagttaactgcctgcctttctgattgctcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattactttgagggaggggtctgtgcatctttcttaacccttttcctggctgccctgtagatattccagaaagatttgatgtcttgtggaatggtctgagaaccagatggaagctagatgaagaacaaaatcaaaagtgtctctcttgtcttgcatgatagaaactaatatcactaagaacgcaattgagagcaaattattaagaatatgcactgaatgtgtacaacagccagtgtttgttcctcatcagcacagggaagcattcttttttttttttttttttgtgagtaattttattttattttattttatttttttttattttatttatttatttatttatttattttttaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtggctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccattgatgatgagcatttcttcatgtgttttttggctgcataaatgtcttcttttgagaagtgtctgttcatgtccttcacccactttttgatggggttgtttgattttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaaggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcattatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgacagagggcatccctgtcttgtaccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgatattggtctcttcagaaattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggtgagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgttggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttttcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctggagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgaggacgggcagactgcctcctcaagtgggtccctgacccctgacccccaagcagcctaactgggaggcaccccccagcaggggtacactgacacctcacacggcagggtattccaacagacctgcagctgagggtcctgtctgttagaaggaaaactaacaaccagaaaggacatctacactgaaaacccatctgtacatcaccatcatcaaagaccaaaagtagcacagggaagcattctaagcttttgccaggacgcctgcttattatatgctatggtctgtccaaatcttctgtggctgccactacagcctgatttcccttggaaacttggcagcccgtgagttacgatggaattcccaggtgataatgtatctaatttccctcattgtacttcttttatcctgtaatgtgctgttgattcccacggctgagctgtgatggagaatagccattattattgtaatggcattattcagtccattaagacttaaaacatacctggtaaaaatagtgaaagcttacaagtcttcatagcaatctcaaagactaataacttagttgttagtcttttcctcaagtaaactttgacaggtgtttgggaataattctttcctgggctgatagtatttgatttgtactatatattgttctaagtaaatgcaggaccaatgctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcctttaatataaaaaagggatataagaaagcaagcctgagtatattcttggttgctctgtttcttgtgttagcctagccagaacgagctacaatagaaagaagttatactttagaaaacaatctatttaatataattcaatgctacacaaagctttatttcttaatatggacaattatttgctactggaaagaaagcagagcgagatatggccctttggggagatggttaaataagaaatacatttccagatgatgtcacatgtaaatagcactccgaaatcactaggcatcaaaattaatcaggctgaatccattgctttgtaaggtgtaaatcgctagccttacttaaccttacttcagtgctgggactcccgaatcgcgaggaaggtatgattcttatttcttcacacacacacagactgagtgttctcaagacaggaacatgattgagaatgctggaaaaaacattacattaatctacattgtaagagtaccatgcaaacatttgcttgtttccaacaccttgtaaatgtatctcgttgttgactcaaaatgaacatttggtgcagatactgagaaaaaagaatgtacttagaacagggatttcattacttctcttataggtctcagctgtggagattgtttagccaacaagaaacccaatctctgttaggtatcttgtctgagatgatattaaaaatattcaacaaccagtaggaaatggaaccaatgaaaatgactcaggtcccctgctgagactggcattgacctgttagttgttgaattgtggaaagaggggaaagggaccggatgatcggtggtaagggtatgtttgaagcagtgacattcatcatctatttatgcaagtattttaacattttaataattgatacagttatctgggtgcatgccagttgacaacttgccctgcatattgataattttaccatgcagactccactcctcaggtaactcttgttctattacactggactttatcatcatgtaatctgtcctgtccctctctctctctctctctctctctctctctctctattgaattctgggggtgtagtagtccattgtttagagggaatttagaagttttcctatattaggaagtgtattcatttcctaggaatgccataacaaagaattacaaactgagaggcttacaacaatacaaagttatcatatcatggctctggaggtgaaaagtctgaaataaaagtgttggtggggctggacacggtggctcacacctgtaatcccagcactttgggaggctgaggcaggcagatcacttgaggtcaggagttcgagaccagcctggctgacgtggtgaaaccctgtctttactaaaagtacaaaaaattagctgggcgtggtggtgggtgcctgtaatcccagctactgaggaggctgaggcaggataattgcttgaacccgggaggtggaggttgcagtgagctgagatcgtgccactgcactccagcctgggtgacaagagcgaggctacttctcaaaaaagaaaaaaaaagtgttggcggggccaagatctctctggaggctctcagggaggatccttccttgcctctttctaacctcttttgatttgctgacaatctttggcattctttggtttgcagctgcagcactttgatcacggccttgttgtcacatggcattctcacctttagtgcctgtgtgtcttcccctcttcacataaggatgcaagtcatattggatgacttatcctactatcctactatgtctatcctactccaatatgaccttatcttagctgattacatctgtagtgaccctatttccaaataaggtcacactccgaggtactggggggttaggatttcatcatatcttttgggagagacacaattcaactcaggacaggaaggaaaagccccggcaaccgaattgtattgttctgctagatgatgacaagtcataatgtagagaagttgctccaaagtgggatacatacattggagggcagcatagaatgaaagttttagaacatctatttatatttattttaatcgtattcctttatatttttgttatagtctgtttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaagcattttcaagaacatgacaaaataaaaacatacaaatttatatctcaaaaggaaagtatcttctttcatgtcagatcatcagcacagaagccctcgatgcatgcaaaggcaagcacaggctctgcagatgagatgtgaagaagcaattagggaaggaaggaagggacagtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttcttgtgattattcaccagggaacattttataatactcatattaaatttttatttcttaatttcttgcctcattactcccatttgcattggctgcagactctctaagtattactttcccttccttgtggttcataccctaatcattgaatattgatgttctatttatttctatgcactcactttgtttttgaccaagttatatagttatttggttttcaggtaatgctttcttacagttactcaagaatgtatgctagaaaatgttgcccataactgcttaaacataaaagaggatatgttttcttgttttccatctatgttacagtctgtttctgaaatatcctttattatgagtagaataaaatctactggacttggaatccacattcccttttaaattaaaagtattcccagactttcaaattttacattccttagcatgatctcttctctataaagacagaagaggggacagaaaattctgactgatcatttcttgagctagaagcagctataatattcctgttctccatcctttataattactttctcataaatactaaactacacccccctgagcatctagaagatttaaacactgatcaaaggcaggtttagctgtatcctcaggacaagctgattcaatgaagaaaagctcaggctcttggagagcttttagaaagagaaataaattaacaattagcatttaacagcagtaaaaactgcttagcggaagcagacttgatgttttaggggatttgagatattcggagtgatgagatgaataggaaaaactgtgttccaattaggaagacagagtgaaaaggtgtgagatgtggtcttctagttcattccactggtgatatagagcctttcctggacagatttttatcttttttgagtaattattatccacgttataatttcatgcctgttgcttttaggtaagctcagaattatagtcatggcttgagtaaagatctcattgcagttgagtactagcagtaccactactcttgcatgagttgcattctctcttgaccagctctgttaatgggtgtccttatgtatgaaactgattttcttactaatggcaggattctgtctggttaggatattccctgaaatgcccaagggtgtattttgcttaaaagcaaggctggccagagaggtttggtttatgtatttatttttaaatttcttttgtacctaggataataaatatattcctctagtcttggataataatataaaattacagccatactgacaaaattaaagaagacattaacaaaaaattcagattaaaatataaagttcatgtctttggcaagtacacacaggattgtggttttgcccaaggtgtctaattaattactataatttttcaattccctgtgttcaataaaaacacgtctatgaaatgctattcataaaagcagaactcactggtcattaaacatgcaaatatccacgaataaatacacaattctctcttgcaggaaatgctatcagtagactaaataagtggtggacatttttctacagtaagtatttacttttcctacagtttgatcttaaaataccacagttggccagggcctcatgtgttgctggtgcaatctccgcattgttaatgggtatatgaagctcatgatgatgtccacaagatgataccgctattggaaaacttcctcattcttcctgtctaaccagtagcataatggatatgtgaatagtgcctgttttgtacattttccctcaggtaaactgtgataggcctttgggaataattcttttcaaggcctgaagcatttaaagtgcactgtatattgttctaaatgcaagaccaatgccccattctatcagagaaaagaaaaagggtatctgtgggaaactatttaaaagattaaaggagctttgactgaaatgtggtttggtggcaaagaaagggaaaccaccatcccttggtacagtattaaggctatatctgggaaaaccaacaaaacgtgtcatatgtggatagatcatgacactgacaccattagcaaggactttttttttttttttaacagcatttcttgtgctagtttcccagtgccaagaatggcttctttatttattcttgaactccaatacctatcacagtacttggtccttacttggtactcaataaatgtttgttgaatgaatctattttttatacttttgtatcaaactatcacatctgagcgattttgtaattttattcagctgatgatattctttataccagtgcaattttccatatgctcatgtgtgttttatttctcatgatatcagtttttctttctttgaactttgtagttccctgaattgcttagtattgtttatatatgactaaaggcccaggtggataagatggtatctttctttgtttattgtttatatatgactaaaggtccagtgaaaggtaaaaaatgagtttgttagatttcaaaatcagtcaaaaggtaaaatcagtgtgaagataagataccatcttatctaactggacctttagtccagtgaaaggtgaaaaatgagtttgttagatttcaaaatcagtcctaactaaaaaccatttcccctactggatgttgtaactcacatcattacaatttatggcttaatgaaacatttatttttctgaacaacttggatttcagtgagcagatttcttaaaataaggacattctatttttcattatagtactaagaatgctggaacaaatattttttctacttacatacttgagttcagttgaattattttatcaggtatttgcaagatgacctggaatatcttggaagttattatatgtaaattatacatacacatatatgtgtatagttcctggcattgggcaactagtataaggaatgctgcaaaaaaaatccttgctaatggtttcagcatcatgatatatatatacatatatatgcatatgtgtaattacacatatctatatgtataaataactatattaatatacttatataagctactacatattaataaatgatcaacatacctatattatttatatataaactatatataaatataactatatatatacacacacacacatatatatatgtagttgtagaaagggtcttttttagtgaattaagacttcatgaaaggccagttatagtggctcatcatgcctgtaatcccagcattctgggaggctagaggatcacttgagcctagtagttcaagatcagcctgggcaacacagcaagatcccatcttaaaataaaaaagatctcatggtaactaatatttgatatgtatgatatatgactttaagcaatattacgtgacatcacctttctcacattctaggttgctgtttacattttttgttcagtaatgaaacaaactcacgaggaagtaaaccaatcaacattttatgcatggagttttctaaatccttcatgtggctttggtagcattttgattagaagcccttgaattctgtcctgagtgcttacccattatctagtgatttacagagtttacaggaggacaccgaaatcacaggcttgaccgcatttacggatggcacagataccagatccaaaaagtttttaatgatctggaaccatgaagtgaaataaacaaggagcccagatttcttgaagacctcctctatgccaggcattttatgtctctcaattctttgagagaacctatggcatgaagttattaatttttttctagatggcaaaactgaaaataaagtatattcaattaatttctcaaggtcatgggattgaaaatactgtgactgaaaaaaatattttaagtcttcctgatcctagagtctatcttcttacattaaaataaacatattaaataaataagcacaatcagtttaggaaagatttgttttgatagaaatccatgcaaagcaggtcagggaatttcagttgaccacagattcaatggggaacatcagctaatgagagaaatgtacagtgcaaattatttcattgtacttagtgctagtcaggcttaataaagggtatgatactttggcacctcattgctttcacaaacaagaaggcattctgagtaagaaaacatgaagacaaagatcctaaacctttatcttgtggatgacagctaagaatgctcaggtaagaaatgactgtagtgacggcaggggatggatgagggctataacatctgttgcaatacatacactgaatggtgactttttcttttttaaattgacacggggtctagctctgttgccctgccagagggcagtggcgcaatcatagctcactgcagccttgaactcctgggctcaggtgaccctcctgcctcagcctcccaagtagcttggactgcaggtgcatgcaaccatgccccactaatttttttatatatttatttttagtagcaacaagctctcactatgttgcccaggatggtcttgaacttctgggctcaagtaatcctcttgtcttagtcttccaaagtgctggcattacaggcatgagccaccatgcctgccctaatggtgtttttaaaggaggaattagctgtggtcagtacagatttatttggaagaaatggaatctgtgcttagaagccaaaaggcccattattattcaataaaaggaagctctttagaacactttgaacctgaaagagttaatgaagcatgagacattagggttcccatatttagtttagatctatgtggcactatttttagaaggttacattgtttttaatattttatatagtaggccgggcgtggtggctcacgcctgtaatcccagcactttgggaggccgaggcaggcagatcacaaggccaagagatcgagaccatcctggccaatgtggtgaaaccccatctctactaaaaaatacaaaacgtagccgggcgtggcggtgtgcgcctgtaatcccagctacttgggaggctgaggcaggagaatcacttgaaccaggaggcagaggttgcagtgagcctagattgcgccactgcactacagcctgggcaacagagtgagacttcatctcaaaaaaaaaaaattatatagtataattctaataatgggatgctccacttcacttgcaagtacttgcatatggaggtgtttttttccccagtatgaggagagatcaacagtaaatacctatattatttctattgctggtcaatgcagaaaatatttgttaagcacgaagagtgtggatgtgtttgatgactacagaactaaggatttctcaaagaaacaaagagagaagtctaagttcaggtgtggaagcccttgcctaatttgcttcttcacttttgcccagaaataatttggccagggattgtgttactattgttgaattaaaccagacagaatcaggcctataagaagagccgtttagtaaaggaaatgattctgtgaaaattttagatttgataactgacatgggaggtgtttaccttcttttgaaaagcagatttaaaaaattgaattaaatatacacacagacttttacactcattttcagggaagcaagaactctatcataataatcaccaaatatcaattaatcagaaggaaaaataggcttgcaggaagagaaaatcagttcctttagacaaatggtattgacatagagattccaggtatgtttagttatataccatgcattctggatcaaatagagaggcttgtgacttgtatcagtattacctggcttcacagcagcaggagcagagaaaatatgcactatgtttagagatgaattaggagagtatgtctgaaagaaccagggatgcgtgggcaggtagatttggtcaggcatatttataataatgagccattggatttgggattgggtggagggaataaagtcagaaaaccattgggtcatcttccctaataaaagagaacgtctgtggagttataaatagaattgcctaatatttcatctaatagctttattcaatcattagaacctaagctttcttgtatcaatgtaaagtatgtgtgtgtatatatgtatatatattcatatgtgtgtgtattatatgcatatgtgcatatacatgtgtgtaatgaaaaaagaaaacagccctgaagaatcctcaagaaactgtcagacgtccttgtcctttaaaagctccagttgcccttcttgtctaaacacatcagtgcagtgtgaatcctgcattattcatgaacacataaggtctgtatttgtatacatttatctcttggctatttatttctataatctctgccccaaaccctcgccatgctttgtctttctcttttcctacttttcttttttttctggtagtttgaaaaataaacattagaaatagctattttattgcttacttctttcctttaacatatggcatttgcttaacctcttggagagttgtggttttctgaccctggagttctgatgggaaagataatgagaagtgtttacttagcatctaggccagcaagctaagaaaaacattgtgccatgctagtattgacaaggtgacagagagcccacacttgcctcacatgttggccactcccgatgctacatcccactttactcttgctggaggactgacattaatgcttactgttttgaggtctggacataatcctggtagattctaaaactcctagcaaacagtggtagacaagtcaagggtctataattgcgtataaacagaaaagtaaagacttacatatttaagcaacctgctaatccccatggtcatttagttccctagtggctatttttaatttgtcttgtttttagaggcactctgaaagcatgaggcaggtgaaagcgtgtctgtgtgttgcttgcatgcacatgctttttcaagaaggtcttcttcttttcttgtcaagactgcagctgtcaactgttccccaaaggtgttgcctagaatcagcatgcagcgctgtaggcaacctgtcacttagatgagacaccttgtatatatgctgtagttcactctctgacttgcctgtgtgcacaatgccatcttgtctgttagaagacagggccatcgtgagatgcagtttctctttgagatatatagtagctcttctttcttcaaaaggaaaaaataaaaaataaaaaaaagctactcttgctggaaaggtagagagaagggtctgcgggtgccctctaccattgtggtttcaatgtctaaatcttctggagaggattgctgcagtgatgagataaaagcagctgcctttccaagtactgtctatttgcattgatatttacattctttgccaaagtgacatcattaacatttgcttagtatttgtgccacagggatatgttttacataatttaagacttggaagtgatgataatgtatttcagatgggcagtagaggccacagagtgctgaatttcatcccctttcttcttaaggaccttagtgcataaataagtccctagtccgtatccctaaatcatattaacaatactgcttactgggtgccaacaatatgtctggtactggactagatatatgtgtatatattgtttagcccccatgacaacagtatgagggtaggtaccattatctccattatatagtaaagaagcaaggctagaaaaattggtgacttgcacaggtctgaattcagagacatctcaccgcaaggacttttctccttatgctgtgtcattctatctcccatcttgtagcctacttgtttcttcagatttaagaaacagaaaccctatattttctcaggacatgacacttgaaataacaagaaagaatattgtgggactctgaccttggtccgtttctgtctctttcattctcatctttactctaggtgcccagaaactcttctttgaaataaatataaaagatctgtgtttgctttgagagaaagccacataacattgtcacaagccagattattgaactctgccagatggcccttatttaccaaatatatgttttagttttatatacgaacagaggttttaaaaagataaagacgaacaaaattgtgtttaatgtcctgtatgataccttttgccttatttacaaactggtcctctctctgactgtacctgctcctgatgccccatcctcaatgtcctccatcagcataaaaaatgtgaaacctctttttcaaaaacaaatttaaaaaaaagtgctcagtctctcatcttgagatggagaattagaagcaaatttgcccttgcttttcttcttaatcttccttcttcccaccttctttccctcgctcccttctttcttctttctttcacaccatgtgccccagaatgacagctcagggaaagtaggcattataagctgagtagccttttccttgatgtcccttgaagggctccttatgttcagagaatatatcactgcatttgcagctcccccagaaatgccgtagcttggaggagcctattactcacttgaatctctttggtgtagacctataaatagattctcgtcttttccttgtaaccccctatagattcttgattcaagggtcaaaaatggagagatgagagttcaatcttcttggaacttactgacaccctagctcccttttaagaacttgtcctccttactaacaccatctacatggccatctgggtcttctcagctcagaaacaccctgcaacaatggctggcggaaataaggggagggcccatttgaattagcacattcccccacaagcacacacatccatactgccaggcctctgtttgtccagtttcctcctcttgtgctgttcttcccacccttctcctcagtgcagttcagatatcatctgtgtcccatgaagtctactctctcccaggggaaaccctttgaatttccattgcatattattctgtgcttctttttatgattaatcccatttaccttgtattatataaatatattttggtccttattagattatatatacttggaggaggacagtatctttctttggtccattggtgtggctaccacaggctcacagcatggcatttggttgcctaaaatgatatgtcttatccgttctttgatgtacagataagaaaagcctttatttagtttggctttcattttgttcaagaacagtggcacagtttggtttttcttgatatctttcccttattcatggttgcttttctcaaacagcacatgtggggcttaatacctagatgatgggttgataggtgcagcaaaccaggtggtacagggtcctgtgtgactctaccatggtgcacatttacctgtgtaacaaacctgcacatcctgcacatgtatcctgaaacttaaaatttaacagaaaaggaaaaagaaaaagaaattattataaatgtaaagtaattaaaagtatattatttaggagggacagtagatatcacaaaggtaagcatgtttcattctcaaatgaaatacacaaatttataaaagtgaattcagcaccagtggtgaatataaaaggctgttaaggaggaggagctaaagttttgattggaacttgaagaaaaggtatgttgttataggcagaaaacttgccatgcaggtgatcatgttagaatcagtgtcagacattaacaaaacattttcagtcaagggcagagagtaaatattttaggctttttggaggctgattacataatttgcacaatgaaatagtgggtccctttttcaaaaagcaataacgaagtgccatgagaagtacttaaaacataaagctctttttcctttttccatggtttctctctctaaacttgtcatgttgttttatatttgctcttcagtgtcattctaaggaaagaaaatgttaaattattagcatgaattttgccattcatctttatattatgccatgccagtcttaaataagttctgaataagaacttctaattcatttgcagaattactgacataggaaacatttcttatttcatagctcatgcagtgcatatatgttttgttcttaccagaaaactggacacactgcacagattaactcacctgtttttatttatttcacttcttgatatacacatattcaacaaacactctcttcctttggcttcctaatgagtaagaaaagactgaaaagaaaagaaactgagttgctttttcttttcttttccttctttgacataattttcagctgaggtggttggtcaattcatggaagtaacatgagtaagaaaggctataattaggttccttagtcatttatgtttcttagaatgccatcgttttctttctgtgttcaaagcaagttttggttccaatggaaaacatgttctttaaggactgtcagcatcccagcttactcagagtagatgtgagagactttgcaatcgctttgagtctcattgagtgtgcatcctaagtctaccagaatcttctactcccggggtattgtgagagctatagggggtgaagtggcaagaaacaatgggcatgtgtatagtatatccatatgtttatgcatctctcttttgctactgcacatgcctaattgtttcattagacttcattcaaaaacacaaattcaaagataaaattattaagtgtttcaagacggagagacaggagaatattaaaccaagagcaggtggtacagggtcctgtgtgactctactggctgcatacccatgaagcttcacctgggttttgcaagccatatggtctctgtctcaagtatttagctgttgtaccatgaagtgcggctataaatgatatgtaaacaaatggacgtgactgtgttccagtaaaactttatttacaaaaaacaggtagcagccagaatctggtctgtgggccattgtttgttgatccctagttaggcaaaaacatggagatgagaatatgtgagccttgtttgagaattgcttagctagtgtgaggtaagtcagggaatttcagaagaaagccaattatgaaagcatggattggactgtttgaatattttcctctagttgataaagtgactgatggctttagctactgaattaacgtgatcaaaagagtttttttttttttttggagatggagtcttgctctgtcaccaagctggagtgcagtggcatgatcttggctcactgcaacctctgcatcctgggttcaagcaattctcctgcctcagctttccgagtagtgggaacacaccactacttccagctaatttttgtatttttagtagagatggggtttcatcatgttggccaggatgatcttgatctcttgacctcatgatctgcccgcctcggcctcccaaagtgctgggattacaggtgtgagccaccgtgcctcgcccatcaaaagagatttttagtgaattaatatggaagtgtcctatcacagagataggaaggggtggatctgttaatagacagatgaacaagggagctattgtgagagtccaggtatgagatgataacaacttggagtattaagaagggatttgcaatgatggaaatatttgattccagaggaattttaagtgaagtgtcaccaggatgtggagagtgatttgatgttggggctgagagaagaaaagatgggaaatttcaaggtcttgtgcccggaaggctgcaaaatggatagccattcattccctgaacctgtattgtgtgtatcttctgtttgctaaaataaccatgaacagaaatggctggtgggctgctgattttaggtggctgcagaattttggtctatttgagttgatgttgggttgcctaatacacatgatgcttacaaggcattcaagatgtgtcactggcatagaggagtggagtgagggatagaagtaaaggtaggtagcccatcttcacagaaaggtgaattagaccagcgacagcagataccatctcccaatggagaaagcatagagaagagaaagaaaaagaaagaggctctaataccctaatcacttacataccctagtgtagtcctctatgcttttcaaattaagtagatatttcactttcctgtttaaccttgcctggaaagattgagaggtccatgtctagtcacaatgttagaatgaaataaatgtgtgaaataaatcatgtttatagtgtagatccccttcatcttcatctttgagtcaaatgccaaagccatttgttggctcagtaacgtttcacttagaaaatgaaacttttattttggctaaacgagtatggtgtcctggtcctttcccaaaaacataccttcaattttaccctagctggctgattgactgtttcctttacagatgcagtctagggatgctaagggcaacatcctttgtgataatgaaagccttataatgtattttttccagtaacttaggatgctgtatattaagctgtatattggtaaatattttgtctatgtggagaaatgtaaatgagatttttttttcttttcatcattcttctctacaaatgtgcattgaaaagacactgaactttggtcccatgcttatgcacaaggtataaaagttgcttatattcctaacctctccacagagttgtctagattcacaggactatttggtcaaatgttctgcaattcagttccactgcttgactgtaattcacctataaacccagaaaaatactgctggagttcagaggccctgactgttattagacagagaaaacctatagcacactggaacaatcacatttaaaagatttgcctcaagctttctatggtcactattactctttaatttatgcttttaggtttcaactttgaaatgatattgaaattttcattatgggcaaccctgaatctggaaaaatccaaggcagcttttaggacagtcacctttaattacccaccaccgttaagattaggaagtaaatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatacttttactttattacattcccaaatgaggaaatgtgctgattagatggaaaagcatgtgtgtatcttatagtgttagcaatttggcacggtttttgttttgttagctctcagcatggttgccttcaactatatttacaccacatgggtgggcatgtgttaaagatacaaaaatcctcagacctctgaattgcattcctgaaggagaccttaattctattaggttggtgcaaattaaaatgccgttacttgtaatggcaaaaaccgcaatgattttcgcaccaaccttatactgcttattgcttttgcctcttctgtaatgaaaggcttctaactggtttgcctgcctttgattttagctttttgtgtagccttggtcatatcaagtttctgctgaaaaatttggcatggcctttgatttcccagtctcatctcctacaactcaccagtatgcaccggtagttccagtccgcaatacgtcctgcgctgtcgagcttacgcacctttctgtgtgctgtttcctctgctaagaatgtctagtgaacttctactcaccgtttaagaccagatttaaatggcatcttccttacaaataagttgattgatctatcattttattgattctgtcattcagaaacattccttcaatgcatgctatgttctgggaaactttctctaaacggactcaaacatttcttcttctgggttttcccagcgctggatactctgagtcattactaatccacactgggttcttgttttctaggctgcatccctcaatagactgtgaggtctttgtgagaatacaattgcttttgtgtttagttccatattcacagcgttcattctagtgtctggaacatagggttccactacatgcactacacatttgttgactagaaaaatgattcgttttatcaagggactgtcttaggaaatactaagtggggtgcctttctgatacattgtaatgaccacccttttctctgttctctaacgttgtatcccaaagtagataaactagagttttatccttaccaaccatctttctctcatctccatcctactttcccagcactcccctgcacccccctgctgtgtgcaaagctccaatcccgggaaaataccatgcagcgctttcattctaaaggggagcaattgaaagcatttctttggtaatttaagcacacagcagctacctttgcaaaagcctggttgctaaattatcccctcaactactcattttgcaaaagggaaaagaaaaaaaaaacacactggggggatagagactctaataagaaaagagtctgtgttttctttaggttcagcctgattcctctccacctcctctcccttcagtgactgcaaggctcctggtgtggctcgttctgctacttttccttttaatgttttaaatgccacaaatgcttgtcataaaccaccttcttaattatgcagaagtggagctgaatggttagttagcagttctattgcaattactgcactttttcaggtctgctgctgttttatgtggcactgttttctaagttgctgattaagatgatgtagtgggtggagttcttcttcccaccattggagaagggccgctgaagcctgggataatgagtccttaggcaatagtttatggcctaataagagttaaggatgggagcaaggaggagatggagagttatgctcattcatttccttcttaaaaagaaaaagccctctggttttgttcaacttttgcttctcctttgtccagtgtagatgctgaaattgctagagaaatatccatgatggctcttagcagtcctaatcttatttggacctgatattctgaggcttttaggcatcttcagatatccttgtgcagtgaaagagccttgcattggagttgaaatgatgacgagaaaatttaagaactgttgagaatttgaatcaatctcttcatgttgccatctctctctctctctttttaaagccaaatatgaatactgctgtgtgccgatcttgagccctgagaagctgcacttccagtgtagttctaggtccccactgaaaataaaataatgtgaaattgaaagcagcatgctattgtaaagtagtgcaatcattcgttcattcacaggtacttactgaatgcctactatgtcctaggcactgtgtgaggcccaggggatggggctaaaaacaatataaacttcttgcctttatggaatggcattctagtcaggtatactgatattaaaccaatctggaaataaatatatactcttcaatggtgctatgaaaaaaataaagtagaatgaggtgctataaaaaaataaagtagaatgagggaatggagagtgtgctagggcatgctattttgggtggagaaggtttctttgtggcagtgacattgaaataagtgcctgaatgaggcaaagcaacaagatgtaaggatatccaagaagagcattccatgctgaggaaatagcaggtataatcaccctgaaacaggaatgcacttggcttattggagaaacagtgggaggctgatggctagaagacagtgagcccgcagggcaggacagggggtaaagtgaggtcaaagagataaccaggagcatattgtgtatggccttgtaggtgaacaaatgggctttgaatttaatataatttaatttatattttaaaatcatcttggcggctgggtgccaattataccataaagaggcaaagtagaagactggagccaccgaggaggctgctgcaggaatctaggcaaaagatatattagtgtggtagtggcaagcgtgctacattattatgatgtcctcggccttcttaagtgtttgcttcataaatcagtagagttgtgagctgtgacttggacctgataatgaatcattacttattttaaaattgatacatacaataacattcttaattttttataagctcatataaaatattgaaggaggattggtcttattttgcatctgtttattaaacattagactggagataaggttgtgaggccctagagccaaataaatattcccagccttgcctggcagacaattattgggtgtggaggttacccagcctccatgttgcctcagtgactccctttcctgtccttcactaggtaggaggcaaaaagctcagcagtgacacacaggctctgctctcctaattgctgtaaagaactgtgctgtttcttcttcaaaatgttgattgcaggcagctacagggatgtgctcttatgttacagtataaagattttttattgtaaagaaaggagatttgttggcatggtgggatgtgtgtatttgtgtgtgtgtgtgcaagtagctgtgcttgcactgggagactattttactttgcttttttcctctcccattataggaagtaatttttggaggaaaatagtatgacagtcctgatactattttatttattttcttcttcagagtaggtacaacagaaaatcctgaatttatgcttgttgtattttttctccctattatatttctgcgtgttcacacccctctattaacagagaaagtttatgctatattctgtactccttttactctttttattaagagaaagtgagaaagctgtcctagaattatacaaaatatacatatatttttccacatctgaagggtaaaggaattgtaattcatgggaatagagtgttaagggcttatacaatgatatatactatatatatatcattgtttgtatgtatgtacatatattgcacatatatacatatcactttttggctctacttttattattttcaagtttcttttatataaccccagctgctcttctgcatttagttaagtgcagtcctaccatgtctagaacccccttctattctgcctacattcacgactttcatccctcaactctggtcccatttatctgtcacttagcattaactacgttataatgccatttatcccttttgtgcatgcattatttctactcaagtgggccatttgcttttttagggcaaatatcataatatgcacctacttatatgctccacatctgcatcaattcagacagtttggttgcaagcaacagatactataggcttagactacctcaagttggtcaggaatgtattaaaagtctttggggtagcttacagaatcaaagcaaagactaaaggaagaggtttccaaaaacaatcagagaatcttgggaggtctaagtaacagggactaattaatagctattttaggctgcagctgctagaatgcataaactccaattatttccccccattcttacaacagcctgctgaagcctccaaggtattgggtcatgtgcttacccctaagagaagcagaaaaaaaaatcaccttttgacaatcctacacctctgtgaacaatgggaaggagatgtaatttcccaaaagaaaaccgggcactgagtggcccaaaacaattgtcctctataatatcaagcatactttggtgtccacagttggagctctttacagatctggtgtcagtgatggtgacgacaaggagaaggaagagttgtaaatgactttgctcttttgagtaagtgatcatcaaatgtccttgcagtcagaatggcaaacaaatggcatggcctgtcagtatctgaagttaatttgggctggctgtcctttctttttggatatttaggtttcagtaatgatttcccgaaggccacaataataaacatgtgttatgttataaaaagcgggtgctgcatacattggaagcaaggccccctaattgaatcacctgtgctatgactctttcaactcctaaggcataattgaagcactatctcagttggcatctttgtggtttccatccacacattcttactttctggtagctggattatgaacaaccccaaggtcaggcttgtgtagaacccaacatcttacatattttactattgataaaatacaccctgagtataaatgttcacataacactttctctcatctctatagttatgtttctttcttatgaccttggccacatactttaaactccttgggaaaatatgctgccgttaaaaacgcttcacctatttcttgaaaaatgaccgacaagatgtttttcgtccaattctgtcgtatatttctattccctagatttaaatttcctggacttaactgttccctatagttagcagaaacattattttaagaacaatttaagttgaacttcatgtgaaactggctactgaatctgagtcgggaccttcttctggagggaggtaattaaatattccttattgatgctattttaaatgtgttgaatgaaaggagttaattatacagcagggaacatggcagagttctgactaataatgagctcaatgtttaatgtcttcatctttgttagaatcattaaagttgtttgaaccaatcagatgtttcaagtgaatgtagactcacagctaaccagctccaaatggcaatccctcacagatgcaggagctggtatatctaatgatgacttcaggaaaaggatggcgatatattgctttcttccatgcagtataatctgtttcagttggtcttccatcgtgatggtaaagagaaaagaataagtcttatttccaaaatttcatgtgttataatggaatgatgtttgtgcctggacatataaaagaggaaatgattttgttttttccttaaagttttacgtagccaatctctttggaatctggtgcaatattgacatttctggctgccaattcctcacatgataaatgcattaacactaaatcttaggatgcccaggaatcactagaggaccaagcactgtcctaaagaatggatctcctgtaatactgttgtagagaaatgtaggctcttgaggtcaggtttttcataccgtattactggtttgttatgtgtctttaaataaattttgcaaactccccgacactcaaactacttcctcttaaatttctcctcccttctgattgcttcaccaaacagcctgtggctttgtttttatttacaggactcctaagactctgtcctgtcctgtctatgctggggaatgtaaagtacagaagattacttccttggttctccatggaagtccttttacccagctgtgaggattgtaacaatgattggcggtgacatcactctattactgaacttcacatatgggagttgggagactttgaggaatcagtagggtgaatttaccaagttctcccatgagcccaggcagccggggtgtgtgtgtgtgtgtatgtgagtgtgtgtgtgtgtgtgtgtgtgtgtgtgtgtgaaggaagagtaagtgttaggacagaacagcagccatcatgggaaagggaaatcctagttccacctaggatggttacttcgtggagagggttactttgggtagttacggcagccttcagggttttcaagaataatataacatatatgatttatatttttgaacttcgattttaccactgcgttccctccagtgtacttagtagagataggatcatgtgtatcgagagctcaggctttagaatcccacaggtctggaatgaaatctcagctctgacttttactacccatgtgactttggacaatttatgtatccactgtcagcccattagataacctttaaaatgggaataaagtagtgcttgctttgcagaattgctgtatggattaaatgagataattcaggtaaagcacatagttgagtgcaaaattaatttatcacatattattagaaatgtggttgaagattgttttgttatttagatgaatcatatttaaatctttcattttcaagtatctaagacttccaaggactaaaacttccctctgaattttaccactcatcccagctggagatctaagataactatttttgtgtttgtttgttaattatttgacatgtttcttctcaaattaagggaaaattcttatttcggagtcactgttcagaatgaaaatgtgagactaagtatttgttttgcaaagcgcaacagaatagagaagaaaagttgggcattctgtagggcgacccatttggaaaaataaatcctaccccttttgaaggggagaaattaatgagatgagtgtcagtccctccctccccacccactgacctctctctgggatcacacaccaacagcctatgatgaagtgttgctgcagtgcaatggagcaaggttaccttcacagtaacagcttttctctggccagattactttatagccaaagatgtggttattttcacctaaacgtttcatttaaatacattgtaaagtgtgacctaggaaaacgagacaaaatcattctaagctgtatagagttggattgtttgtagaaatgctggacattaaccaatgactctcaacttgaatgtacatcagaatccccaggagggcttgttaagaaacagattcctaaaaccttactccaaagtaggtgtcaggtggagcctgagaattttcatttctaacaaccttccaggtgttgctgatgctgctagccaaggaaccacacttagagaaacaccttcaaagtgcatattttcgtgtcttactattcaaagtatgctccctggaccacctgcattagcatcacctgagaccttgttggaaatgcaaattatcaggtcccacttcagatgtaatgaattagaattgtattttcatcaactccctgaagtgacttgtttgcatattaaagtttgaggaacactgatctagtgattatagccaaggtctttggagagttgagaatctgagacagtcagccctggattcaagtctcacctactgccattttctagccctgtgattttgggggtgttgtcatttttcttctttttaattcccaatttcatctgagaaattgggatgatcatacttgaaaagttgtgaagattaaatgtgataatgtaggtaaaatgcatacaattagtagtgttgttaaattatgtcttcatttctttttatgtgaaacctgtcctgtgaaaccattagaaacagctgtttgaagaaggtatttgaaattctctctgaagtgttttcctatgtcctgttttgagagaagctattttcacagtatggcattagattgtcctcactatattattttgtgtatgagtgacagctgtagagatatataatggtttgagtttgccaagtcacagccccctcgtttgacctctgaatttaagggtgtgtgtgtgtgtgtgtgtgtgtgtgtgtatgtgtgtgagagagagagagaaagagatacagatagacatttcgttggaggaggagtgtgagggaaaacctagggttttctttcttctctaataataaaatatgacataggctttcaaagataaaattcgatttgtaatatttgacaacactggttagtcagccctaacctcactgatatattatgaagatgaaggttatgccagttaataaagtgttttgagaacattgaaaggtgctaataaaattggatatttgactttttatttacgtatgtatgtatgtatgttttgagacagagttttcctcttattgcccaggctggagtgcaatggtgcgatatcagctcaccacaacctccaccttccaggttcaagggattctcctgcctcagcctcctgagtagctgggattacaggcatgcaccaccacgcccggctaattttgtatttttagcagagacaggtttctccatgtttgtcaggctggtctcgaattctcgacctcaggtgatccgcccacctcggcctcccaaagtgctgggattacaggcgtaagccaccgcgcctggcctgacattgtttaattttttaaagtacagcccttagtgataatttttccttttctgtagccagagaggattctagtattttggcagttggacgatatcttatctctctcaatgccctcatcagttgagaaataagcctctttcttttagtattttatattctcaaagctcagaacatttcagagtcatgttatgtaaaaatgaggtataatggctgcagagaaaataaattaaaatgagaattgcgctaatgcaaattaaaagggttaatgggagcattttcttctgggtctcaatgtaggtctctgtacagatgattgaggggtttttggatcctgagtgttattcagcttggaggggctcttttctgaaattgctggctcccatacaaataggcctcttaggaccagtcattatgatgcacaccttgcactataactacatttttaacatttacaggtagggcggtggagctcttcactgcttagttactacccagggtaatctccttcaactgtaacagcaagtcaccaagttcttaatgagtatctcctgttggtccatggtaatgagggtaggtgtgtgggagaggcaaactgtaagacctttcgctgcaaatcctataagcacttgccactcaaagtgcgatccacaaaaccagcagcagtagcagcacctaccagcttgttagaaatgcagagtctcaggccccacttcagacccactgaaagagaatcagcagtttaacaagatctccggaggctgtgggggagactcacaggcagcttaaagtttcaggagctctgctttaagaaacattcctttcagagagggaacttaaactgagccaagatctaaaaccatgtgaactccaaattcagagaatcaggtcagtggtcaccagaacagagggtataataattggttataaaccattctaatagttgtaggtttaaaggaacatgtaagtgtgaggtcagttattcactgtattatgaaagatatgctttatagtttgcctcaaaaaaaaggaagtctgattaaatgtcctcaatctatgtggcagatccaagtaagaccccaaaggttaaaaacaaaacaaagcaaaaagggcaatgccgtgatcaattgcaagtcagagttaagatcaaaattaaaatatgaggtttgtaaatacaatggtaatagaaatttgacgttagcatacgaggctccccattgtttggaaccctggtttaaaagctagaatcaaaagaattttgtctagacctaatgcatactctcacttaagctaagtggaaatctttgcctctgttccagtaaccaaatctgtggcagagctgggagtggaggtattggtgagggttgtgggtggggagcagtgtcatcccccaacacactttgtgacagtttttaaggaattagttgatgagactcttgtttattctatggtgcagagagattagaggaagcagtttgagagcaaaggtcagactgttgatgctgggttgaaatagtctctaagatgcagacaggtatagatgtcctgccaacaaccagcaacacagggttgtccccagacttgctctcctgatattagagtctggctattcttctgaaccaaatacattattttactttatgacaagtgctattacatttaaggactttagagacactgtgattctctctgacatcatagcaaaatttttatgtgtgtgcccaagtactactactttttttttttttcctttggcttcccaagaagaggacctacttattgtttgtatcagatttttcaaggcaccttgggatataaaattttaagtctgctgaattggagaatttctatttattttcccaggggaaccctttggagttctgtcctactcagctgcgttatcccctagatttctgtaactgtattagttaggatgctttggagtgctagaaacagcaaatctggctcaaattgctccaaccaataaaaccaagtcactgacatgtaactgtaaccgcccaatgggttcaccttgtctgctgcctagatagaaccgatttatcaagacaggggaattgcaatggggaaagggaaattcatgcagagccggctatgcaggagaccggagttttactattactcaaatcagtttccctgagcatttggggatcagagtttttcaagataatttggcgggtaggggcttgggaagtggggattggtcaggttggcaatggaatcatagggggtcgaggtgaggttttcttaatgtctgctgttcctgggtgtggtggcagaactggttggaccagattaccagtttgggtggtgtcagccgatccatcctgtgcaaggtctgcaaaatatctcaagtactgatcttaggagcagtttagggagcatcacagtcttgtagcctccagctgcatgactcctaaaccataattgctcatcttgtggctaatgtttgtcctacagaggcgatctagtctccaggcaagaaggaggtctgctttgggaaagggcttttatcgtctttgttttaaactgtaagctataaagtataaactaagtttctcccaaagttagttcagtctacccccaggaatgaacaaggacagcttggaggttagaagcaagatggagtcagttaagttaatctctttcactgtctcagtcataattttggaaaggcggttttataactgaaaagaacagcctggctcgctcttcatgagacttgatacagggtacaaaggtgtcacctagagcatttttttctttctctttatttcctgtgcctttcctgcatctgccagaagatgacctaccaaggctagatccttgtgtacctctcaaatgttggccaacaactctggggccaactgctttccctttcaatttgagttggagagaaataatttttgtcccatcaatctcaggaaaatactttcaatctcaggaaaatatttcaaatatttccttcaaattcactgaagttgggttgatatagtttacctgcacagtctggaggaaagaatcctttttcccttttttgaggagatgttgtcttgctctcttacccaggctgatctcgaactcctaggctcaagcaatcctcctgcctcggcctcccaaagtgctgggattacaggtgtgagccaccatgccctgcctgaaaaaatcacttttgccagagggatagctgatttagttagtgcatgtgctctatccctggagccagggcagtttctaaatggaagtcagtggaataaaattctgggaagagaggtaaaaaaatgtttaccagttttctcagaatgccagctctgtttgacacttctctctcaggactttgaagactccaagaggaatgtattattatctatattctactgaggcaagccctgaagtcaaaagttttaagtgaaataggtggggttgtgctactggtctgccaactccagatccttccagggctcatctgaccatgtaggagtctagtttatggtatccacccagctggtgctaggaggtgagtgagaggaagaagaggcagactctttctctctccaattagcctctgcctctctgtttggttaataagatccatatatttaatatgctcaatgtgctttaatgtgttaccaaaccatttgagtctgttgtcacataggaaatgtagaacttttcaaacactattaaattcccttaatcgattaaagatactgccaaaatggtttacatgaaagaactaacataatagattaaaatatctttttcttttacatttattcattacattaaattttatgccatggttatagatctgaaactaattaaaacaattatacattgacttttttattcctaaatgtatcatgtttttagatgtgtaaaaataagaaacagattcagatttaaaaaataagctatgactcaaaaaaaattaatgtgaaatgcatctggaaaatttctcttttgaaactgaaatattcctcttactaaaaagttgacaatataactctttgtaacacaaagtatatcaggagaatctttggcaaaatggtgaaagaaactcttacagaatatgtaagtcacctaagttccagaattcaatctgtgctaagatttttatggctcagagggaaatatcatggactctttatgttataaaaggagtgaactatgtgattatatcttattctgaatatcaactgtaagaagcagattctcacgggcttcatccaatatgctcttgtaattctttctaacatatgtcctctattcacgaagaacaagaaaacatctccagtttaactgcattttttgtttgttttattaaattctttttttgggtatttgcacgttccaactacccagaaaattactcaaaatatttgccttgtggtctctgtggcactgagcatttaaagcaaactagtgtagttttggcttggtagagattgaacaccctttcgtgtttcaaatatttttagagaagaaattcagatacaaaagccatataagatttatcatcactttgacattaagggagcagccatgggttaaattacttgctttaggtgggtaagggaaattgatattacaccgattctgtcctcagcaccagactgtgtaatgtggggtcaccagaaacctctgacacagctcctgtcctcggggtgtttatgatgaggttttgagaaaagccagactaataagaattagattcacaatgccatgtcttagcaggatgatatagtttgggtacttgtcctctccaaatctcatgttgaaatagaatccccagtgttggcgatgcagcctggcaggaggtgattgggtcatgggagcaagtctctcatgaatggtttagcaccctccctttggtaataagtgaattctccctctgagtccacatgagacttggttgtttaaaagtgtgtggcacctccctcctttgctttctttgttcctgctgtcaccttatgatacccccctttaccttctgccatgattgaaagttttctaaggcctcaccagaagctgagcaaatgttggcacatgcttcctgtacgtcctgcagatccatgaatcagttaaacctattttctttataaattatccaacctcaagtatttctttatggcaccacaaaaatggccgaacacacaagatatgtctgcttggcctccaaaataaatctcaggtctctgattctgcctctatcaacctacattaggccaccatcgtttctcacctaaaccacaactatattcccctaaatgatcttcttgcttcagtttttttccttgtactggtttatcctacctatggcaaccagagttattatttagaatgtaaaacacagcggctgggcacagtggctcacgcctataatcccagcactttgagaggcagaggagggtggattacctgaggtcaggagtcccaggtcagcctgaccaacatagtgaaaccccatctctgctaaaaatacaaaaaaattagctggatgtggtggtggcacctgtaatcccagctactcaggaggctgaggcaggagaatcacctgaacgcgggaggtggaggttgcagtgagcagagatcatgctgttgcactccagcctgggtaacaagagtgaaactctgtctcaaaaaataagataaggcaaggtaagataagataaggtgagataagacaagatatgagcacatcataaaatgatcttgccaaaaaaaagaccattcattgatgtcccagtgcacttaaaaatcctaactctttcttactgcctggaaatctttacatgatcactgctaaaatctcagatcttgtgtgctacccctctgcccctaaggtcactaccctctgatcacattaactttcctgttctttgaagatgtcttggaacttgccattgtttctgtgtgaaatgtgtttttcctgtatgcttaggtgtatcactcctcgttatccagggttcacttacatctcgcctcagtgaagagatttagcttgattgccccatccaaaaagatcttatttgttaacttatttacatggatactatgtcttccccaacttcaagttcatgaggtctgtgtttctgtcttgtttatcaccccaggctcaatgtcttaaaatagcacctcgtaggctctcaataacagaagatggcaccaaattaatacactgaaaatgccacaagattttagataaatgtaaaaacattcaggctttgattatttggtgaacattttgaggcattacgtgagttggagcaaaactcttgaggttaaataatatttgaatgggctctgagaggcaaggggagcgtggccatgcttgtccccccacccttatctgtattctgataagaaaatacagaataaatttctttgaaattaaaaaataactcaaactctctgtaattatttttctttaattttctgagagaaggtttttttttaatttggagaaatttttaaaaattaaataaaaactagaaataatacttaatgtcttgacaaagtattaacttgatctagtttcagaaagatctcattaaactgcctgataaagtgattattcagtgccactttcatagagttttcagtaattatctgaaatgatttttagaatgaggcaacgttttcctttttttttttttgaaacagagtctcgctctgtcacccaggctggagtgcagtggcgtgatctcggctcactactacctccgcctcctgggttcaagcgattctcctgcttcagcctcctgagtagctgggactataggcacgtgccaccacccctggctaattttttgtatttttagtagagatggggtttcatcatgttatccaggatggtctggatctcctgaccttgtgatccacatgccttggcctcccaaagtgctgggattacaggcgtgagccaccgcacctggccaacatttcccttttcagtagcaggtgaaaccgtcttggtattgacacagaaatgctgataggaaaaggtgatgaactcatacacactaaaaatatgacatctacctctaaaagttttagaaatatgtggaaagcattcttggcccttttctcctaagttaagactgttcgcaaatcacttttgagagcgaagtgacgatgacatttttctcactcaagtcctaactcatttctaggcatataatttgaattaaacccttatatataattttctaattagatttttcttctttcatggctttttaagctttacataacctttgtgcttcctttttccattaatccttcaaatgccagcatcctgccaagagggtatttaccgcagtatttccatcattgttaacagagccacaagtttttttccagtatattgaaattacccatccatgagaaaatgcagtcttggatttttaattatttagttgacgcttattcaactatatgatgtaagtaggccttttctccctaatgttttattaccagttaaagcacagacaggtattttactttaatttagatatagagtaggtaacagagagctgaaattttaaaaattagataaattttttggtagttagttttatagttaatcttctctctttttttttttttttgagacagagtctcgctctgtcgcccaggctggagtgcagtggcgcgatctctgcccactgcaagctccgcctcccgggttcacgccattttcctgcctcagcctcctgagtagctgggactacaggcgcccgccaccactcctggctaatttttttgtattttttagtagagacagggtttcactgtgttagccaggatggtctggatctcctgacctcgtgatccgcccacctcggcctcccaaagtgctgggattacaggcgtaagccaccgcgcccggcctaatcttcttaatttgtcacttagagtagggcagtcgccacaatatggaaatgagctgggattagtgttatcactgggaagtgattgtaacttttgggtttgtaccaagaagtatatagaattgcttaaacttctgcatgatcaattactgcagatttttgcacctagctccactacgtagtccatcacatttcatagggcgatttctccactcctttatcatagaaccttaggagagaatgttcttttataactcccttgatggagttgcttaatgctgcctttaatttaattgaaaatggttgatcaataaagtcactttttatggatttatttctactgtttgatgtggcaaatcattaattatcattacctaaattagcatggattgccatgaaagtgaaaggagtaaattgctttatggatttcctagtgcatagtacacatagaacttttctaaatatacatcctcttcagcagttagtttgtgccagatttcaattcctacgctacaagttctccagcaaactagaggtgtccatgtccaagtggacatgctaaaaaattcaaattttacagaaattttacagagaccttacttttgtaaggtctccggaatctttaaaaaaaatctatttaattattgatagaattttagtgaccaccatagaggggagtacctgtgtaagcagaaagcaggaggaaatgaacccatttccagaaaacgaactagacattaaggagaaaaaaagaagagaaagaaaagtaaaaagaaaggagagcaaatacctctaggttttttattctgaaagcccatgttatgggttgaattgtgtatctcacctccgtcctccccgggaaaaaaaaatacacacacacacacacacacacacacacacacacacacacacagacaatattatacataatatgttgatgtcctaacctctagtacctaaaaaccttaaaacctctagtacctcaaaaattgtatatagtatgttgaagtcctaacctctgttacctgtttggaaacagtcttaacagaggtaatcaagttaacatcaagtcatcagtgtgggccctaatctgataggactagtgtccttataagaggaaattttgatacagacatacatagaaagaagattatgcaaagagacacagggagaagatgccataggcaaaccaaggagagaggcctagagcagctcttagaaggaaccaattttgccaacaccttgattttggacttctggcctctagaactgggtggcaataagtttctgttgtttaaaccatagcatttgtggtagtttgttacagcatcactagcaaactaatacagcccataatttatgactagcatttcatattaaaattaaacatattatatgaaagcttccccaaacactggaatactataatctataagagttgcattaactattttcatggaacgtcagaatgtggaatccaaagaaattcagagcctaagctgggtactatcaaagcattttataatcaaacattcaagtatgctctgattgagagaattgatttccatatgtatctttaataaaggaacccaactttcatactttcattgtattaacaagaacaaggcacagactttgttaagcctgattctgaatgttaagtaagccaagggtgaggaactaaaatttgtagagaattgagtcatgtagtgtctactctactgtgggactctggtgttggaattatcaaatgacaatgtgaatgcatcatagagatttatcctggactagcttacacttggaccaaaggtgatttatcaggcttatcattttatattgaagtccataaactctctcttctgcatccctctgttcgggagtgtgtgtggcatagaacaaatcagcctttggcacacattggaggaaagggtgtgtgttttgttttcataggttttttttagtgatgacaatcaaaagcccattttcttgattcctatggatatgaagccgattaagtattgataaggagtaaggtattagagtttaaaatcggggccatctctgagctacatggttaggtcagtggcacctttctctgaatccataatcctccaagccatttcaggccttttatgcagtcctactgcaacccagaactccttctaggccttcctctccaggagcagttatgagattgagtgttaactgcttataagacaccatatgctacacaaaactttttataaatgttgtgcttatatcaactttgacattaatgctattataatcctcaatttacagaagaagaaactgaggcttgaagcggttaaatgacttccccagagacacatagcagtatatgctagaggcaggactccaacccagaactggcagaaaagctgatactttcaaactttcaactaatggtctctgcagcctccaaagtatcagatttctccgtcaaatccttcttgcctggtctgtctgaccaactaatctctgataatgtaacgaaggttataataaatcccttccagagaggatatttgcatttaactggatgtttatgaaataatgtgctggcagaaagaaatgatactcatggtgggaatttctcattctttttctggtggaatgtataatcttggacaaatcatgaccgcaggagtcttcattttatcatctataaatgccaggattgggttaactactgtctaaagatctcttccagattcaaaattctatgattctttcacattaaatgcaactccttttcaacatatgtgtatacttggccctttattgaacctttttataagctgccaattggaaatacacagtcacggtagatatgacaatgagcaagtcacttaataactatcagcctcagtttcctaatctacaaaaggaggctattaagagcacctacctcacagtgttaatattatatacacaagtagcaaaatgtctggaacagagcaagggctcactagctatagctttaataacgtgataactgatggtgtgatcagttctattatcatctccctgcagaaatcacagtttatctaaggttatagtaaaagcacccatcatgacttcttttaatcataaagcatttcatgcagagtgcatattttaactttgtattctaaaggcattggtgtctcactaaaagctgggcagtatttatatcaaacagtatatcatctatgtgttcatttatgcatgcagactttcacccccctccaagctatgagaacaataggcgctttaaaagtctgaagcaagaaggatattagctccatgaatctttattttaaattacatttctgagttagaagtgtcaaaatggtagaacaagttaagcaagattgcattccccagtagggctattgatgttggttgcaaataaattgctggagcaggtgatgatagcaaagtccatgccatcttttatttagcaaagtatttctcttgttaacagctccttctgcatgctttcctttcttctgtttcacatcaatcatatttgacacattgcccaatgtcagggtaaaaaaaaaatgcagcgtctggctaatcatccagatgtttggcctcacactgactgaaacatctggttgtgtagctaaatgttatgttctttcatccagttattttgtgttctgttagacagaactgaagaataaaccctaggatcttcttctattaggataaagcttatagaatctcgaacttgagattccagaaccaaggccttactggttctcatagttgcacagctgtcagcagaatccggatcaattgagataatgtgtgtggaagcattatatagtatgtggaggcattatatggatttgagaagctcatgttaaaagaattctactccctttacttggttatacaatggccaaagaatgtttgtcttctggaaagaagttttaaaacagaataaaaattaattggtgttagaagccaagatttcagagctagaccaataataataacagctaagatatgtctgatgctaactctgatccatgaactcttctaagtgctctgcatagatgtaaaaacaatcctttgaagtggaccctactctttttttccattttacaaatgaagtaactaaggatgagagtgcagttaacaatttaccccagttcagaagctcaaaatttggattcagacaatttgatttcagagtctacgtatttaacttgtaaacttcctctgaaatcaaaatgtttattcagcttccaacaccatcacttattaaacttggttttgtcaccttaaagtggggatagcatgacataccttaaaaggattgttgtaaaggttaattgaaaggatgcatgtaaaacatttaacaatgttgttttttggtaagtagtaagtaaaagtagctattttttctctatgttatgcaatatttggaatcaaatatttcaatactaatttaaataatatattctaataatctcactttctgaaaattcattcaatataatttttttttcttggaagaacattcctagcaggttaagcacttttgatcaactcttgatataggctgttcttaaaataattggaagtccacaaattatatgtttctggaaactattctgaatatggaaaattatattcctttttctttttaatgaacatataatgagtatgtattaaggggaagatatatgctgagcttcctcttgccttccttttctcccccttcatttctgtcaccctgcctttcctatcttcacaatggtcctgtacagtaaactttgtttgcttttgcatttgaactttaggaatcaaggtttttaaagaagctgcatcatgtatcataaataaaaacgaaaaaaatgaagtgtaatattttaaactgttttagaacatgaggctcagtgttctatccaacaggctatgaaatattgctgttactaataagtatgatgatgaaagccactgattcttggacaactactatatgcctgacatattgctgggtgctttgcatacattttctcatttaacgcttagaagttcttgtgattgacacttgggtatcatgagcaactttgctcaccattttttcctatggtccggcgtctttagtcacttgtattactgttgttcagagtgacctttatttgattcatttacctttcagaatcttctattactcatgtatgaggaccacacatttataattagggagtaaatttggtcatcaactcggataaggcaatgggcaaatctgacatgttttcaaagacttttcagtatgctaactttcagtagggctggtttctataacagctacgacatcttttgtcaacactcaggctgattaaattgcaagattataatgttttccgaccctaagtgaaagtgacacattcttgttcttttagtggcttcataaaagtcaaatgtttaatctcaggaggaaatttaaaagatggaagtaaaaccttaatgagatgcaacataaataatagaagtccctttgcgtgaaatgacttgtgatgaggtttcttcaaaggaacaaactataaaatggagtgtttcagaaacctaaaatacactagtaaacactgcgttttaaaaatatggtatcaatgatactcagcattcagtaaataaaaagagttagacaactggtgtctgtaaaaatgttaattttccaaaacactataaatgtatcaccaaaaaataaacattttttaaaaaaattaggtgactattttcatgaatttttagtccatgaaacctgaggagttacttgaccacagcaaagattctttctaatcctttatccagccttttgtgcaatagtacctcctgttccactcacatttcacatgcctgtatgcatgtacattcagatgtgcctgtctttgtctcccagtgcttgttacacagaaggtattcaagaaatggtagccattctcacaatatcattcctattaccatttaaaaatgtatgtggaaaagggtaaagtgcaaacctgggttgttaaaataccggaaggatatctataatttaacaccagttcatttttgttttcaaatcactccaaaatgccctcacttattggtttagaaataatgtaacaaaacaaattgtgttgtgtctccaaagaacattttgctaagtgccagagctgtatataacactaaagtagatgctgacatatgaggattgtgagagatgaatggtgatatttggcttttgcttcccaagtataggtcgtgtccgaggtatagataattgttgttggtttatgataattcgacttgcggagttaggtcagtcagcatagatgcatattttttggatggttttttaacaatgttgcttaaaattttaaatcagattatttgccaaaggggggtgacaagatttggttattagcaaaaaggaaaatattaatctagatttgtttggtcttagtactgattatgaataagtcatcaatagttaatgataaggaatcagtctgctgtgccatattggtagatgaaatgctgctactcctcctattcctgggcttttctgtcccccacccccttccttccctccttcctctgtccctccaactcttcttcacatctcccaactcccccaattcacttcttttccactgcatgccatgttaccctatgcctagttatgatcctaattgtaaccctagttagagtagacacaaagtaaactcaggagcagggattataaagctcaaaattgttcctcggctccgcattttgtgtttattaacctattttacccttgcagcaactccaagcaagtctgtaaattttagcattgagagttctccattttgtgagacccctctgtctggtcaaagtgggatgacagttggtcactatagcattcaataattatccactatggttatttttattcttacagcttttattgaaagtttctttttaaccatagtgccaaagacaaaataaacaataaatattaatgattttcttggcttctatttatgatattgttattttacttttaaattctttggtatcttctgccctttcatcttttctgttctgttcagtcaagacttagctgatcctatctcaacctcaaacatatcttttctatttcatctcttgactagttagaaactttcacggcagctaaaatctcccacacaaatctgagtaaagaaaccctagaggtcaaagattgtagtgtaaataaaagtattttcctttatatatgatataatttatatgtgttatataatatgaagtctcaattagaatagggaaaatgaaattcaataattattagagtattatttgcgaagtgttctgctaatatttttcctcctattaatcaaaattagttttgtattttttttccatagcaaagtagtctaacaatagagaagaatgtcttttaaaagactaaattaggtgaaatctattctttttgttaaattatcctaatgtaaaaccaggtggcctgattaaaactagccttctttgctgcctcctactgtttcaagaaaaaggtcgccttaacacttagtttctcttgctgtcttttgtttggagtatgtgtgggggtgtgttatttatgcaggcatagctcctcattatgggaactccaagagcctgattgtgactgttttttaatgccgcctgctgtgttgtccttaaactcttgcttttcctggaatgcacaactttctcccagctcctggtttagccattggtgtcatgtcttcatgctgcatccttgtgcctctgaaatcgtgttcaaaagagtgtttatgtttcaaattcatccacagtctcaccacatttaaagataattgcagaaggtaaaacactattaataggaacaaatttactagcatctcttttactatgtgtcttatgcataaagcagtttctggttgttgggttatacagtgcctattgtgatagtctattctaccttcacctcccgccccactgcctccccatttaactaaagctcctgctgatatgttcaatttacttttttttcttttttttgaaatggagtctggctctgttgcccaggctgaagtgcagtgatgcgatcttggatcactgcaacctaagcctcctggggttcaagtgattctgctgcctcagcttctggagtagctgagactacaggtgggtgccaccaggcctagctaatttttgtatttttagtagaggcagagtttcactttgtggcgaggctggtctcgaactcctcacctcaagtgatctgcccacctcgtcctcccaaagtgctgggattagagacgtgagccactgagcccagcctgatatgttcaatttgataaatgaatgtgttgaaagatataaaatgtgttaatccctaattgcatgtggctgtgatatttaatatggctgattctaatggagtttgtaacttatggggaacactatgaatgggatattataaatatttgtatgaagtaatacaagagacatttcaacagaaaaccatgtgatctatgccctccatcattattttctttctgtgtaacaaatgaccaagtaaaagtagtgaattaaaatatgagtaagtctattttcacagtattcataatttattataaacttcttttttaaaaaaataaaaaaaattaacttctattcctttaacaaagcaaagcaaaccaacattattatcagctaatgccatttgatttcggtttggtttggtcagtctcagggtggccaatcatttaagttttctgggactgttccaatttaagcactgaaagtttcacttcctgggaaaacacacactcctttgagtatttaccgttgacttccaggtgacccacttaagggcttcttccagaagggcaggcaataagactatcaagactcttcaaagcactcttccccaaagccattagatgaggtccaattttctcagcttgatatttctgagaactgctcttcctttatttccaggatttaagaaaaataaaataaactgatatatatatacatacctttagaaggattcagaaaagaagaaatggccgtttcaccccaatatgtcactatagatatgaatgccactcatagaattgacacgtcatgtttttaacttctgtgctttaggattttcctgtttgaattgtttatgtgcatgtgattttggtggaatttcttcccctttcctctgttccttgctccttcttttgctcagtcagcataggaacatagctcccacactaggaagggctggaggttagtaacatcaagcagtgggctttcaagttagtttgcaccttggtttggaagtgtttgctcaggtctcagatacacaggagactgtgtaatcactcttgtggcatctactacacacagcacgtgagttattcctaaactgagcacaggctcctgggtggtgaatcctagtctttttatctcctgcaggctaagccttggtatttccttcagattacaccaaaaccaaaataatgggcaatgttgtccctgaatgttcaaattaggttgagtacacagagccaaagactatcaaaagaaagtgtcctggccgggcatggtggctcacgcctgtaatcccagcacttcgggactttgggaggcagaggcgagccgatcacgcggtcaggagatcaagactatcctggctaacatggtgaaaccccgtctctactaaaaatacagaaacaaaatcagccaggcatggtggcgggcgcctgtagtcccagctgctccggaggctgaggcgggagaatggtgtgaacctgggaggcggagcttacagtgagcagagatcgcactactgcactccagcctgactctgtctcaaaaaaaaaaaaaaagaaagaaagagagaaagaaagaaagaaagaaagagaaagaaagaaagaaagaaagaaagaaagaaagaaagaaagaaagaaagaaagaaagaaagtgtcctaaaagaagtggtggtacctgtggggcgtgtttggtgtcagagtgtttctgctaaggttattttaattagcctcctcccaaagccctccccctattctccttgaggaactgtttgaccgtcacatccttagaaaggccaaaccactactaactctcctgaccctctgccttatcctcatacccttaaagatgtgacttaaaagagaaaaaattatgttgttaatttcatcaactagggcaaaggggaaaaatgttcatttcgatgcaggaagttaatgggagatgggaggaagctacggttacaattcccataatacattaatgtatatttaatataccaccttgatttgtggcctcaagttaaataactacatatgtttgcagcataattcttttcataattgtgtagcctcaatgggataacatttgtattagtttccataatcgaaaatgtcaaatgcctgtttccaccttccaagtattttggttttaggtagcaaagacaattctttcaatgcgtatctgttctcattaagttctgattgctttataaagaaataaagtcttttcccattgttctgctctgtggaagtcaccttcagagtaagggtgggggtgactgtccttgccaatttttaagtaactgccttgcaagggtgattccctacagagttattttctgcatagtttccctctgggtacagaatgtgggaaagtagatgcaacgcattttagagtagtcatttgctctaataattagcattatagtacagtgtatgggctggcttcctgttgaggtctagatttctacatataatgtaggtttttctattctgtcctatattaatttcattggagttactctttatcagagcaaacatccgtaacatttagtctttttttttttttttttggagacagagtcttgctctgtcgcccaggctggagtacagtggcgtgatcttggctcactgcaacctcttcctccaaggttcaagtgattctcctgcctcagcctcccaagtagctgggattaccggtgtgtgccaccacacctggctaatttttgtatttttagtagacatggggtttcaccatgttgagcagagcaataactctgtagggaatcacccttgcaagccagttacttaaaaattggcaaggacagtcacccccactattactctgaaggtgacttccacagagcagaacaatgggaaaagactttatttctttataaagcaatcagaacttaatgagaacagatacgcattgaaagaattgtctttgctacctaaaacgaaaatacttggaaggtggaaacaggcatttgacattttcgattatggaaactaatacaaatgttatcccattgaggctacacaattatgaaaagaattatgctgcaaacatatgtagttatttaacttgaggccacaaatcaaggtggtatattaaatatacattaatgtattacgggaattgtaaccgtagcttcctcccaactcccattaacttcctgcatcaaaatgaacatttttcccctttgccctagttgatgaaattaacaacataattttttctcttttaagtcacatctttaaggatatgaggataaggcagagggtcaggagagttagtagtggtcttgaactcctgacctcaggtggtccgcctaccttggcctcccaaagtgctaggattacaggcgtgagccactgtgcccagccatttgtaatatttacagagcattgctctttttcttatcatggaaagttattccaatatctattcattctatacacatttattaagcatctactatgtgccaatgttaaagaggtgaaagtgtaaccttggccctcagactgactttttgcaggttatgctgaaagatgaatgctcagtaatagctcgtgccttaagacgtggccgagcaagctttggaggtaaaatagctcatggagtttttatttatttatttattctttaaaaatggtcacaaagatttcagataaacaatctgagtatggctaaattatttttcttaggtaaacataggaggcaagaaattaaaagggtgggagaaacattaattaggctatgctcttatcaagtagtgtgaccttagcgaatttacctaatctttttgaacctcagtgtcctcatttataaaatggaggcataactttttatgaagattaagataatgtgtgaacaatctgtgcagtagtagttgctcaataaatggtagtgattttcacatgtatttggactattgtagaatatagaaaagaatatcatgcaaactctagtcctttaaatatgagtgaggaagaggaatcacctgtgtgtatgtgattaaagctgttagctatgatgaaggcagggtgatttttctctgaagggtaattcgagtacagagatattactttgaagaagtaatatgttaaatgaaatcattggggctgaaagtggtaacaacattctgggaaaggagccgtttactctcttcacctctaagataaaccataatgcatgcatgtatttaataaactgtgatagctagagctgtttcactggggcatcagtaagctatcctcaacccccttttcttttcttccagcttttcacttccaaccccctaagttttatcagaattagttaatactgagtccagctgaatacattgcttgttataaatagaatgctttctcccttcctctgcccctgaccaaacaattgattacaaagtttatctgctgagtgcggtggctcatgcctgtaattccagcactttgggaggccgaggtgggtggatcacttgaggtcaggagtttgagactagcctggccaacatggtgacaccccgtctctataaaaaatataaaaattagcccagtgtgttggtgcatgcctgtaatcacagctacttgagaggttgaggcaggagaatcacttgaacccaggaggcagaggttgcagtgagctgaaatcacgccacggcactccagtctgggtgacgggctaaatagaatgaaaaaggaatgacccatacctgaaatgtttaacataataaaatgactgatatcgattgatgacgttgagagcaatgaccagatataagggaacaatgtgtttttacttggattgtagatatcaagaatacaggagaatggaatgggagggctaacaactctagacaacatggctgcaatctatgactttgcattcttgctataatttactttcagtgcttttacaaatgtaagactctcgaggccagcagtgtatcttttacgctattcattctacttttataattattattattattattattattattattattattatttgcaacctctgcctccaggtttccaacaattcttctgcctcagcctcccgagtagctgggattacaggcgcgggccaccatgcccagctaattttttattttattttattttatttatttattttttattatactttaagttctagggtacatgtgcacaacgtgcaggattgttacatatgtatacctgtgccatgttggtgtgctgcacccattaactcgtcatttacattaggtatatctcctaatgctatccctcccctctccccccaccccaccacaggccccagtgtaagaaatacaataaacaaagtatcttttattttggctacgtagttatgttgagggtcattcatcgtcctccagtttagcctatttggaacggtactggttaatctcaataaacaaataacattgtcagtttaattgttcaattattggagggaaataaatatatattaacctaaatgttaaattctgcaggaaaaaaactgattagacatagacaatatcaacatgggtttgttaaataacttgccttccaacaggacccaaccagaaattggaacctatgtttcatagaaacatgattcttagaaatgatctttacacaattgtaaaacaaagggaagattatgtgacgcagatgccaagaaatcagacctaggcaccatgtacaagtatacaagcaatgccgagttcatcagtcccatggctgctgctaaattgggctttatccccagcaaattaacacagttccagcaggcacgataagtttactctgaccagattactgggttgaatggcatatgccgttattttagaaagatgcagaataacatttccatttagagtcctggcagaacaaagcttggatttgggcaatagataaaaacacatagagagtatttgcagatgcatgtgatagatagaaatggtgagtgaccatttagaaatttagaattggaatttttttttttttttttgagtctcgttctgtcacccaggctggagtagtgcaatggtgtgatcttggctcactgcaacctccacctcctgggttcaagcaattctcctcccccagcctcctgagtagctggaattataggcgcccacaaccgcacctggctaattttgtatttttagtagagacagggtttcgccatgttggccaggctggtctcaaactcctgacctcaggtgatccacctgcctcggcctcccaaagtgctgggattataggcgtgagccactgcacccgacaaaaattgtctcttttttgatatttcctagagcagtgtggctcatttagattgaaatatctgtcagaagctatataccagttccattgatttcaacattaaaatgtctccacatattcttccgcatccttcttccagctcatagctgtaattagtgttatgctccatggagtggcagaagaccagctgaacaaacagccatgtacgtaggaacagttccaggcagctaaaagagcttcttcctcacttgccactatcttaaatggtatctggtgtctacagttgctccttctactttcttaagaaaaaaaaaaaaaaaatccaaatggaaaagaggactctgaagacaaattagtcctttacaattataattttatttgatttcaaagcagtacttggtatagcaccagtccaaacagattggaagaatgatattttcattccagctcctgcatagaatatctttgtgcttttcaattgctttagggagcttgcaacaatagaatcctgttaaatctaacaccattttgaactcttccttgccgatattgtgataagaaatttatacctggcccaggtttatctctgttgataatgggcttcatggctatagggacatgttgatatggtgagctagcacctatcattttgacacctactctttagtagacatagagaataatgggtgcttggggtaaagtgctggagaagagtgtcagcagtcagtgtgtatgaacctagtgatggatgtctctgtgtttgtgctgtggccatatctgtatggctatcattctttcttcctcttctcatttcttttaattttccttcaacagtctttcatttgttgcttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagaggagtctatcatgcaaggatgcaaaggagtatgaaatcagtcacaaatgtaggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgcagaccgagagcagaaaatggacagtagggaaaaatgcaacatttctacttggtccagctgcctttgaaggatgctgatgtttcattttttatttcttaccccaaacatatttatttgctgagtcattaaatagggcaagtgttatttctttctttgtatttgccatctcaccacagaagagttttattggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactctgtctcaaaaaaaaaaaaaaaaaaagaaaaaaaagaagagttttattaaaccatctcgaatcgatattgttttggcacaaattgcactaataacttgaatatatagttttgtttttttaaaggtgccttcaaaatctgatacgtataatgtatgttaaaattgatatttctgtgaaagaggttaagatcagaccgctttctgattgcagagataaaattgatagttaacaagtatttattaaacatctattatgtgactagtactatgctagggcatgatgaaaatgattcaagatgaaccatgcaagcacccctctcttcagcacctctgtgtgtaaaacataaacagaatgctatgattaacactgaaagggttcagtccgggatacttgggataaaaatcggagcactgataagttacttgtcatgtacttacttttttaaaaatttaaaattttttaattatgggtacataataagtatatatgtatggtatacatgtgatattgtgatacaggcatataatgtgaaatatcacatcaagataattggagtattcattacctcaagcatttactgtttctttgtgttaggaacattccaattccacttttttaatttttaaaaatatgcaatacataattgttgactatagtcaccctgttgtgctatcaaatgctagattttattcattctatcaatgtttttgcacccgctaactgtctctacctttcccttctctccccaatacccttcccagcttctggtaactgtcattctactctctatcttcatgagttcaattgttttaattcttagctcccatataaaagtgagaacattccatgcacttctaatttagactcttctcctctttctctgtcttctttttttccatagctcactaattttgggcatctcttctcatttacagtagcttgctgctcttcattcattaattattacaatatataattctaccaagaagcccaaagaactatagtgtttttatgtcattattctcagttcagaaagaaagcatgtgtgtggcacagggaaggcatttgaatgaatgtatgcattttctggatagcattctcgaacagagatttgatgagagtcacatggataattttaacttttctagtagcaatattaaaaacacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggttcatgcctttctcctgcctcagcctcccaagtagctgggactacaggcgtccaccaccacgcctagcttattttttgtatttttagtagagacagggttttactgtgttagccaggatggtctcgatctcctgacctcgtgatccaccagcctcagcctccaaaagtgctgggattacaggcgtgagccaccacgccctgcccccttagtctgactgaccaaatttcatgtgtttacggattgacaaccatgtgggtagtgcaggttttggatgcatggcaggctgaagcttatgtagcacatatttgaccttcacattttattaagtctaattttttaaagttttgtctgttcatttacatgtggaaggatgatagaaatataggaagagacatgacagaaagcttgcctaggactcagatcaaggattcagatttcccaattccggcttcagggccctgttctgtaacatcacatcagggaaaggaaaatgagagaaaagaagaaagaataagaactaatgttaattcatgtcagacacagtgccaaagatctttatttgcattattgttattattttttaaaaaataaatagactagcacgtagcctagcttacacacttctcattgtatagatgaggaaactgggaatcagttaaactttataaccacaccaagatcattgagctagtaagtggcaggcttgggatttaagaaagcttgtaatgatgttacatttgatggtttaaactgtgctgtgggaagggaatccaagaagataatcccatgtttctgcttcttgtgatgtttgcaaatctgtgttctggagtaagtctttgagttgactcttggagcttctgaaacgtctattggatatactataaccaaagataaataaataaataaaaagatcagggttcctgaacgttttcatctttacattgattgcaatgattacaagtgatcatttcatcacttggagcattattacctctatggggctttacatgatactgactttgtcaataaaaggacatattaggagcaggatttctgtttgggccagaacaaggggacataccctatttttaaaattccccagtttaggaattgaagtgactgcatactaaagttggccaaatttcatgtggctatggaatgagaatatatgaaaagttggttgtaaaaacaattaagaggattggggcagactattttatggatcccttcctccttagcttctgaaatgaactaacattgattctacaaccacttattaaatacctactttttgccatggctgatgctaagtgttgaggctagaaatgcatatgaattatattttaataagcacagaataaagaaaacttgtcttcctaatttttactttaaaagacttttatctcattgtttaagtgccataattgtacaaagcatgctgttctgagttcagtgtttcttggctcattctcagtcaatactctgcatagcatctttgaattccttactcatcaaagggtaatgagttaatttgtgtactctacctctgccaccttttgagctgtgttgttgaccattccctatacatttgcatctctgtctgccagaagatgtaccaggaaaataaaagcagcagaaaatcttataacttcccacctagacatcagtcaccatcagagtttggtctggaaacagaaaagtttatttaaaacaaaattggtactctgtgaatatttcaaccatttgttccatttaatccccattagtgaatttgcttagattaatttttttgtggattccatttccaagaatgaaagcaaaataattacatcaaaaggccactgaaatcagccaaattctctggcaggaaacttattctattcagtcacattcaaactatcaggtatgaaaaatacctttcaccactggataatacaacaatggagttggaaaatcaatcgtgtggtaaataagcaaaaactacgtgcaaacagaggaaagaagagttgttctgaaaatggtatttcaataaaagttatagtgatgacgagcagtgtgatgatgtaggaagttccaaaactaggtagagggtataatcaaaggtgggtacaatggaacaagcctggaggcaaggacgggccagtcaggaacaggtgggcttatagtgaaagaaagtggaggctttagaagtagagtatttgatgaattcttccgtccattctattttggcttctatgtcaaggaggatgacagatattcattgtgtagttttataggaaaggcgattggtagtgacttcaatgttataaagaacttggccaagtccataaaatgtccatggtgtataacaaatcttttatggtgagtgatccatggaattaggtacttagaaaagtcgattgaaacatattcacagaaaggcaaaggtttgatgacctggtgcatggaatgagacagagacactgagaaattttgattgtacaagtttttcctaatatcccacttacatcctgtagcggtgtgggcccatttattcttttttatgtttggtttccctgtctcatggtaaaatcatggacagatgttacccctcaattttctctttttcaattatttctgatccttctcactttaatcagtttacttgatagtctctgcgctagtgtaatttctccagccttttgaaaaatgtagacgcttgagccagacaaaagcacttcagcaggaacatgactaatcttgaagacatagagcagggctgataatgtacgccaggaactgtcagttaagaaatagtgatactgcattgctgactcacagtcagctcatgggtcactatgctgcccccattctgttgagatttcagtacactttccgtatatggagtttctgtgttggtacacatccagaaggtttcttgggcgcattgaccttcacatattgtttggttaatttacctaacttggtattaatcagacagaaaagacaaacatgaagtaaggaaagtcggcctttgctgttctcccttgaacttggcttcacttctatccccaccatttagtaaggaagaacagccccaatttattgagttgctatgagccagacactgtgtaagcactttctacacattattgcatttaattctccaaagaatgagataactattataatctctgttttatagaacaaccagctaaagtttatcgggttttttttgtttctgtttttttgggtttttttttgttttttttttttgagatggagttttgctcttattgcccaggctggagtgaaatggcgccatcttggctcactgcaacctctgcctccggggttcaaacgattctcctgcctcagcctcccgagtagctgggattacaggcatgcgctaccatgcctggctaattttgtttttttagtagagacagggtttctccatgtcggtcaggctggtctcgaactcctgacctcaggtgatctgcctgcctcagcctcccaaagtgctgggattacaggcatgagccaccgtgcctggccaagtttatgttaaataactcgtccagaaggtgtagtgggatgtttgactccaaaatacatgcttttaccgcctcaactgactgagcttgggactacctctaactttcattagaaacacaaatctttttctaataaactttcttcttcttttcaataaaaacatttcccacaaggtgacttaaattcattcacaattaggtataaatactgataagagcagttaacttgttttaagagtctaatatgtgctaagccttatgccagatgctttacaagcattatcttaaaccttgtaacaattttgcaaaaatgttactctattttatagaaccaaaacccaagactatgaaaacctaaatatcatcctcagagtcatacagcgaagcagaaattgtatcagctaatgagacttagtgccatttctctcatattgtgtgagaaaaatggcaatgctcaataaatgttgttctaactgttccaggtatcaagcagtagaaaaagaatatggcagatcaggtggattttgctgtcagccctggaaacactcagctggtggctacataatccatcatctcctgaagctttcattgtccacattttttttctaccctttagtcatgtgtttgtaaggaataaattactaaaatacaccataccttttaaaatatagaataaaagctcacagagagttagggtgacagaacatatgattcaaccttctgccttctggcagacagtaggctatttcttttaggtgggtatctaggaatagatacttgcatataatattttttttttgaatcccagactggtcctactaacattcttgattaccacttatttaagtgaccatcaaaccagttttatatctgatatgtttaatccaaataaatgtctttttttaaaaaactgtttaaaaaatggtatttaaatccttcccagattttagctgtgtatagtctggaaggaaacccattcacatggttttatcaggtttgatatttaatagatcaaattagtaaaacagggccctcacttcacaggcacggtgaattctttgttgataagatctatcaatgatcagtatggatcattggatggcagtgaacgtatacgtttgtggggaaaattcttatgcaccttcatagtaatggtactgcccattttatttgaggataattaaaacacaaaatacccaacgatgctgtttttattgtaggtatatgttaattcctctagagatagacaagactctaaattcatggaactttaagtgggatgttccacaaaggaaactctttaaaataatatagaaaaataaataagtaaatgtcaaccaaaatggcagaacatttaaaatcagtctgccaaatatcttttctcactttacttcatttgttgaacaatttatatgctgatatagatggccattttaacagtgtatacaaagcatttatatccacacatgtacatttaatcaaacctacatgtctacatacacatacttaagacacacatagagagtgtgtgagagagaatcaactcatcataattgtaaaggtgaagaaaattgattccttaagactaaaacacaccatattaaacttggagtttatattttgaaaataagattcaggaagtcttctaaagcattcgaagattgattagaaagataaatttcggcacacagggtctctgttcttgtaactttccctgtggtagcttatccctctgtataatacattttgtcatcattctttctttcctccctgatacaataaaaataatttccaaggttagattctatcttgcaagagcttttccccaaggaggtgcatgcatcttcttaatttattatattatataataattcctcataggaaaactaaaggcaaattaaaaccacatggagataatgcctgactgtgctttagactgttgtctaccactggctctttagaaaaagatcagagatacccctctcttgattgtccattttcttgatcatgcaatgtggtattttaagttctatgctggctttgatgcttttgttagtcaaggtgcatgtgtgaatgtgtgaattggatatgtgaatgattttaatattagcttaaataaaacattactgggaagacaaattttctgaaattcccattttcctcttccacttcccctacccccaaagaaacttgacatattcgtttcaaagcatacactgcttttttactatttttatttttatcgtgcatatcacaaccccttcattagtagacatcattgagcattaactgtgacttaattctagaaaaaaatatttttgagatacccattaagatatcacccctgacaaatataaaaagagaccttgagtttacttcattttaaataaatagactgtcttcatttcctaactctgtgaatctgacgcttcttatcaacaccccaaattactgtcaacaaattcaaaaccatctactgatgaatgagatgtttaggtccaattctgatatgccatgctcattctcatacagagaaatacctacactcttttaaatatagttgttattgctgtgacttgcacctactaaacaaatgtaaaaattcttacagttcaagaaataccagtgaagtgtatattattgccctcattacacaaaatgctcatggaaaacactctatcaattccaattatgttctggggggaaaaaaaaggaaactgaataaaaagcaatcccagaatatttgactgggctggttggttatagctgctgaacaatatgtaattgtaagaagtgtggcaaaatgataaaaataaactcagtatttgttaaagaaatgaaaacgtggcaataaaagattccggaaagcgatttagttttttgcattacttcttcattacttgattattttactgtttcatttctatttacctaccaagttgattcttttgcatctggattttgcacaattctttcaataatatacggttcagtggctataattacaggattgttaaagttcacattttactattcatcttgttatctctggtaatggaaggttggaataaatgcacataattacatggttggtcttaaattatttttatattgctcttgccaggatatactcgaaaagcagtatttattctctaatatttatttttggtggtagtggttttagcaaaataaaagtaataaatacataaatggactggtcccacgagcttactatctatggtttttttcaaattaattctaacccattcatctctctgagcctgctaggggcaggaggtgcttagagtctatggaagaaaaacgtcatgtttcagagctctggtaacaggaaaatgtccctcatgaggtactcatcatttgatctattattttatctatttgtagcagagtaactcagtaacctacagatctgtggaccaacttactaaataaggtgtcaaataagtttgatttcattctaaagcaatgccatgtcatgaaagtaaagtgaatttttttgtttgtattatactggaaatagtctcattgtactatatggcactcaaaacattttataaaaatcttagcactatcaactaaaaattaactcataagctcccgtaattaactgaacagatgactccctgttggccaaagggaccccagaaaagactgaagaactgagttcgtggccattgatggaagcgaggtcagaaacgcctcattacatgccctttatgttagagtttaggcacaactgaccagcattaacattaaaatagagatcataagattaactaaagggactcattgtgacactaaaataccacattctaaataagacctaaggccatgcaaagcaagggttaaggcatgctctgcaaaccgtaaaatctttttttaaaaaattaatcctgcataatgtggcttactttccaatctgactctggtataccctcacatggcagatagcagaccccttatcttgacttaagcatccctttgtattgacctcaagtctttagacaaagcttaactctttcaatcaattgccaactaaagtatctctaaaactcacccatgacttgtaagcccatgcttcaagatgtcccaccttttcaggccaaaccaatgtatacttttcatgtactgatttataattttacctacaattcctatctccccaaaatgtataaaaccaagctgtaacctgattactttggtaccaattatgcaagacttcttgggtttgcgttttcttgggctgcaccattcatattggctcagaataaacctctttaaaacattttacagaggctgatttttccatgaacagcagcatccaaaaaatccacaggatacatgtatcaagtatttattaagtacctacgatatgccaggcattgggctatatatgaaaaacagtgttatcagacatccacctagtgctcctgattaaaaaatggatgtgagctcattttacctttacggaggtccagagatttaaattacttgactagtccctcagcgagtcaggagaagaggggttaaaacctgattcctccagttatatagtcatttaatgttcttggacttaccagtacttttgagtttttgtgttttttttttttttttccttaaacacaaaactacacccccgcctccagctcccaccccctcccacacatatacccttttttcatagaacaaaatttggaataaatggactttaaatgaatgcattgttttgactctgcagggaaatgacatagagaaaataaggaatggatcgtacatgctcatgcactgtctggggcactcctgctgaagtctcaggagtgtctttggtttgttgtctgagacctgagagttaaaaagcagagtgccttttggaggaacacgtgtctctttccgcagcgggacgtgcacttgatacacatcagtgggcatgccatcagtgcctcgcagctcatctttctctttagggtggctgtgttgttcttccgatgactggcttgccctggagaaaaatactgcttaaatattaagattagattagttttcacacagccccattttaaccactaaatttaaatccctcagcaatctacttcccaaccttccctaggcataatattcagtttaataaatggtttgtatgccattatttctcatcaatatataaaaactaaaaggaattttaaaaatccatacatcttggttgagatgaaatttgacttgatgagaagagattattcttagaaatgtttctaattcccaatcaaggcattctatttcaaaatgtaggagcatggttgaaagaataaatctttagaaaataatgtatgagcatggttgaaagaagaaatctttagaaagtaatgtatataataatatacatatatgtatatatacttatatataagtgtatatgtaagtaatatatatctctcacaaatattgttttagtcatcatcatcatcatatacacgtgaatatatgtacatatatgtattatatatggtatatggtatatatgtgtatatatgcaagatatatatgagtatatatacatgtgggtgtgtgtgtgtgtgtatgtatatatatatatatatatatatatatatatatatatatatatatatatatacacatacatatgactccaaaaacaattcctctacaaattgtgtgtcacttccttgacccattacctccccaatgtatatatcatgtgaatatcaaacaattgaatgttttgttggtacaattggattcattcacacggaaacgtggagtctatttcttccttcaaatcctcatcctccaattaattagctgaaaaactgactgcatctctgattctctaagaagcatggaagagaaagaaatgggaaaccagctagcagctcattacatgaattcaaacagttccctttgaagggaaactttttcctggcatagatgatgtcattgatgagattgcaagggtaggcattgtataaagatgagatcctttttaattctgttttcaaaactataaagctaaaatttttagaattgaaatttcagttaacatgacccatgtattagataaaatgtctctttaaagcctgggagctctccaaggtgtggtgtgtttcctatttgctaggtacatgattacgatgcatatggatagatgtttctgaagtgtttccttctaagtgcactattgccagtcagatttacacccaagtagcaaagatgttaatgccatgcaatcctattaatctaacatgttgcttttgtggattagaactactcagactctaccttttagttgtagttattttaaatctttaatactgagctatcaaattttcttttatgatacaaagctactaagtagaagatacttgaatattccattggctgactgatgtgtttattaggcacttactctgtgcccaacacaatgataaacattctcagcaatatcgtgaaagtttaacacaggattcctggcttccagaaatatgatgtttacttaagaagagataggaacatatgtgaaaaagttaagcttcatgtagtatcttaagatgctaagtttagtattctggtggtggagtttcttatcaacaatgtttcacagaagatattgagctcagcttttcattatcaaagcaattgcatgaagaagaaatttgagaaagtacaacccctggtaatgattggagcctctgaaacttttgtaatgtcaatatccatagcatgactattttttatttccggtactgatgtggcagaagttgtggagtagtgtttttgagttatccgctgtttaggatcctgtattaaaagaagtatgtcggctgtgcatagtggctcatgcctgtaatcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtgagccaagatagtgccaccgcactccagcctgggcaacagagctagactctgtctcaaaaaaagaaatatgtctcagtagtgcagttatccttctgtaggtttgtattggtgttcagcaagtatctggtaaattaatgaattaacaagagaatagtttctatgaagcagaaatgcatagcaaagaagtggggtgttgaaaggaacagctgggatatcagttatacaggttgaaatgtggcattggtacaatgacatattagttatactcttacaagttgtccttgagtgggtgcttgatagaagttggcttgcaaaccaaaaaaggttaaacacttgtcatggcctcaggctaatgaccccttctaatatgcaattctgtttttctcattctgagagcaaaccagatgccccatgatgtgcccactgttcttttgctaatgtgttcatcctcagtgccttcattaccagtttctttcatttgacatgcaaagatcttttttcttggctcatcccagagaagtggccgggcaagtgttctcctgagaaaatgttgatgactctggcacacagaccacatacaatttgctgcttcctcacattcacactgaagttggctaaggtgcccagagagaaaccctgagccctgactgcatccaaaaccagtcattagggatgaccaccgtgggatccctcctactgggtgcctggttaaaactgagtgtcagagaagagactggtggctttgtcattgactttcttgttcagatgtaagagcatcatcactgggagaaggaaatgtgaattgtgaaaataaataatgcagatagaagagtcggaagtacagaggagtgttcctagagtgctttatatggagctctattatggtgcataccatggtgtgttgttaagttagtttacgtgtcagtttcccctttacactgtgaaatttagcaaagcagagactatgtctgattcatctttattccaagtacctcacaaaggtaatgctagcgttgaccttaataagcatttaatcatgtttattcatttattttttgaatgaatggataatgattaaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaagaagtacttcatacgttgtgttatctttctgctcaggtcactgtggacgatagatagcctttacttctccgctttctcaattttcagccactggtattcaactgcaggccttctttaaaaatgtacctctttctttcaaaattttctgaaaagctagaatttttttgttttttgttttttccaggaaaaaattttaacttactggagaccaatttcttttcttaaacctgtctctgagctgagtatactgtatagtccctataatgattttggtaaatccttaagcataaggtggtcattgtgtgtgacggtgttttctgtttagtgaagacaaatggtgggatgagtctcctgctaggatgtgcagaaatgtgagcattagtctcaaggtacattccgtaaagtgttggtgccaggtgagtattgaggttgatagcttctgtgaggcctggtttcctggggttgtgcccatgttcatatgacagctgcttccacaataacatagcaggtgcgtagctcaggatttgcccactttctgcaagtggacactctcgcttgtatctaaaaggcctctcccatggtgccagaatgcctctgacagcattttcagagctgtgacggcaggactgtagctttatggtgggagcttctatctttgtaaatgccactgatgtcagctctcaccattaaccattttcttttgtcaaatgggagagattcaggactcatggaagtgagagactggcatgatgaggcaaacagggggcagtttaactggctgtttggccactttcccccactctaattctccttctcctttccataaaacatgctttccaatttctgccaataaaagcctttttaaaaaagtactagtctttcatttttttttttgcataccttgttgttattccttctgaaccagtagtaacacaatatacgaagtacattctcttgggtataaggccagtgtataggtgggaatcccatagacctaaaaagaaaaacaatctaggatttctggatgtgctctgaagtggcaccttctaagctgcagtatttgttcaacagtgtttttccaacaaaaaataggatgagttcacctgtgaagcatcctgaagggaaacaccggtgcactgggcagggaacaggagacctagatatacttcttcttttttttttttttttttggtagatatatttatttatttatttatttttattttattattattatactttaagttttagggtacatgtgcacagtgtgcaggttagttacatatgtatacatgtgccatgctggtgtgctgcacccattaactcgtcatttagcattagttatatctcctaatgctatccctcccccttccccccaccccacaacagttcccagagtgtgatgttccccttcctgtgtccatgtgttctcattgttcagttcccacctatgagtgagaacatgcggtgttcggttttctgtccttgcgatagtttactgaggatgatgatttccaatttcatccatgtccctacaaaggacatgaactcatccttttttatggccgcatagtattccatggtgtatatgtgccacattttcttaatccagtctatcattgttggacatttgggttggttccaagtctttggtattgtgaatagtgccgcaataaacatacgtgtgcatgtgtctttatagcagtatgatttataatcctttgggtatatacccagtaatgggatggctgggtcaaatggtaacaacaggtgctggagaggatgtggagaaataggaacacttttacactgttggtgggactgtaaactagttcaaccattgtggaagtcagtgtggcgattcctcagggatctagaactagacctagatatacttctaacataatctgtgactgtgtgcaggtcatgctaagtatgtcagactgccattttctccttgaggctggaagtgtggggagaaggggataatgtagttgagaatccattactggccccaccttggacagagagacaggcaggtaaagggtacacatgtgcctggatggtgctgctactggactcttgtttacattaatgtgtcaacagtgtgctccaaggttctattaggtgttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaatttatttgcacatgaaatgcctgtgggacataatatctctgaaggccgatgttccttgaaagactgtgtgaaatattgaactatatgatctctgaaagttcttgaattctccattatcatcagaatacctggcccttccaagcccttgaccttcgtctgtggagtattgactctagctgccttccagacattgtcatctatgcttcttttcctctgaggacgatgaaccccggctgttctctcagtacccctgaaaaatgggaaattgtatttttttcttctttgtacccaggagtctatgtataatgcataattctcagtcaaaaggaacttgcttacttaagtgctcaaaggtttttgtcctgtggtttttgtaaggtaatcccacaacatccagataaacaaataatcacaagacataaccttccagagtgttccataacattgatcacaatcaaataatgaggcacgattccatgaaacattaggaaaattataaaggcatcaggcagaaaaccagcaactagcaaatggtttctccatgatgattttgggttcacatttcacttccatatataatacaacttatgtgcccatatttcatcctctggaagcctgccacattatcctctgaatgaatattaacactccttgtactctgaagtagcctctggtattctggtatttattcaacaggttttgaacaagattagtggattataattttggcttcaccacattttaaactgtgtgccttctctgtgcctcagttttctcctctgcaaaatggaacaatagaatccttttcattgagttattctgaggattaaatgagtgaatataggtaaagcacgtaggacatccctggcatatagcagtcaatcccttgtaaaatgttagctgcagtgggtgcaactgactgcggccagttgtcaccacctgtgacatttaccaagacaattttgggtaaaaaaggcagatttattggagaaagtacaaagataccttgcaagaaagcaatgcgcaggacaatgggctgtctaccaagaggcaggagctagagggaagttttatagggtcatactggaggggctatgtccagataagttgtgcagataaggtcctgctgctagggctatgtccagaaactaggtatttgggaacatgatgttctgtcagtcggttgtctgtgataagccatctcctctctcagaacaattgttctccccaatctggggccccttcttcattcttgcttatcttattaggactccacattaactattgttgttattatcatacacagactatctctgaaaggatatataagatatagataccagccataacctctgcaaaaagatacaaagagactagggagccggaaagcaaagatagaggagtaggcttacttttccctacatatgaatttactctattgaatattttaaaatcacctgtgttttaccatcaaaaaaataaaataaaacaagcatcaatatttacaaatgaagaactgaggttccaactttacgattgactttcctaattcaattggctatttgacttccctaatagttaagttagatttgagccagggatttgaactacaaaaaccgtgttttttctagtctaccaccttatatagagagatatgacagaggggagagatgagaggtgtgtgggtgggtgggtgagggtggaggaggtggtactggatattactgaaaaacttttgatgatattgaattctttccctgagttctgtagattttggcactggtctcttgtttcttctatttctactgtgagtaaacaaccattcccaatcctccagttctaacttgaatttcagtggactaggctgagtggatgtacaagggcaaacctgcatggggtgtagggaaatataaatagattggcactgtggaagtcagcatatgtttgcttggcacccaaccctcctatgcctttcatttgctgaatattaagcatctcatttttatctgtcctctttttgatggaatggacatgcaaatttttcaaacctacacaccctcttctttctcttggacaaagggagtaattttactatgaatccatcatgtgtcccaaggaggcaaactcaaaatttgtctgcaaaaagcctttcattcatttcttttcatgtaagaaacaaaattggcaactattttttcatagcttgtaaattccaagaaacttagtatcttttcttttcacttgctctgcagccaaaagcatattgttcagcattgcgaattcacaatactcactgctcctcagtcctggctacaacataattttgaaaagtttatgcagggaccatccgagtaataaatcacagaggaggactgctttaactgttcaccccttagctactgcctgaatgagctccatgctttatcatctcagaaggaagctgtctcaaatgcatgcttcattttattatccaattgtaacccatctagataaatttaacttcctatagatttgctgcctcttagtattcatatcttctccagacttttcattaatattatgatacttggataggagtattcccctccctttcctttataatgtaacagctttaaattgacatttggtgaatgtatcatcattgctattcaaattaggtcagtgtttttatttcattatgctggaagtcctcttagctgcgaaatcaagtttgaatgtctgttacctgaagcaatgcttctggcaaatgtttcttagaggtttttgcaagccagaaattgtcaggcacctcccccactcccacttcttatttctatgtggtttggttcatataaccatttaacatatttttataaagcggtagttgaatagagtataaaataggaaaaaattaatcatctgccctttaagaggtttctgtccactgtgtgggtgttggagagggaggtgggggaagagaggggaagggaggcagatatgcaaacaaaaatcatactatgccatggttttggtacagtcagttaatgtctaggatataatggaaacgtgggaaaaggagcctcttgacgtttactaagacttgagaatgagtttttttcttaataatctataaattgaaatccactctttctaaatgtgcctttggcactgttcttttgaattaggaaatacagaaaaacagttaaatttggttgaacgatacaggaagtactcagaaaaggcaaccatcttaccccaggagagatcaaaagacattcacagattatgttaacccaaagttttggcctcatttctcaaggaaggggctacatcttttagaccacaggcatttttccccagttttgaaactgtgaaggtgtttaggacctgagagattattaataacaggtttcaatgcctgacactcttggacttaaatgttcacctacactcaatctgatcatggacaaactacttaatctcactgagcccatgtcctcatccataaaatgagggtaataatagttccacgttttagtattgttaggatgattaaataaaataatgcatgtaagtaaaataacccagctattggaacaatcgctgctgtataataaaccatcaataattcttagcttttgctatcattcttgctactgttaattagttagtggttctcacttttttctagaaattgctctacctctgtttctcaactgagatattatagtttaagactttgattatgataactagatgataatttagatggtgtctttttttttattatactttaagttttagggtacatgtgcacattgtgcaggttagttacatatgtatacatgtgccatgctggtgtgctgcacccactaactcgtcatctagcattaggtatatctcccaatgctatccttccccccgcccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtagatggtgtcttgatcagcaatctatgctttgagtgttttttgttaagtggctaatgcagtttgcatatttgtcccactaaatctcaagttaaatgtaatcctcagtgttggaggtggggcctggtgggaggtgttagagtcatgggctgagcactcagacttgggcaccatccttgtgacagtgagtgagttctcacaaggtttggctgtttaaaagtgtgtggccatttacctatataacaaacctgcacatagtgtacatgtacccctgaacttaaaataaaagttggatatttttcaagtgggcttcatccctgggatgcaaggctggttaaacatacgcgaatcaataaatgtaacccagcatataaacagaaccaaagacaaaaaccacatgattatctcaatagatgcagaaaaggcgtttgacaaaattcaacagcccttcatgctaaaaactcaataaattaggtattgatgggacgtacctcaaaatcataagagctatctatggcaaacccacagccaatatcatactgaatgggcaaaaactggaagcattccctttgaaaactggcacaagacaaggatgtcctctctcaccactcctattcaacatggtgttggaaattctggccagggcaatcaggcaggagaaggaaataaagggtattcaattaggaaaagaggaagtcaaattgtccctgtttgcagatgacatgactgtatatctagaaagccccatcatctcagcccaaaatctccttacgctgagaggcaacttcagcaaagtctcaggatacaaaatcaatgtgcaaaaatcacaagcattcttatataccaataacagacaaacagagagccaaatcatgactgaaccactcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatctcatccccatcaagctaccaatgactttcttcacagagttggaaaaaactactttaaagttcatatggaaccaaaaaggagcccacattgccaagtccatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcttatctacaaccatctgatctttgacaaacctgagaaaaacaagcaatggggaaaggattccctatttaataaatggtgctgggaaaactggctagccatatgtagaaagctgacactggaccacttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagaaacatgaaaaaatgctcatcatcactggccatcagagaaatgcaaatcaaaaccacaatgagataccatctcacaccagttagaatggcgatcattaaaaagttaggaaacaacagatgctagagaggatgtggagaaataggaacacttttacactgttggtgggactgtaaactagttcaaccattgtagaagtcagtgtggcgattcctcagggatctagaactagaaataccatttgacccaaccatcccattactgggtatatacctaaaggattataaatcatgttgctataaagacacatgcacatgtatattttattgcagcactattcacaagagcaaagacttggaaccaagccaaatgtccaacaatgatagactggattaagaaaatgtggcacatatacaccatggaatactatgcagccataaaaaaggatgagttcatgtcctttgtagcgacatggatgaagctggaaaccatcattctcagcaaactctcacaaagacaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacaccaacatggcacatgtatacatatgtaacaaacctgcacgttgtgcacatgtaccctaaaacttaaagtataataaaaaaaaaagtaggatattttttaaaaagtgtgtggcgtcttcccccttattctctcttgctcctcctcttgtcatgaaatgcaccagctcccccttcaccttctgccatgagtaaaagatccctgaggcctctccaaaacctgagcagatgccagcatcatgtttattcagcctgcagaaccaactacacatctttaaaaaaaataaattacccagtctcaggtattcctttatagcaatgcaagaatggcctaacacagtggctttttttttcttttaagtatattttatatttagatgctactattagcagatgatttgtgcgtatgtcttgccctgttcagctttgaggagtccaggcccttatgggactccttctgagagtggggttcctattttccttaggaacccaagacagttctttcagaggatttcattgatctgttgccccatggtgctttgtggcacataatgacaaagcatgacaggcaggctcacagccctcgactcatgctagatctcggttcattctgtatccagggactccagttcatcatatcccttacccaggcctctctcctagctatgtctgtgtggctcacagatactctagagggagaggcaattaatttctttttggcggtgagatggtttgcctgggtccccactccaatcttatcttgaattgtagctcccataatgcccgaatgttgtaggagggacccagtgggaggtaattgaatcatggagatgggaattcatgttctgttgtcatgatagtaagtctcacgagatctggcggttttataaatgagagttcccttgcacatgctctcttgcctgcaaccacgtaggttatgcctttcttctccttagccttctgccatgattgtgaggcctctccagctatgtggaactgtgagtcaattaaacctctttttctttataaattacctagtctcaggtatgtctttattagcagcatgagaactgactaatgcagggggttatttcatgtcagacattgtcgtaagttgtgtcttccttggtgtcttagttttttctgtgctgctataacagaatacctgagactgggtaatttgtaaagaacagagatttatttcttatagttctagaggctgagaagtccagatcagttgggtggcatctggcaaaggctttcttgctgttttgttctatgatgaaaggtggaaaacaagagagagaacaaaaggtgtctaaatttggttttatagcagatccattccttgataaccaacaaactcccaggatgataatattaatccattcatgacggcagagcccttgtgacctagtcaccacttaatgctcccacctctcaccactgttgcattggggattaggtttccaatacatacctttatggaacacattcaaaccatagcatttggcaaataacccaaacccttctttcctcatctgataattgggaaaataatagcaactaccttgtggatactttgtgagaatcccatgcttcatgcaataaggacttaataattgtaagttgttaaattgtcatacatgctccttttagttatgaaaacctgtggcttttgtctaagagttgaatatgagaaggttcaaggactagggcttttatccttggatctctgtagcatgctgaattaatgaaaggtctgtctctctctctctgattaatcaaaaactctgactagtactagtgaaagtcaggtttgaacaattctgtgaagaatggatttggaaggaaaatatgaggcaagaattttaaaaagttgtttctgagttgaatttgatttacatttgctaactggaaaaagatcagggtataatcagtccataatattgaaagcagtttggaaataccattgcagatacaggtaatttaaaaaatctacatgaattaggtccaggagcggtggctcacgcctgtaatcccagcgctttgggaggccgaggctggtggatcacgaggtcaggagatccagaccatcctggctaacacagtgaaaccccgtctctactaagaatacaaaaaattaggcgggcgcggtggcgggcacctgtagtcccagctactcgggaggctgaggcaggagaatggcatgaacccaggaggtggaacttgcagtgagtagagatcgcgccactgcactccagcctgggcagcagagcgagactctgtctcaaaaaaaaaaaaaaaaacctacatgaattattcttcctgtgacatatttgtcattcttcatctctcctttaacattcctatcttcatccttcaggccatcctctgcctacctctttctgctgctacagtgtaagttgaatcatactttccaaaatatgtaaatgaaagtcagaagtaaggcaactcatagtgtttcagtgactttgatttcaatctcactcaagactgggagattctcctaaattctagcaaacttgtgcctctttcccagccttataagaaactgtccttctatctaaatactggaatgccactatgtgaagcttcaaatcagggtggttattctgagacaatggcagcttcttgggatgtggtgtaacatgtactaaatcattatgtgcacatacatttatttttaatcaacctgcgtttacctgagtgctgtggtttgaatgtgtcccctaaagttcatatattggagacttaatcctcaaggcaacagtgttggtgtatggggcctgataagaggtgattaggtcatgagggctctgccttcatgattgaattaatgtcattatcacaggagtgggttagttagcacgagagtggcttgttctaaaaggaagttcagccccctcttcctctcttgccctttgcctttggtcatgggatgaggcagcaaggagtcccttgccagttgtaggcccttcgaccttggacttcccaggctccagaatttcgaagaagtaaggctctgttctttgtaaattatccaggctcagatattctgttatagcagcactaatggacttagtcaccaactaaatgtaatggacaagaatggcctacattaaaaaaaaaatgtgattagaggatcttaatatcttattctgtagtgaactttagaatattttagacactggagattttctatcagatgtatcctgtggattcaataggattcattttgagaggcagctttctgaagtggaaataattctgtactccaggcacagtaattgggttcaagccccagctctgccatttactgggatggggagaaactcttggacagcctgttaggcctttttggcttccacttttcttgtctttaaaataaagttaataattttcattctgcttcactcatggcatagatgtgaggctcaaataaaaaaatattttggaaactaccctgaaaactgtagaacattctacaaatattatctaacaaaatatatgaatgcataattagtgtcttcaagggatgtcataaatatcgtaaaactaaagggtgagctgtatcaaaacttggaagggattgggatgaaaatcaaactgtctaaaatagaatggccaaatacattgggacttggctccagaaagaattaatgagaattacacagattcatatcttctccattattccattggtcacgtctaataacttgccatgaaattgcattgatttctacaaagtgattgcatatgctgttgcctcttttcaactgcacatgtcataattcatccatccagatcagtattttacttttaggaaaagagagatgctaactttttctcagaggagagtgtttagaagtctatgttctatagtccctcctagagaggggggatttcttcagtactcagcagctaatcttttttttcttctctctctttttccttttttattatactttaagttctgagatacatgtgcagaatgtgcaggtttgttatgtaggtatacatgtgccatggtggtttgctgcacccatcaacccatcatctacatgaggaatttctcctaatgctctccctcccctaacccccacactccccaacaggtcctggtgtgtgatgttcccctccctgtgtccatgttttctcattgttcaactcccacttatgagtgagaacatgtggtatttggttttctgttcttgtgttagtttgctgagaatgatgatttccagcttcatccatgtccctgcgaagtacacgaactcatccttttttatggctgcaaaatattccatggtgtatataccacattttctttatccagtctgtcatcagtaggcatttgggtttgttccaagtctttgctattgtgaacagtgctgcaataaacatacatgtgcttgtgtctttatagtaggatgatttataatcctttgggtatatacccagtaatgggactgctgggtcaaatgttatttctggttctagatccttgaagaatcgccacactgccaacaaacatatgaaaaaagctcatcatcattggtcgttagagaaatgcaaatcaaaaccacaatgagataccatctcatgccagttaggatggggatcattaaaaagtcaggaaatggccaggtgtggtggctcatgcctgtaatcccagcattttgggaggccgaggcaggcagatcatgaggtcaggagatcgagaccagcctggctaacatgatgaaaccctgtctttactaaaaatacaaaaattagctgggtgtggtggcatgcacctgtagtcccagctacttgggagtctgaggcaggagaattgcttgaacccaagaggcagaggttgcagtgagccaagatcctgccactgcactctaggctgggtgacagagtgaggctccatctcaaaaaaaaaaaaaaaaaaaaaaattcaggaaacaacaggtgctggagaggatgtggagaaataggaacgcttttatactgttggtgggagtgtaaattagtgaaaccattgtggaagtcagcaggtaatctttttacggtctgagtaatgaggaacctggctaatagttgccattctagatagcattaagggtgaagtctttgctcacagaagttggtgtatccagacagacattgtaattacagcagagcaaattaccatactctgaaagagaagaacacagaaagcaacaaacacatttaaagaagactgtcccagaaataaggagaagggcaagaaatctaagcagaatattccacttgccatttacagcatagacaaggacagcaaaatggaaagtcacttatataactgcaggataaagagatgggtgagatgaaatatactttctccgaatgaagttcactgtatgtgtagtggattaaatgagattgactatttttaaaaagcctgttacaaagaagaacaaatttaatagactattaagaggtaaagaggaacttttaaaagcacatattgattaaaacaaaagttatacactttgggaggccgaggcgggcggatcatgaggtcagaagatcgagaccatcctggctaacacggtgaaaccctggctctactaaaaatacaaaaaaattaaccgggcgtggtggcgggcgcctatagtcccagctactcgggaggctgaggcaggagaatggcgtgaacccaggaggcagagcttgcagtgagcccagattgctgccactgcactccagcctgggtgacagggcgagactgtctcaaaaaaacaaaaacaaaaacaaaagttatagttcagaatatttattgcatacaactcagcaaacaaagttgacctagatacaagagtattattggaatttgttagtgaatacattgacaaaattctgttatttttgtttaattatcactaggtccagtagggtggaagtcagaaattttgacttaaaatatcagctaattgaattagttatttcaaatcaatgtctagtttggataagaatattttataaaaaaacaaatcatagtattaggcatagtttatgcttggtggcatgtagagaaatataaaaataaaagatagtgaaatctttttaaaaattgtgttgaaaggtataatcatttgtgttaatgtattattcaaccaggatgtaggaagaacacacatgtcactgagctttgttctggggctggaaggaagtgcaaataacaatgatgataataataacagcagtagctaatatttatcagatatagagcttgttaccaccacagtaagcaatttgcatggagtatctcagttctcgtgattagtcaggtacacttcttacattggtttttcggattgagatattaaagtccttagaattgaaagaacttgctccaaatcatacagctaggaatggtagactagcgtttttactcaggcagtctcaagataacatttgttgagggtctattaacaaccaggcattgagatggtgtttacacatattagttatctcagtggttcttaacctgggatgcatgttaaacttaccaaggaagcattttaaaaccctgatgcttaggacctacaccaggtgaattaaatcagaaccttttgagacaggggcaggacttggcatcagtatttcttaaatataaacattgtatatgtaaatattatatcaataccagtatttttaaaagtatcccaggggagtcagccttttgaattactgtccatttaatattcaaagcaaagtctatacatttgtattattcctattttatttatgaggactctgagattcagtgacgataactgacttgctcgatcaaggtcacttacctggtaaattgctgagctgggatgtaaatgcagttctgtctagctaaagagcccgcattcttcttgatgcctcagtgtctagccattttacccagagcaataaattcacttgttcctgttatttagtgtttatcatagaatttagctttagcctcaatttcattttattgtcttcactattgagtactcacaaagggagccagttaacaacatctttggaacaaccatcctgtgtggagcattgtgctaattgctgtgggaaagaacaggggaagatatgaaatattccctttacaaagatatctactgttctgccagggttcataactttgggcctgtgacttgacatctgggtggcaaaagaagtctcatgaattgtttgggaagtattcatagttttcatcagattgtaacagagccatgagccaaaatatttatgaacttctgccttgcttggtatgtaaggcatttgattccagaagcagtggcatattatcttgaattttcttcataaaggcaaaacagtgccttttcaagagattttgagtttgatatactgtcaaaaactgtttacagctaagcctagtaaaagatgttgcatatgtggagtgtgtgtgtgtataaaaaaaatgcaggctgtgaggccgggcgtggtggctcacgcctgtaatcccagcactttgggaggccgagatgggcagatcatgaggtcaggagatcaaggccatcctggctaacatggtgaaaccccatctctactaaaaatacaaaaaaattagccaggcgtggtggtgggcgcctgtagtcccagctactccggaggctgagtcaggagaatggcgtgaacccgggaggcagagcttgcagtgagtggagatcatgccactgcactccccgctgggtgacagagctagactccatctcaaaaaaaaaaaaaaatgcaggctgtgaatataaaacaatgaaataaatttcattagtggctcagaaactagatctgagaacaaggatttggttgtttctggcaataaaacattattaagaaatgtgatatcatgaggtaaatatcttaaagaattgtattcatttacacacatatatgtacaaataaatttgcacacatatatacatgctatgcacatatatactatatatacacatgtatgtattatatgcatgcaccaatacatgctggcatgttttatgcaaattgatttttattccatagctatttttcctatataatccattatttttaaatgtattaataattttaatatcaccataaactgaaatgagtaaagaggcctgtaatgtgaatattcatatatggaacataatacgggggttgcgtaattataggtccatatatgtattgtatttcctgatatatttatatatgaaattgctagtatgtgtgaaagatatctacatatattttactaataagagatatattcatatatatatatacaaatatatgctttatagagcctaagtttggggtggaacaaatgttctcacccttgtttgattatgagaaccacttgcagagctttttaaaaacctgagtcccttttacccttgattcaaattcagtacatccagagcgggtcctggtgctgtttttaaaacattccttgaatggttgtgttgctttgcttgagaagcagccctgtagtttgtgtacaggtaggaatgaggaaggaagggtaccagacaacagacaggtaagacagtcaaggggaagaggccaggaaaatttctaccaggagggtggcagtttattgatttgcttatgttaaaatagttgagtccgcgctgtatctttttacttgattaatttaatttacacaaaccaaaggtcaatatcaatgattaatgtcagagggaagggtattattattatttttaaccctacttctttttcaactactacatatctgaccttgcagaggaaatcttggagagaaaatagccactttcatacgactatcccttggtcaatgcgctacttattaaactttattttcccactgaagaaagaaaatcctaccttcagggaataaaatagagattcattttctgacctcctagtataatgctaaaggaaaagcatacaatctctttggggagggagctgttaggaaggccagaggcagctgtcttggaaacatacagaaaggtgctattgggacagagcataatttaaagtaggtgagattggaaaatagggatttttccttctcttttacatttttttttcctttcttgaacatatacagttcttcagttaagtgttagcctgagattaaatataacatttatgaagctcctttcaaaactcatccctgcatgtgaatggaccatttcctcctttataccactgcactgacttctaattacatgcatctttcatgaaaatgtttgtcagactgtctgatgttaaattgcaagataattgataacaagacccatgtcttaatcatctttgttggtgctaaatacgtgtttattgaatgaatgaacaaacacttggatgaataaatagactgtaattgttagtaactccatgagacctgcacatttctttgttattggcactttgcctccctgtttctcttgagcttcatggttctatatctacatcacaggtagtctagtgtaaggttgaataacaacactcaaattaaaaagtaaaaatcttaagatgcttttggtacctaagcataatcataaaacaatggtcttgtttaatttgaggaggagataagtgatcaaacccaagaatccataaatttggcctaagtattggtatttatttccagagatgggcaaggaaagagtgttggaagaaaatacaaggtaagttttacaacctgtgagtactcagaacctggactttcatgtcttttagaaagacacattgacaataggcagaaaatccttagctacaactcactggctgaaagcttggtcagttaaattgtgaatttacatggaatccaaatgaagtgttcagacatttcaaacatctcttgcttaatgaggttctgtgcctggctagcaggtcagcagtctgatttcagtttacagatgcagtcttaaaaaaggaccctgagatcatctataacacttccctgtcttcctttgctccagctgcattcatcagcttccatcagggttcacagcaatgaaattaattgacaagaagctcaatcttaagagcactctgaactgtatactcttgccatccacccgctaactccaatcctacatgaatgaatgcaagtgtagttttttgagaaggggccatggctcaagcagtgccatatatgtgccttctatacaactggcttggtatctggtaaaatttccattgcccagttacaaactagccagtcccttgcagacctaggatcctcttagaatgccctatcaggaagttctttgcaagatgttttaactgagcaatgaatttatagaggaggacttgaataaattgtttcaaaaatgaaaccatttgaacacaaatcatgtctttcactaagacccagacaaactaactcatatgtactccacacatctcagtgtagtaagcagatggaaaatattcattgttttttttttttaccaatgagacactagtaacaaagagaaagtgtagaaattcttcaagatccctagaggctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaaaaaaaaaaaaaaaaaagaagaagaaaaaaaaaaagctgggagtttcattattcctcaaagaaggcacctcagaccaggttccatagggcacgcccctaaagagcccaaccttctcagggttctaaaatgtatcttaagcccaagcaaaatccttgactttccatttagatgccaatatgccatcctcataatattcattctcatggaattttgagttcccacactcttacatagctcccaaagccaacttattttactgctgaaaaatacttcagtacacttttattgctgacactggtttctctatacttcccccagagatattcatgttataagtaaatctttttccaaggtgtgcttcatctcctggctggaagcaagaaaaaaaatgttcaaagtattgtagcactttttacagagtgtgtatcatgaaatcaataatcatttattgagtactgactattcactgtggggccagatattgagaatattggagagcaattagatgtggtctctgactccaggggtctacaaacggcatggtggggaacaagctcattagatgaggagaaaaaataataatataagtgagtataaactcaagaactataattatgcattgattaatgaaacaaatactgaagatttactttttaaaaagcgttgtgctcaaggctatggcagatgtaagtttataatatgaccacttacattaatttgctaggtttgccctgacaaattgtgaaaaactgtggctgaaaacattggaaaatcagtttctcccagttcgggagaatagaaggccaaaatcaaggtgctgacagtgctatgctacctctgaaggctctaggggagaattcttccttgccttttcctagcttctggtggcggccatcaattctgggctttccttggcttttagcagcgtcactccagtccctgtttctgtggttgcaaggccttcttccctgtgcatatgtgtgtgtgagtgcatgtgtgcatgtgcacctgtgtgtgctcctgtctttacgtgacctgatacgaacactagtcttttatttggaacccaccctaatccaatatgacctcatttaaactaattgtatctacaacgattctatttgcaagtaatatcacattctgaggttccagggggacattgttcaacccagcacaacccttaaatatcctattgtcttgttggaggttattttatgggattcatttttggtgttccatggcttttcagaggaggctcagtgtccactgatagtctctgggaagactacgtaggcataggtccgaccattgctatattttcttatatctatgaaatcctaagttaacattttaaactacagtctactgtgtgtcaagtgttgtcctaggctcttatttacttaattcaatcttatcctcacaacagcctttgcagtatgattttttccattgtatagatgggaaactagttcagaaagtttacttacttacatgagacttataagctaggcgctgggatgctaaacaaattagttccaaagtctactattcaggctgaacttatgcatttctggtggtgaaagcacagcctacataaccattagtttgtgatttagaccttagcccaaacattcgtcattatcatatttgaagccaggatggacccattgttccagatctatatactgtatatcagttagccatatcaattaataatcttttgatacttgtcaaagagcagagaaccgcagaaattaagagtttattctcttcattaaaccattaaagattggaggtggctattgtgaattgggcatgaattatagcataagcctatatatgttgcatatagccccccgtaacaagcctccttgttgtcttttgtgttcctaacttatgagcagggcagagattatcactgaacacattgcagggtaaatgtaggactctgagtcacccattggatttttacaggctgaaacatttacagtgtcctgcttacaattctcaagcatcagttaggtgcaggaacacacaggcagagtcagtagctgcccagggaactagtgtccagtctaatctcttcacaaactttgtgcgtgattcaggaaggattattacaggccaaattttacccatggacctgttttgtttagtaaaatattttcaaaaataaattttggatttgaatgactttagggaaggcaggaatgatctaggctctcacaagccttagtcattacccctggcctgaattacatatttatgtgagccctctagtccctggaagcagttctgtttgtcaccctgtacttagaaaagtggaaattaatgtatggttcctggacaggcagcaccagcatcaccagggaactttttagaagtgcaaatcctctagtcccacaccagacttactgactcagaaactctgacgtggggcctgtaatctgtgttttaacaagccttctggttgattctgatgtgcattgtcctaggagaaccactgacttagagataagttaagaaactcttcctttcttgaagaatagcgtcttctgctttctaataatgaacttttctgtaatgcctcaagatctacaaagatgtcttattttgcttccagagtcacgtgagaaaacagtaacaatttgagggaggtgttgctctttcagctttatccagagatgtgcggtggcttgttccaggtgttatatgacaggacaatggacctcaaactcaagattctttttcctctacacttcactactttaactctcctgattattttgtggactgatgaataagtacgtgtaaactgattttagttttcctggtaatgaaaaaaaaaaaaaacaatgagtattgttactcttgtaataatcacatcattttttgtctttctttctttttctcattttatttttagacagggtcttgctctgtcacccaggctggagtgcagtggcatgatcacagctcactgaagcttcgaattcccgggtttaagcagtcctcccacctcagcttaccaaggagctaggactacaggcatgtgctgcaacacctggctattttaattttttattttatttttttttatttttgtagagacagggtctccctgtgttgctcaggctggcctagaactccctgggctcaagtgatcctcccaccttggcctcccaaagtgctgggattacaggcgtgagccacttcacccagcctttttttctgtgtctaaaattcagttactctctcattcacttaacagtttagaaaatactaactatacaacatgtactacgctagatgattttttaacttaaaaatgtgcaatgcacatgcatattcataataaaaatccatctttctaactcctgagaggtaagcaaaaacttattttactgctgtaaaaatcacataattggggacaaaaacttgcatgtaatatattttctatgagactgtattgactttgagagtggttagagttaatggtttgaattagcataagtaaaattaatgatattgtaggtcttaaatgtaaatgcaattttacaccaggcccagaagaaattcccctcacctaccttaattggtcagatgaaaatatttggaagaaatacctcattcaattttttaaaagcatattggctacttgccaccattgaagaattagatctcaaactaaagggattgtcgggatgggcttaaacagccttttgatttgttcattaattcatcaattcaacctctcacaaaacaattgtatgttgaatgactgctaggtgctgtgtgctatgctaggtgctgctgatacagttatgagcaagacagactcagaatcttataaatctttttgtacaaaagacaaacaattatttcagtgagttgattaaatttaatattaatatttaataaagcagaagtaattatacctgcaaaggaaaaataaagtgtgtttttagcacctataatttgaggactgtgggatggtagggttatctgaaaagagataaataatttgttgtatatttgtttcttttggggggtgaatgccatgtgccatgatgtgggaattaattggaaaaccataggctatgggagtcagaagagacattagaggctctaatatctgtcccacttttctctaatttagaaatctggaggctgggacccagaaaaggtaaaatgaattaccccaaagccacacttagtgaatgaaagatgtgtgaacggacatatgcatgggcctccttaatcctatgctagggatgaggacatgcctttcccaaaaataggtgaaattaccatatgataaagaacatttttagatattgggagtagggtagggtacaaggctttggaacagcaaagttaatcagctcagtagggggaaggaaaaaggaagagagaaagagcaggacctccagtggaacaagagtctgtggactctgtcaccctgttactccctcttaatcactcagatgatttgctttttctgcttctatttcaaaataagctgctaaaactgagatgcagtgcagtgaaagcacatcatgatctatgttctcatttttgcatggagggagtgagtaaagacctcctacttaggtagtcatcttgctgtccctgcatgtagactaaggctgtgagagagaacttggtgctttataaggcattccctgtgctggtataaatttgacccttgcatgtgagtgatggtgagggacatctctgagaattgttcctggtacaacatgtgtggatttcaacatgggtactgcatgctggagagatcttgatatgacccaaaagcaagaccagaggcaagcttgacacgatggagcaaagggtggaaaggtagaaaatagaatgaaaaatttttctttgctgtcacctcctcgattttattcaaatcttaacccaaacaactagattgcattactgggctcttaaaagttttgttggaaaagtgctgctaaagaataggaagacaatctaggcaatgccattcaggccataggcacggacaaagagttcatgaggcagacaccaaaagcgattacaacagcagcaaacactgacaaatgagatctaattaaactaaagagcttttgcacagcaaaagaaactatcaacagagtaaagagacaacctacacaacgggagagaatgtttgcacactgagcatccaacaaacgtctaacacccagcctctataaggaacttcaacaaatttacaagagtaggatctcataggtttatttacaataataattcaaatgtttcagatttgtaattgtcctttgaaaccattgctttcctttaattccagctataccaaagactctttggaatgggtaaattatttctacttgatagactaggaaagtgagtcacaaaaaggctcgcccagagctactggttattagttgtgtgtttttctctcctattccacactcgagaaaaccccgaagaatagggggtggttaatggtaaaaagaaatctagaagaagagttctggaaatgaaagacagctaggttttgagtttctctaagaaaaggtagggggcaatggatttaaactaggggcatacactgcgattaaatatcgaaagaaacacactgagatttaaaaatgtataaagggcttatgggaacgaagaactaaaaagaaaatatgaggcaagaacatagggtggcgacagaacaaggctgtgagacgtgtgcttggtttgtttaggctttaaaacttgtcaaagtttaccgttttctctttcaagagggatgaaagaaaggatggtgcttcccttagtttgtttgctttcttctttcatgtatctgccctggcagatatgcatacatgtgcaggcccgtgtgttcgtgcacacatatgcacacagataaagtgggaacagagagaagccagtgggtggtggtgagagatgggggcagaattgatgcatcagggggcctaaatccatgcaatgatcaagttcatagcaatttccccaggagactgtatcatattccagtgaaggggagtacggcaggaggttgccatggcaacaaaaggcctgaaatattaactctgactagcaacaggccagtgaaacagcctagctaggatttatggcacattatagtgtgaaaagcaggagaaaattactgtaaaggcaggaattatagcacaacagaacatataaactcccaaatccgtcttcctaattaaaacagcatgctcggaggtagagcacatagtaaggccattagcttaaatggggatgtgctatcatcgctttgttatcaagtttaatgtccttaagactaactgtgtgcactgggagagtgagagcaagggtaagatagtctggagacagatggaagcaagactcttgggcacttgaattcttctcaaactcattcttggtgacataaggtttcttcagatactagtctctgatcccacaggagattctagaagatgccttgatccttctatttgtaaataaatcatcacttctcaggcatgaaggctgagagactgataccacagtcaatccctctggaacccaccaggaagagaggagcaactaatcaatgaggtttattgttgaggaaaaaggatcttggatctcccgactccctagaggggaaaataactcccttgttgtcacagacccaaactttcttttatgtcttagtcaacagcctgcccctaagtgtttgaatttgcaatgcctggaggaagtcttccatgtaattcatactttatgagggaacctttgtcttcttgtgattcttattagaaactcccaatttctcgaactctaatccaggaccttagtactcagtctggagatgggtcagggaaaatgagaaaaccattattttacaagggttcattgttcatcctttattctgccagccattcaacaagtatttaatgaataccttctacattctagtaaatgctgggaacatgtccatgaacattaaacaaacgcacaaataattacttaataaacagttaaatatacaaaagaaagtacagaatgttttgaaaattatgaaaattcttcccatagcactatctttatttccctatcaccatagttgccaaagtgcccccacctgacattcttttaggtttgccagatgaccaagccctacattcccacagctatgtcagcaacatactcaagatcatcctttagacattgcattcccctcccctcccctcccatcctctcccctcctctcccctcttctcccctcctctcctctcctctcctcctctctttcttgagacagggtcttgctctgtcacccaggctgcagtacagtgattcaatcctggctcactccaacttctgcctcctgggctcagatccttccacctcagcctcctgagtagctgggatcacagttgcatgccacagtgcctggctaatttttttttctcttttgtagagatggggtttcaccatgttgcccagctggtctagatctcctaggctcaagcaattcaccctcctcggcctcttaaagtgctgggattacaggcatcagccactacttctggcctgtgtttttcttttttaaagataagacctaaagaggattttgactattttgaaaatatattcatatctgtgtatttttggttattcacttccaggtcctaaagttgcaattaaggagaaaaaaatcattgattattcttagtagttttgatgaggtaatgcaaggtttttctgtagcaaagtcagcatgcgtcgtgaatatggttaagctatgtatgattaaaggattatttatgttttatttataagtatttgctatcaataacagctcccaaaagtaagattcaccagtattactacagcatatgggacttttgctgtagattaataatgccatgatattttctttaatgaaggtggaaatgattgctttattttaacaaagggacctctatggtccccctgagtttgagccttgaatgtagacgatcagggatgctatatcacagctgtctccctgctgataatgactctccttggggtttcataatttctgcctgaaatcctttggtttcctctcaggaggcatggagtgaatttatagggagattcttcaatccagacacaaaaaaaggttttaaaattttttgtgtgtctccatatttgactttctgtctcccattctcatttcctttactttcatgtgtgtgttttcttcttactgtgccaaacacataataaatgctcagtatttgagattaatagatataatcattattattttgtgttattctttctactcctcccttataaaaaaagggattcctcccttcatcatgcttcccatgccttcatatacttcttattggtttgcagaacaggcatagttatgatggagaaagtaaagaataatgattaaaaagaataataacaaaccacataactaactgtttgggtttaaatgacagaactctcaaatccatcttcctaattaaaacagcatgctcagggatagagcacatagtaaggcttttagcttaaatggggatgtgctatcagtgctttgatatcaagtttaatgtccttaagattagctgtatgtgccttgggagagtgagatcaagggtaagatagtctggagacagatggaagcaagattcttgggcagttgaatccttctcaaactcattcttggtgagtactgtcactttctaggtgtgccttaggcaagttatttaactgcttcgtgccccagagagtggtgggggaatcaagggtaggacacatgtgagtcactcagaacagtgcctagtctttagtgaatggaacttcgggtgttcattattgttgatattgcaggtgtaaagaatttgattcacacactcctatcatggattggagggaagttgaatattggttcatatcttgttttaggttctggtttacttgctgcctgaactaggaatataattcgggatttgcagctagtaagttgaaattaagaagaactcaggcctttagattaatcaagtacatatacagtattgaaattatgtctttttatcagtatctttccagaggcccagttaggggagctcctggcatgtgcccggcatgtaaggagtgtccacaagtgtttgcagacctgcactgaacactatttctcttttgatatgatgcagtttaacatactcaaaagagttgagccttatcccctttgctcctcaaaaccaaacacagccagttttggattaacttttattcagtcatgttttatgctgtagggtccaacctaaattttctaggacgcagcccaactaactgaattctttatgtcacttgaaggataacgtcactacagttaattttgataataacatggtttgaaggattcctaactgcttgcaatttatgtaatattctcagtgctctgtgaatttgtagtctgatgaaaacactgaaaagggaggtaatgtttactatttctgattattattctgtatccctcatgcagacctaacctcaagcatttgcagccacccaatgactttttttgaaggaatttttactagtgggttcatctggggcagatgaaaatgtttgcattttagacactccaaatacagatataaaaactttatgtctcctcctccagctctaccttcaactttcttttcactttctttcctactaagagcacatatttccaggctcattcttcatccctaaactctgtccctctccttactcctttgttccgtcttttgtcctctccctggaatttctggtcatttgcattaactacacttataagtcaaactttctttgttcctttgtgggtgtactcagaacatcattacattcaagtaaattcatgtgttttttttctttttttgcccttttatttaaaagcactcctactggccattagaatagttaccagaaatctcctttggtctatggataagaaattctgcagaacttttcaaccaagtaattagatcatattatgtctaaactggtgcctttttctcaactgaatccaagtaggagtatagactgttaacaccttcaactgagtaaactgcaatctttgcaaagtgaattaatatatgaatgcttgctaaggcaagataacacatttttcaattaacaaagtaacaggagctcagggtagcatgtgatatatatatatattctgctacatacatatgcaggtatatttttcaatcaacaaaacaggagctcagggtagcagactacagatatacatgtgtgtatatgtgtatatatatatgtagcatactacatatgtatacatgtgcacatgtacatatttatctgtgtatatgtatacattatgtatatacatatataggtatatgtatacatatatgcatatgtaggtatatgtatacatatacatatataggaatcctatatatgtagtctgctacacatatatattcacatatatatacatgtatatatgtagtctgttgtcctgagctcctgttgtttgtcaattgaaaaatgtgttaccctgtcttagcaagtgtgtgtgtgtgtgtgtgtctatatatatatatatatatatatatatcctcaaaattttacctagagtaaaaaaatgaaatgcctacattacataaagacccatatgacaatattaattctgtgagctgagacatattcatgccaattctccataccttctcccccattgcccattctccagccctttgttgttcactggtcctaactctgctttcttactacaatggcccacttactgcatccttagtttttgacattttgaaatcacaaggttctcatattaagcatggacattttctttacttttttattaattacaaccacagaacttctctcgtcccactccttcttgttttgtctttgggtaaaaggaataaattatatatttatcataaattttaactctacaaaatggccatatttatactttcttcagatttctctcagttctagttaaggtttttttttggcttccatttgccccttatttgattattatactccaagtggctgaagaaaaaatacattcaatataatctgtctgtaattttcatgtcttcctcattaccgtaaaatataatgcttatttgagacacacacacacgcacacacacacgtgcatactcttggcctagatcaaccacacagattcatttattttaccttctcattaattagaccctcaagcctcttaatgttgttttaacactaatttgttgagttctttctggcaccaaactaccccaaactccatgaagaactgaatcatcaatgtattatttataggggcttctttcgtgtgttcgtttaaaatgtagttatctaattaatttattaatttatattgtcaataactattcccagaaggttttttttttttcagatctactagagaacttaaagctttttcttttccaggaatggccaaaatatccagaaggacaatatcaagtaataattaaagttataagctcttggtttgaattcttgctccactagttatgtgaccttgagcaaattacttaacttctctgtgccttacttttgccatttgtgaagtggaaactaaatagcctttatgtcccagtaacaatgcaaagtttattcattgccgattagaaggggcacactgttcaagatgctcattaattcattcactcattttatgtaatgactcatttatcaatcctttgttgagtctcaaccactgtcctaggtaatgctgatacaatcttatgttttgaagctcgccacaaaatttgatcaccactagagccaagatttaacacattatttcatttaatagctattttgagtcttcagggtacaatttacagttttgggggggaagatgtagggaaatatgactcgtcagactcaattaagtgcatttactcagggctacccatctattaagtggcatggttctctaaccccatagttcattctctttttctgtgcaccactagtaggttttgcataaggtaattttgtccaagtggttactgtgtgggtcctgttcacaatcttgatcatgattgtattccaacttctatgtcagagtttgcaagcatgtggcttataaactcaagatggctggtacaatgttgttcaatatttaatggaggggtattaccaagatctagttttctaggttttcttgagaaattagaaaatctggcaacactaagtttgtaataataccagggacaactagccaaactgccctattttgttgaatcatgtgctgtctaagtcctcacagtccttgccacccccaaccctgcaatcatcctacatgtagtgtttctatttatcattgtatttttgcttttatatctcttacatcttgtcacattgtatagcctgtctagcatttgaatttttgactcctgttttaagctagagatatgcttgtcactgaacacgacttgaataaggaaatgagtaataattatgactctacatgccctttatagtacacaaagaactttttaaacaaccatgttatactgctactttgattttacagtagtttgctccaaatgagtcaaatggtatgtagtagagtcataattagaatccagaacaattggtgtaagtctagtgcttttctcatttatctgtcattcattcatttattgacatatttattcaacaagtaaacaattataagtaaatgtcaaatatattctagaccgtatagtggatgctagagatatagatgtgactaagatacagtcccaggctttaagaagctcatagtctatttaggaatgacagataaacggatttttctgagtgcattgtgatgtgaactgagaaatacacagggtatgtacaaggtgccatgttaacatcaaatggcatgtgattgattttatctgtgactcagacatacctctgccactgtagggagtagtataattgacatgggatcctggccagtctccttatggtgatggtggttaatctacatgtccctgagtatcatggtctttacagaagcaggagagtgaaatgtaaaaagtgctggaatggaaatcagggcaccaagtatatatggtcctggctctgacatttgcttgctccttgacgttagaaaaatcgttgaatttatgtgtgcctaaatatcttcaccaaaaaataaggaggcataagaggggagataccagatcttacaaaataagtaggttttatttacaaatacttatggattagtgggggccctttcactaggctacaaagaatttgaggctctatctatgcttagttttaaagaatgctatggtcaaagaagctatgtttgtcataggcactagaggaagggatagaaagattctgagatctaggggcaaaagggattttgagagtgcaagtgaattaaaaagctaggatcagctggctcagtggctcacgcctgtaatcccagcactttgggaggctgaggtgggtggatcatttgagttcaggagtttgagaccagcctggccaacatgatgaaaccccatctactaaaaaaaaaatacaaaaaagtagccaggggtggtgacctgtaatcccaatcccagctactagggaggctaaggcaatagaatcgcttgaacccaggtggcggaggttgtaatgagccgagatcacaccactgcactccagcctgggtgacagagcaagactctgtctcaaaaaaaaaaaaaaaaaaaaaaaaaggctgagatcaagtttctgctgcaaggacattttcattagttaaaataagaaggggctaataccaataaaatgcatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttggttgtattctttattggatctgggatgatatgacttctttgcctggggctgttgctgccattacgcagttttggattcactgttgcttcataccaatgttggtgctgtaaatgtacatgataagagttccacagtgagatggactacaagacttctggacccagagccccctaaaactagatccaagaccagattatgcactgctactgaggttggcctgctatggtacagactgctcctccttccccaaggatacaggcacttttacatagagggtacaacagatcttgacctgcaggtgttcaaaaatcgactcataacttccctcctcttatatctatcttatcagtaaacaaatattaataagtcataggaatgaaacatgcgactctttttggttttgttggagtgatcatgccagaactgggactttctaatcttgaattcaaatcatgagagttaagcctgtcatgaactgtgagtgcaagctgacccaggaaccatgtggttctcaaaaaaaaaaaaaaaaaaaaaagcttatggctctttttgtgccacaatggcagaattgagtcattgctacaggcagtgcatggcctgcaaaacctgtgatattattctctgctctgatattaacatagctggaatgtgccccaaatgtatttcaatcaagagctttcatgtattttttgaaataacctggataagaaaatccagattttagactcaccattctgcgggggagtgggggcggcagggggtcattgatcctgtttgttttctctcttgcatgctgtccttggagatcagaggattgatgtttgagtaagaaatgcagaataggaccatatgttaggcagggttatagacagtaaagcaggtcagcatcctataacttgatgactcaatcatcctaacattatgccatctgggcgctgatactgttcagctctcccttttcttatgaaaagtttgactcaggtcaaatagggtgtctttttttgtttccttagaattttgttttctcttccttttagggattagttcttttagtcccacctttgagataaattttataatttcaaattttgaattctgatctaaaccctcaactgttctttctcccacagtaaagaagttaaagcaatcgtagcaaaaaatgtagagagtatttctttccccatccccaactttactgagatataattgacgaataatatcatatgtattcagggagtacaacataatgtttgatgtatatatacattgtaaaatgattaccacaatcaagctaattaacatatccatcacctcacatagctaccgtgtgtgtgtgtttgtgtgtgttaagaatatttcaggttcactcttagcacattttaagtatacaatacattatcattaactgtagtctccatactctatattaggtctccagaatgtattcatcttataacctaagtttgtactatttgacccacacctccccatttcccctatttcctgacccctggtaaccacacttctactctctgtttctatacattcaacttttttagattcaatatataagtgagatcatgcagtatttgtatttctgtttctagattattttactctgcataatgtcctctaggtttatccatgtttttgcaaatatcagaatacccttctttgtcacaggatgaataatatttctatatatatgtgtgtttatacatgcatacatatctctctcacacattttctttgtccattcatctgcacggacactcaggttgatataatgtcttggcttttgtgaataatgctgcaatgaatgtaagagtgcagatatctattcaaggtactgatttcacattttttggatacataattggtcctccatatccatggattttacatttatgaattcaaccaactgtggatcaaaaatatttgaaaaaaatgtgtctgtactaaacatgtacagtttttttcttgtcattattccctaaacgatacagtgtaacaactatttacttagcatttacattgtattaggaacttaagtatcttaaagatgatttaaagtatatggaaagatatgcttaggttttatgcaaatctgatgtcatttcatgggagggtcttgaacatctgaagatttttgtgtctgtgggaggtcctgaaaccaacccctgtggatactgaaggataactgttactcaaaagagggattgctggatcatataaagttattttcttaatgcattcatgtatgcactagtgtgtgtatgcctctatacacccatgcctgtcactctatgacctgttgtcatatctgtacattcatgtaacaatcgccatgtttaagaaatgtagcattgagcctatgtcttaactgatgtatcctgtttcaatctatcttgaagtggccaatcaccctatccccaaagatactgctactcaaagcatggtccctgaaccatctaggaacttattacaaatgcagaaccagagaactcatgcctgatatactgaattggaatctgcatttaacagatttcttggtgactcatatacatgttaaaggttgtgaacactgttctaagaaatgtcttcacttcttattcctttggcttgcagtgattaattgggtagaggaggcagcatatcagaatcattatgaagcttaaaataaagtgtgcctgggttttagacccaagattaaatctgaagcgaaaccaaatgtctgtattttttaatgattccaaaggcaatcctgatgtacccaacacagggcaagggtatatattgcaaggagtcacagaatctttttattcttttcttttaaacctcctggcaaccttctcttttgctgcctggtcaacaaagattatctaatgtggttgatcagcttttcactgtcccgttcattcttatgacaatttgccctaactatgcacaaactgagaactctttttaagggtaaataaatgttctcattcatcctcacaattgatttaaaatattgtaacattttctaaatatgtacaaacagaaagctatctcatagttcttgtatgaccagaaagttattgaaattttacaaatcaaatgcaaacaataccatgtaaatgaagaacattaacgtggcagatgacattttcctgagaataaagctctacttgcaacataaatacaacacaattgctatattttaggttctttagaatttggcacattttactgctgtatgccttgtgatttctcagttctgttattatttgtctctgtttgaacccatgcaaaaccttcatccacacagcttagactgtcattcagccctctctttctgcaaataaatctaatatatgtctatagtcagcccacttttcttctatgcagatttcattaatgaaagtagtaattcttgtcagtgtgattgcaagcacaaactcaaagataacattacatggcagtccttggttggcaattgaatggtcagtattcagttgaaaggtcatcaaccagaaatatggttagccattttttagaagaaaacaaattagaaaaaagtatggataacaactttggacaccaaagaatatttctataatatttcctgctcagtctgtagtggaaggcagtagagaatagaacttacaaacatagccttggagtgagaaagatctggaaactatttatgatagttctacttactagatgcatctcttggaacaagattcttcgcttctctgtaacttggtttcctcgtgtgtatgatggagatgattattatctatttcataggccaggaataggtatgatatgcaagaagcacctgtggccctatcttagcacatcataaggactaagttatcaggagctattttaactattataatgatgttatcattgttgcatctttattataaatgtgaacattaagtttttattaattaaacctgccacatatttcttccatttgcttcattgtactcttaagatgtttattcatttttctcacttcttgctttaagaacctggttattacagaggtgaaaaatcccatcaaaatgctagagaatttggcacaattattgcttatatttctcctattgctgcttttactgctgtagctgcctcctgaactgctgctgctgctaccatggcttctagatgcttctttgacaatttatttattttccagtggaacccatctgtgaagaagcccttcatagcagtaatatcctggggctgggcactactacaataatgatgctttcgttaatcaccccatgtaattttagtttttgctgataaatactacaataaatcgattgaaactgatgaaaatagctcaaaatttagagacatacagtatttcattttaccatcagcgtatttctatgtttatgcaatagggattgaaaaagttcaatccccatgctcaaaaacacatacttccagctctctgagatgatatgccagacagggcttttgattagaagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaaccaagactaaagataaagaaagaaagaacatccaaaaccttcatgtgctttgtatttgtacatttctgacatatgcatgaagcatgagggaaatacagtaatacactgaggtatgctgccaacatcctgactattcctagtcattagatagcctagtgatgtttttcagttagaggggtgctgaccttactgttttcagtaattataagtctataattaccttttatattctttaagtgtatttttgtaatttcaggttaggtatacaagagtggaaaccgtgtttgatctgacgttttggctcttgtatgaggcagctttaaatagctgtcagatttggtttcattttagtgaagggttaagtaattttaaggcgttaaaaccatgggcaataaataaccatccacagtcatcgaaggaagttgcttcttagacaagagaatgaagctagagctgctagggacattagtctgataaaaagtcacatcagagaaggtttacctccaaatgattttggtggcaaagaagcctgtgcatcaacacctgcccttgagcacagcagtcaataaaaataaggtaacacaaagcagctctcttgaaaacaaaatcagagcctatactcttaagaagttcatagccgtcacaaaaggaccctcgtggcagtagaagctaaatggccaagaatgctggaaatggggctgcaagtcataaatggagaaagtctaaactaagagggtaaacagcaggtgacagtaaattggagcacttggccaggcaagccctgcatctgccacagtgagatcagttactggagagtcatcccaggcctatttcacactgccgtctgggaatgtgggactctaggttcttaagtgttaactatgggcaaaaaagaaacaagaagtataaagtcattgagaagattgtctgcagtagggcaggcatggatgaaaatcgaactctactttgtctgtgggtgaattatttaccttctatctgtcctgggtctgtaaaacagttataagaatagacagggttaatttgtgaaacttagatgaatatgaagtatgagtaaagtaccagacatttagaaatgctcatcaacatcttgaaagaagttctttcattgagataaaaagggtctttgtatctctttctgtaattcttctgaaaacagatggtcagggtagagagctggtgcaatagctcaaatggtaaatgacagacataagattcaaaagaagctcaataggaagaatgatcctaagacaaaatggatgaattgcaatagggttacataaaccatttccttaggtttagaaaagtcgttattccatttctaggtaggagagattccactgaaataatgtttctgtgctaaaaatgcaaaagccaatttataacttttaaaattataaattgaataagtgcaaagagtgtgatatggctgctagatattggtagaaaaccatccttctcatttgtgcccttattagatgtcatcaagagtcttgtgtgcctcctgctgccacatttaaagaggggagagagagagagaaagggaggggagagaaggatgaaagagagagagaaagacagaaagtgaggcatgtccagtatggtgaaatcagctgtaatcaattccagctcaaccactatgagtccttggacaagttacctcattgacaaaatgaggatggaagctccctccctggcttgacctaaggattggattacataatgcaagtaaacaactctgcacagtacctggctcataactgggagctctgattattcacaggaaagagtggtgagagacagctatgagataaggagctgcagaagctctcggtgatctgccaatataagagaagcttaaggcaggacatgacaactgtcatcaattatttagatacctgttatgtagagaagcaattctcattaatcagcctaactctaaaggaaagaaccaggaccagtagatagaagttatgggaagagatattttggctccataacagaagtaatgaaagcagtagtggtgtagtagtaggaactgagaatgcaaatagctcttggagtgttccagttcctgttctaaggactctgcattcttatttgatcctcagaacatctatgtgaggtaggtataattattattattttcattttacagatgaagaaactgaggtacacagtgaagtaaatttccaagaacatgtaaaatagaaatgaatgacagagctggaatttgagcccaggcattctgtctcttaacccatttatgctggaggttgtgattttttaaactgatgtatgacagaaaaatcagaccttggcaaatatcttgagcagtaggctataaataactcccacatgcttagtgttccaataatggaacactaggcataagtggctacacacattatctcaactgccccaaaaagtagctcaaatacacagggaaaggctgagtgactgtacaccatggttgctagtaaggggattcctgcactgagttaggaattggcctggataatctctacggtccctcccatgacatgtctgtcattttataaaaccaaaaagcaagcaaaaaacacatggtggcaaaagctaatacaaaacctagagtcaaacattcatgaggttttctcaatgcaaaagaagcctaaaatattcacctgtaatctatttatatcaaccttatactcagttataaaaggatggccatcttattgtcttgttcaaggcagagcagaagaaatacatttgaatctgggagtggtagtagaactaatagcagcaaggagagactcatgaatctttaggagaaaaaggaggtgttaacgcactgaacaaatattaactgagtgcctcttctgggctgagataagaaaatcattgtgaaaccaaataagaacaagcattgcaggccccagatatttagagactccagtgacgtttgggcttttcctgaactttagtgtgcaatgtcattttaaaaagtattttaggggaaatgataaattatagccagtttcataaaagaggtatacattatatttttaaaagactttatatgaactgaatcatttgactttaagtttgggtgtaaaaagggtatacttcaatttctctcaggccagcttgctccccagtaaatgacaaatatgggtctcgccgcactaagatattttaatatacttcagtgggaaaggctctgatccagaaatttgcagttgtgctattgataaaatttatgagaaactttcttctgtgggcctcagttttcacatctattaaatgtgctgatttaactaaactatctttatttcctttaggctcagacatttcctatttcttttatttctataactgtacttattttcattatgtagataccagatggcaaaatgtcctggtagtgtgtgcaggactcaaactgattctgggaaaatggggcacaagtgaattctaaggtataaggagctgaagtgagcagaagcctctagaatctatttctatttctgtcagctacagaatgtaggcccagtttaatattaggagacgttgtctagcttttaatattaggtttcagagttgcctaacaaaacccatagaggttgtttcttgcttagagtaatttaatgttataaggatcaggcaggtgcaacatggcataaaagtattacttgccccaatgccacctttaatttctctcaatctttcaaagcatcaaaagaaaaaaaagttctctctttgtctattgtttataaatataatttattctctgtgcttaggtgattttcatagataagaggacattcattgtattcagtaaaacttctagagcagtccttacactagtaacaagtttcctgggcaatactgctttgttatcagacttcaccatgtagatctcacatccttctcttttctgatcttgctcttatcatttcaaagttacatgtagagtgaggatgcaggtttcatagggtttttgtttttatctgagacagagtcttgctttgtcacccaggctggaatgcagtagtgtgagcatggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaagtgtaggattacaggcatgagccaccaggcccagcccatggtgttttctgacaaagctactccattcatttgctgtttgaagttgattagtgaaccacattttgatgttcactaccttcatttgcttttatattcaactgcattctttaagaatcttccctcagcagttagaaggccaaagataatttaaatgggattgagggatatttccctctcacattagtgctgtagagccacataagaaggtattctatggtagaaatagatttagaaaggtcaaatttgaaaaataaagtaagtccagacccgagtgataagatggatggctgtctagattgagcatgcaattctaatacttcagttccacattcttttttttttttttttttttgagacggaatcttgctctgtcacccaggctggaatgcagtggcacaatctcggctcactgcaacctccgcctcccaggttcaagcaattctcctgcctcagcctcccgagtagctgggactacaggcgccctccaccatgcccggctaatttttgtatttttagtagagacggggtttcaccatattggccaggctggtctcgaactcctgatcttgtgatccacccgccttggcctctcaaagtgctgggattacaggcatgggtcaccgcgcccggcctagtcacacattcttaaagatgtttcagcttttgatttttaaacagaatggtatggagaagggcttttgctggaggtgcttcagtcagttagcttcaactctgaatgaacaccgaagatgtcttggctttcctaaagactcaggctacagattcttgctcatggccaggggtaaaatgcccttcatccaatttaatgctctcccatgtgtagcaaacatatcaactactctgggttggcatatgggggttttagtaaaactgtgtaaagaatttgccatagaaataggaatagtctttcactttccattttgtactctgggtcttctctgattatatatctcttttggttttcctttccaagctccatctttatcccaacctattgggtatacatctgatcactgctttgctaacacgataatacttgagactaattaacaataccttagtgatactgcattctcaaataggaaaatttcaaatgactagaagaagactagttgatgcctaggaccagtactagaatggttaagttactggttggaaacttcagtgtgcttgtttctgcaggaggagaactgctttaatgtgaattgcattagaaagctcccctccacttttccttccccagtgtttgtctactgaatagcagggtgaaagcgtcggttgctctcatcgcctcacaatcaggccaattgggcataactgctttctggtagaattcatctcataataaattgcattcatggaagatgcctagtatgtggtaaacatggcatggacaggccaatactagagaaagatagaacactggctcagaggagacacaaacaaattgcctttctgctggctctgaaatattctttttcagtgtagttaaatataaagttgaaatgatgctaactacaccttgatccaaacaacctcttcattgcttggcttctgatgggaatgctgtaggtagccatttgttttaatgattgatttcactaatactgagtcacaattgcactcctcttgaagttgacataagatctccatgcacagaaaatgaattcattagaatcaaagtgattgtataagaaactcaaattatccaggtgttgaaatgcatgtctactttcttttcagacaatggaatcatttataaaacatatagttatttaaaacacagacacacatacagagactatcatatgggattgtgagagattgctaattaacacatacaaattaagacaaatattcattaaaacaaatattaattcctcaaagtttaattcttaacaaatattaattctacaaagagctaaaaggctctatgtaggtagataacggcattcagatttacctcctaatctttacagtaattggttttaagggttggagaaagaagtaaaggaggtaaaagaatgtacatagacaataataattatgaataacatttactaagcatctactatgtgttaggtactttgctaaccaagcttagcatttcacatatattatttaaaattcacattaactacctgaattacattcaattattttactcttcagggagatttgtataagttgtgtaaggtctaaaactgttaacaggaaagctgggagttgaactcaagtttctctagttcctgagccaagatcttagttgctaagttattaccacattctcagagcctctgaagcaataccactgaattcagggcttatgtttattctagcagcatctttctttacaaaggggtatgtaaaaatagtagtccttctaatttctcctccctccccccaatatttctgggattatgcaggcgatactttgcttttggaaagaatgaaatataggcaattgacagaggcagggtcctgactttcttttttaattttttttccttgatgatgagcataatcatgtgaataattaagcttcaagagctaaatgactgattggcagcaagctgactaactgttctttatttataaggatatagctttcatgggaaaatgtagggtggttggtaaaacatcagaagtctcccttgagatttcataaatgccatagcttaggggttaaactcacagacatttaagtcacatgttcttgagttcaagtccaagttgctggccctttgggacttttaactcccctatgatcgattgctataaattaaaactcagttaatagaatataatgtaagtagttatatatcggaaccaatgatagtacctacttcttagggttgtcaagagcatccagagagctaagttatacaaaggactagctcgatcactggcatgggataaatatttgataaatgtggtttgtaatattttataaaagtgacaaaaattcttatttatgtaccttttttactatgaggagaatcaggttggattcttagaaaaccttcagtgcctctgtcacagccttgcaaagactacttgggatatgtttatgttgataatttctccccttttatttttctatcagtcagatttataataagaatcagctgttctttctaaaagactattgtgcctttatattattttctttaattttcaataatcctatgaattagcaattattatcctcatttttacaaatgaggaaactagagatccgaaaagtaaacagcctcccagctaataaacagatgagctgcaataccaaccgaggtcttctgtctctcacaatccagttctaatattaaaacaaaaggctttgagaccatatgacccaaggtgcaatctgtttttcagatcagaagattgggactctaagatagaaacacggtctgtccagagtcacatagcaagttggagacagaatggacactagaccctaggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaacctcctttcacctcctggccagctgcagcgctaccatcaccagctatagcagctttctccctggagattcagctttttctccactgatggaaggctttccctccatcactccaatgtcagagcttggccgatttggttcctcaggagactgtagagaaattcactcccattgaagcattttcttgacattttgacattcaatcagagaaaggcaaaaggcaggctaagggcccaatcatcaggtccatgaagatcaagctatgttttctgagtacctattgatagaatgtgcaggagattattactgtttgccaaagctctattgatcttggctttgtgaagctcaaagtctgtttacagccacctataaaaaccaacagccacttcttttactgaaggttaacgtgctgtgtttatttaattgaatggaaatggccttgtgttttccaaatgtcattgttaataaattttcaagggaatctgtgactagtgtgtaggtgttgaggatgggagaagggactgtcatggggagggacggctgttggaatttgaagttgctggaagcaagagataaaagacaaacacatagatacgacattggaataatttccctgtatagaagtgctataaaatatccttactctatattagtgttgttttttaaacttgtcagtaagaattctcccctgggtgttttattctttagcctgcgtctgtttttgtttgttcttttgggtttccaaaaaatatatattttaaagtgacattgagcattttagtataattgtgagttttggggttgaatatttttcactattatttgatcagttttttccttctgtaagagatttaacagaaatggctaaaattaggagccatattagatagaggaagatattggcaatcctattgacctgctttttaagaggcgtgtttcaactaacaggaggagagatgcaaagagctttcaccaaagcaatcagaagacctgtaaacagcctcagggaactgtaaaagtctgtgagggtctctagtgtaccagatgaaaagcagaaactttaggtagccgtctgaatgtgtcaaatgggaatatcagaataactcactaaatttcctttttcaactttcctcgcaaggtttgtctttttatgtggtaaatgttggtgagttccatttttaagttttactcttcccattctacttcagtctccttagcaaacacacacacaaacacacacacacacaaacacacacaacacacacaaaattgttcttcttgaaagatacatgtaaatgaatggtgagtaaaaaattaaagtctggacgcagtggctcacgcctgtaatcccagcactttgggaggccaaggtgggtgactcacttcaggtcgggtcactcacttgagaccaggagttcgagaccagcctggccaacatggtgaaaccccatctctactaaaaatacaaaaattggtcgggagtggtggcatgtgcctgtaatcccggctactcaggaggctgaggcaggagaattgcttgaaccctggagttggaggttgaagagagctgagatcgcaccactgcactccagcctggcgacagagcgagactccatctcaaaaaaaaaaaaaaaaattaaaaacttattgtctcaaagcagccattcatttattcaaggaattgctaaacttttctaagggaccaggcactggcctgagtgctacatcgagagagagtaataagatcgaggatcccattcccacgttctgcacgtgtgtgtgtgcgtgtgtgtgtgtgtttcgatctgtgtgtgttggtgggtgaatggctatgcaaatacataacaatttaataagtcttatgatactgggagtacctgactctgattagggggcactgctttaatatctggcaatggaggatatatccatcttcattcgctccttcatgcccccatctaaccttgattaaagtctgatttcaaatagcccatttgttgaacattttatcaaggtttttcaggagcctgacagaaaatgtaaagtcgtcgtatgttttgttttgggaaatactacttctaaaacttatttgagtgtctcagctttttctttcttttattttattttttaattaaaaaaataatattatcttttatttgtctttaagagacagaaccatgtctgcctagtaccttcacttggtcaaatacctcttttggtggaaacaacacaaattatgtaggttgtatatacaggatgaactcggtttaaagataagacatgaaattcagtggaaatattctttaaattctaaacagagaaatcaaaacaaaggtatattcatactgcatgtgggtataagttttttcttacatatattatatatacatatataagtgtaacacttttaagaattttattgaccatctaaatatatagcaaaatcagctgggggtacaagagtgtaactacttccttttttcctaagttgtggaaaatgtgagaaatgagaagtaagcaagacggaggattagaatcacaaggtaggtttccctagtatgaattcagtacctgaaaatcttcttagttctgagtttgaagcagattctataaaatcctgtattaaaataaatacagtaggaattagcaaggatgggggaataggagtgggcagatatgttcttgaagagaataaatgcagaacattattctttgtcaattaatttttactttttatagattgttagactatttaacaaattcttatgagaaaagtgtgtttttaagtgatctctgggaagatgttcctgataataaattaaattaggactgtgcattgcggagcccccaccagttgtactccctctggtgaatttaataccagacgcaacctagttagaggtgacatgaaatcacagaatttgataatcttttttttcaaagttaagcaaatatagatgagctcttcttgtatatgtaagatgccagatggtgtttttgagaaatcgattcgtgtatagtaccagtccagacaaatgggtccaatccttctatagataaggcgacccacttttcctattcaaccatagggctccgttgtctggcacacattatttaacaaagtgacattgtggagtcatcagtaagaatgtggcttctggagtgaatttctttttgagtttgaatcctttgctgggtgatcctggccaaatttcttaacctgtttgaacattagtttcctcgtctctaaaatgtgagtaacaagagtttctcgtaggaactatgtaaaggtaaaaagaaactgtctagcatagtgcctggcacataatataatttcataaagtgtaactcttgttattaaactggatagctcaatagatattgctccagaaacactagtgcatgaggctgccattacgatcgccaaatgatagcagctgtgaactgccactccaagccctttgcagatgcatgtacttcttcgcaagggcttctagtcattgacttacccagatctatcgtcacctcttgaagaaacaaccagaaaacactttccctacttacagtgaaataagtgagtatccttctacagaaggacagttagttcttgaaccaagggacttcaatgccatatgagaaaaattgtcttgtatacaatatctttggagagtgaaagagttttaagcatcttgatattagaaattaaggctacaatgcattcaggttgcctataagttattcatttctgtatcttgttgtcaggaaaaaaaaaaagaatacttcaaaattaagttttttccatctaggatctcagatctcattgtataattttcatcattcaactggatttaataggtctatcagtatgtacagtaaattattttcaaaattcttcacctaatagctaaaaagtaagccctaatctggttttctgtgaaattgtcctcgacagaataaatagttcaggtgtctgaaaagaaaaattccatattcctatatctgggttgacacttaagactgcgtttgtgaagcctccttatatcttgaagacaggatgtatctatcttgctggtgagaattttgctgttctggagtctatatcaggtacctcaaacgtgatgagtgatagaggtcatgttttgttgtatcacagtttgttgaatctccctccttagagattcatttgactgaaaaattaacaggtttatttgtgcaaatggtagttgcacacccaattattgcttctgggtttcccatgtgactagccaagactcaaggtgaaagtttggcctgcagctttggcaaacaaaggagaagctaatgaatcataaaggtcacatcttcttgaattttcttctctttcttcactgttctgattacttttaaaaaatctctattccttatatattctgagtacaaaaactcattagcaagatttggttctgttgtctggagaattttctgctcactgcaataggaaggtgatccaggtaccacataactgtctccatgaagatgtttgcaatatgttatgagttttttaaagttattgtttgagaaaaggccatataaggagataatttttgcttattactaattagcttacccctcttctgctgttcttacatttatgactatttacttgtaaataaaagttattgatctttttagaagtccattggattctgctgcttttatttttgagaatcattttaacttacaaacacatattaccttttccaaaaagtgaccacatagctttgtgactcctccctcatatattttgagcacacagaaattaccatcctctcactgagtactatacatcggggcctctggctcttacctcctttctcagatccaggactgaatgcatagctgaaaagatgactttagtctttattcacaacctgtaaactaaagaaggtcattaaaaaaaattcttcgtatcttgcaaacaaaagaactgagatacctatctaagaatggcaagtctgagaagcaaatacctggctctagccctctgccataagtttgcaagcttgtgtagacctttgtctgagaattggttaggtatagaaatacacttcagcagagacttgacctatatgactttcaaatttgttatgattctacaattagtgtttgctaaaatcaaaactgtagaatatagtatagagagtatattaattgttggctctatgctgacccaaaatgaagtcttttaagagattagagtactacactgtctacatttaaccaggtgtcatataacaattaatgaaaattcaatgttttatacttagaatttttaagtaataacagatgatggatcaagattaaaactgtattgacagcctaagcaaagaaataaaatctaacaaaagaagctttaaaagaaatgaatgtaaaatcctatattttgattaaataaatcaagtttgcaagtaccaggtataggagttttggactgacagaactttacactaaacaagatgtaaaagttttagttgtacataaatttaaaatgaacctgccttactgtttcttttaaaaaaattaagaaaaaaaaactctacgcagtattaagttctattaatagacttctaatttattactaaattatgttgactcttcatctgaaatgtatctatctttttactccattaatttctcttcagtgatctagtcacagaccttattatcctttacatgacagtagcttaataatggtatccttgcttttctccctactacagtctgtcctctgcatgtagccaatgttatacttgatgacttaaatctgatcatatcattcccaagtaaataagccaacaatggtcctcaataattaccgaattaattattccctgagaaatggggcccctcagtgtaatatctcatctcaatcattttttttagttttgcagatagcacctgccatttctaaatatgtgtctttaattcatcttaaccacttcggattatgacatcctaaaattgccatatatttttatatttccatacttttgctcaggatcttctttggttaaaataatctttcctacttcacctttgaccaaccactgccagtgatccatgagattcaaatgtcttctcatttggaaggactgcctgataacctgctacctcagcttcaggagaaaccagttgctggcctctgtgctgttctcctacctctaaacagaatgtaaagtactattattttctcttcaattgacaaggcgcttctatgattgttcccatcttctgttggtattatttttaataaaaagatctcatatattgtgttaaagtactaaccttgagaagacccccagtctgaaagaagaatatttcacttctcccttccccattttcaatcacacatattattgaataattttggttaacatccttaatattctaaagtatcttgaaacagttattttttctattttcagaaataaggttttagtgataatactgaaaattctaaactgtgagcttttgtttcagggatagaaatttaaaaaatcatgaggtcttctgtcatgattttgaatgtttaatctactttgtccagtgggcttctgaatcttttgtgattggcacgtgttactgagatgcagacacatgcaattctggtgaccgagttctcaagctacagtttattatttcacactgcagtaaatgtatggactgagggtgaggggactgtcagaagatgtgtgtcttgggtgcctgaataatgcttcttttgctattcactttcatcttaatttagagtcatatatttcttgttaccttttggttttccccggcacctaacaatgtaatcttcacaaagcagtgctacattctaaatttatagtgcagtaaatgaaagaggttggatccattgtgcttcataattcagagggaagaatgtctgcagaaagaaacgtgggtattctttggaatgccatatgtgcaataattgaaacattttgaggaatttccaatttacctcttaggaggaattcaggtttttgttctttttgaaaagaagatgattgttacagacttgggaaatcctaaaagaaaaaagaaggactgttgggacatcctggttgttcttgacccccgcaagaacagctacagttctttcagatcacagcacttgaagtcagaagcctaagtgggtgtccagagaattcaatgccgaaaggttttgcccctcttaactctcctgaccactagcattctctctaccttagtgtgtgggtaggtctttgttatgtctccagactcacactagttttttaaaaaaaatacttaggtaaatagcagtgggaccccaattctctttttcttgtattccagatgaaaaagaaaaaaactcaccagtttaaagtgctcgtttcatatgttcacgatatctaatagatgttaaattttggtaccaggaagtgagagagtgatatgaaggaactagtgaaataagattttaatacctggcaacatttcatagatgataacactggtccacttgaacacttgccattttttattcattatatctggtctagatgggtctagctaaaactttattccgtgcaacacagctcttgcctatttagaagcctttaactgtgtgtttaattatcacctggagtggttcttttgcagagaaaacatagaacgtaggatccagtctttcacaatgcaaaagttgaacctctgtcacctggcatgcttgaggaaatttcagaagctttgtcctcaccttagacccactgaataaggtcactaaggaatggcacccaggaatctacattttacaacctctccatttaatacatatgcttgctagaggttaagcaacactgtgggctcacctgtagcacgtagcactaatcagacaagactcaatatctggccagacttttagatgataatcacaagaagcaataacatttttctgaaacaaaacaagtggcaaatgatactgtgaaatctctggcactggttacccaatatccacacataccccacttagctctagattagaaaataaagaatgagattcagcccagaggcagccatgcgcacaggtgcacaatttggaaaaaatgagaccaattcttaaaaaaaaaatcaagctgaagtcaaagaagcttaataaaaatgtaaatcctctttcaactggctccatgttttctgtctcttcatgaacacctgccacctggtgaataatgtcaaggcctctcagagtgggtcaggaaagcaaaaaggcccatggccggaaatgctattaggcattcaaaaatgaacaatccaggtaacaaaaactcatgtcagtggtgcaggtacgatggcgtattctcttcataagaaacactatgcaaatgaatcgcaaagcgtgagagagcagaacttttcactgctgccttctgtcaagttgggaacactgaggtgaagattgagtgcaggggatttggggtggggagggtcccctgtgaaacagtttctgaatgaaagtgagggaagcaggcatgggatagaaggataatttggtctgagatgcaagtgcggctaaagcctcagccagtcccacggtgagctctgaagttaggttgtcccttctgagatgacctaaattgcataaacggatctgagtctttgtacctcccgtgcccatccaaacatccagtcaccatatgaggccacacccattgactgaatccggttctggagagggactgaggtttggtgcaagttgtccgcagccaggacttccaacatctggaggatgagcaccctaatcttgaaggctgaattcagtagcacatccactgcaactgaatatctgattcaaggccaaaaattgtggagctcagagccacaacgggcttctgatcttccacaggctgctgaatgcccctggcagtccactgaagtgataatgttaaggaaggaaatgattagaagtaatttgctgagggatcagagttgcatttggagctatcagcaagtaatgaagcaagaatgtcaatcgacaggtgaatcaaagtcagggcaaaagaaagggaggaggaaatttgctcaaaaaaaaaaaaaagccattactttcattgaggcctgggatgaggtaagtagagaaagtttgcaactgccagagattgctaaataggaaaaaatcttttgtgcacgtgttgctggtgggattgggacatgaaagatgttgtgggacagaatctcactggaaaagtcaagaatcagagctggtttcaaaaaaactcaaccttcaaataaaggatcccctatctctatattgaacctggcaatgaatacctctttcttttccttattggttggcaaggatgtagaacactaagatacacacacacacacacacacacacacacacacacacatacattctttgtttgtttgttttgagacaggatctcgctctgtcacccaggctaagtgcagtggcatgatcatagctcactgcagtcccaatctcctgagctcaggctatcctcctgccacagcctcctgaggagctgggactataggcatggaccatcacacttggctgatttttaattttttgtagagatgaggtctccctgtgttgcccaggctggtctcaaactctcggactgaagggatcctcacacctcggcctcccaaagtgctaggattacaggcacgaaccaccacacttggcaaatatttaattaaatattaaatatatctaattgtttgataaaaagggagagaggctctccttgatggaagtaataggttctggaatgcagtgagttctgctcggaatgccctctgaccactgcctccatgtgtctaatataacctatgacattacccatagaggtgccgctttttcattgggggacactgctccaaaagtgcctggaaccaggttaaaccattgaggttataaggaataaagggcctttataataaagaccatttctgtgactgtgttctgaaactgataaaaagcacttctttctgtctttggtgtcttccttgatagttgtaataagaatagtagtagttattcttctttttcttttttcttgtttgatttgtaaaataaaaacacttttcctttcctctctggtgtttgaatgcacccagtctcatttcagcagtccacaatgacatactgaaagttgtaatagagctacagctttgctgtatagaggtccatggatatgttttctaattataatcattcttgagctgtttgtaactatttcagactgcttacccagctgtatgccactggcttgtttctatttcaggaatcatctcttcctcttctcctccttccccctccattcccaaatccccacattagtagcggccaagttattttcaagtacagtgtatatgtaagtgatcttgatctgctaagaaaagacatactgtttgtttttattgggcaggcagcatcctagggaaaaggagaattacaagtctaatttggttaggaagcatcctttttcgcaacagtgaggactgcaggtaccactaaaatcattgctgttcattactaattggattaagtcctctctgttccaccaaccctgcttttaaaatttcttctctgcttttcattcagaaactgcctcagcctgcactccgttatctacctccaggctttattgcaacacctcccactgcctctctcctggaccaccttgtccacgctgcacacagttgccaaattcaactttctgtgttgcaaaccttgttgtggctccccctgtgtaaaaaccttttagtgtttctcatctccatgaatcactaatccatggtgcttagtagcatgtcaaaggcccttccgaatctatctctagcctacctctgtggaccttatctcttggctctcccacctgcccccacccacacctctaccccttgctttttgcttttcttttccccaaattctgagctgcttatacgttctttcccttcatggtgttttatacctcagcgctttcatgcatatagttcccagtgtctggaatgatcttttggataaatagtgacacttcaagaaatatctttgtcccaacttcagaaacctaattttcattgtgatgaatagctcccacagttttttccccgggctattttgcaagtattgaggattcacatgttaatcctgaaatgtgcgttctaaaaaaaaaaaaaagctccatctgagaacccattaaacctctagtttaaatacccaggcattcttaaaaatcgaatttgcattgtctttgctgcagtgtcttctcaggtaaccaatgcagccatgtcagattgatacatcatgttgttaagacccccatctgtctctagggtagtagaaaagatgcagctacggaagagaacagaactgtgctcctgaacatggcatggctgccgaacctcacagataatcctgaagcaggcaatctctgcagacttctggggtgatttgagcatgtgtagcttttgctggcagctgagagaaatgggaagtcccctgagctgaaagttgggagcactacatcctcatcaacctaaatctgccacatacaatctctgtgatcctggggaagtcactggacctctttgagtcatgctgtcctcaaatgtaaaatgagttttacatttaaatgttctaaataagttcctttagaatgtttcaattaaaaatttatccatctgtatcagataatattggtgatctcattcaatttttttagttccctttttgattatttttgtacccccaggcctcagcgtggcttctcttgcaatagccagcatggcttgttcttaagaaagttgtcctcagtctactactctattgcctctggctggaaaaactcgggtaggtgcaaggtgtccaccagcattttctcctgggatcgggctgctgccagctctggcactttgcctgggactgtagccttgtctggactcccctttccctctgcgtgggagtgcttccttatcaatcatttgccctcgaatccatgtcttaggatctgcttatgggttggactcagcccaagatattctctatctaggtatcctggttgagtttgttaataaaagttcggtttggatttagacgagacaaaccaaacttggttagggtaaatagaggaggaaggtgccttgtttcctaaattgtgtttgataaagtgcttaataagggcggcttccaaagtggttccaggtaaagaagtactaaaaaggcctctttattaatgtatggattttctgtcactgatgtttgtctgcctatgaatagtttagactagatttttcaagtaagcactttataatatctgtaactctttctaggtgttttataaacaactaactgagtagagcagcaacaacaaagagctgtaagttttctgccagtaacttctagtttttacctcctcaaaagctattttaaacaaatatgtgtctaattaaatctcaagggaatgtgaaataaaaactggaatttgagttcagagtacctgaaagagcatttttggaaaagactttgtttatgccatttgtgcatatgtagatggaatcaaaatgtataagataataagagaaaggtgccattgagcctccaagtagaagcccgatgacttcacttatgcccggctgatcacccaagtgtacagttagtcatgatttgatatctgttgtagattaagcctgttgcacacagtttctaccctgatgtttggcatgggccatgcaccatacattgaaacaagattttgaagtaaatagaaccacattttccactttctttcatgcagttattttctctgcaagatgcattctggctccttttgtgaaacctcagatttgattctacaagctgctgagaaacacagcacctgcatgccacccaccaaagagagtgtttacatagtctgttgtacatagaaagcatgtgggtgtgagtatacgtatgtgtgatgaaatggttcaattgacattgtacttacaagataaactgcatgtatcaccaaattatttgacttctctactcagaaagcattaaattttgaggtttaagtagacattaaacatttataatttaatatacatttaataaaattaatatttatgaacacatttgccttgggaattaaaagtggaaaacagtgtcatttacttgctaatggccaccacggtgccatgcagttacagatttgatggcctgcatcccagtgacattgctccaagaccagagacaagaccattttttgtttgcatggagctaagtattattttcagaaaatcaaaaccaaaaggtatgttttgcttcctagctcagggtctctggagacctgacctgccaggtatcatttgctcattttatttaaagaaaataaaataaatattcaatggagaagttaaaagtctctttccaactcaactctatatctcaaagaattattttctcattctgtcaagccatgttaaaattttcaagtaaagtcgtaatcatttctacattttctttcctgtttgtcttgcatctcttaaaatggttttaatgttagaagctacttgacaatggatgtgaaaatagatttaactcagcaatcaatatattatcaataataatcattaatttatacataaacatcacatgggtagctttccaagtccatcctgttttttgtgggctcttatgctggttcagagatgatatatgccatttttataaggtgaagaagtggagcagtataaattgtaccaagcaagtattgagcactgcgaagttcactgttccttagagaaatgagctatgcatttactgctaaaaacaaacctttcataaaatatttttttgggcaccaacctagtgaaggagtaaggaaaagaagtggatggttttagcatttaccctatggaagcttatagcctggatggcaagatcaaattaacatgagaaggcagtttggtgtaatggttaagagcctttggattcagccaaggcagaaagtgatttgaattctaattgagcccctttttagctgtacaactttgtaaaagccctttaccttctatacctcagttttcttatctttaaaatagaaatgctaatatctacctaatagtgttgttactattgtttcttaaagattgacaacaaggcgtatgaacagcatgcctggaaaatactggatgctcctcataagtagttatttatttattaatatcactgacacaagtgaaataatccatctcttcctaccccagcacacttatcataacaaatttgtaatttgtatgtttacaatatcttttctgatgaattgatccccatagtatatttagagcagtggtgtctggatttgtataaatctctgtaactctagaacttcacccagtggccaatacataaaagattctaaataaatatttgttgttgtcattgtaataggggaagagtatgctccaaaacaaagatactgattttaaaaacgaccacactttcaaaaaaaaattttttttaattctagagaccagcatcgagagtaggagtactcagtacgattatttacggtaatatatttattgggtaaattaggcaccatctggtgtgctagcttagatggctctagttctttattaatagatatatgagactctggggtaataggttgctagatccatatgctattcaggagacaaatttagtatacggtaagcttgctacaggatcaagtcgcataagaaaatgaattgaagtcgaagaaatgcttaggttaacccaacaactctgataattgaccaatgtggcaagggccattctgttccaaaaataattaacaatatgatcagtactgaattaatgttgttacggattataggtttcaaattttcccttgttaggaaaatcaccttttaaataatctcatagggttttgaacaaagagcacagtgtttctttttttttaaatagaaacccatacttgagaaggtagcaaagagtagcaaagagacctggatctctgtagcaagttcttggcctggtcttcattttcaattctaaaaattttgagggaaataaacagctgtccaaacaaaatgctgaaagaatatccctggacaaacagaaaatctttttttttttttttttttttttttttttttgagacggagtctcgctctgttgtccaggctggagtgcagtggtgcgatcttggctcactgcaagctccgcctcccgggttcacgccattctcctgcctcagcctcccgagtagctggaactacaggcgcccgccaccgcacccggctaatttgtttgtatttttagtagagacggggtttcaccgtgttagccaggatggtctcgatctcctgacctcgtgatctgcccgccgcggcctcccaaagtgctgggattacaggcgtgagccaccacacccgaccgacaaacagaaaatcttagaggggcatcaaagcaaatcatatggatggagagtgtgaatatgaagaaaagcatattctttcttcacacacacacagtatgtgtgtgtgaagtaatcttcagccaaagcaaagactaaaatgacctgttcaataagatggaagcaaactttaaaaaacaaacaaacgacaaaaaaaaaaactgtcctccttctccgccaaattcaggatacatgttttatcagcccatgtgctattaatctatttgtgattattctatttcattttctctcccatgcttttctcatttcttctcctcattctaggtgagtataggaagcatcagggctggggccataaaaagcctgtggccaaggacattgcaataagacagagaattttagatacttcattaattatttttcctaccagttaaggattccttgtgtaatgacagaacaaggagaagacagcaaaataatactaatgctaataaaaatatgtaatacagagtacttatgatgatataagcattgttttgtttgcttagattattctgtctggtgttcttaacagcctgtatgctgggcaataaaaatagagtctcaggaaaacagaaccaagtttgctataatttggagagacaaaactaagctaagattctttaagtaatgttcatggggagtttgtgcatatgatttatcagaaagagctgcttctaccagggctcataataataatggttcccctgaactggatgctaaatttatcaactggttattttgggcttctcttgccagtaagcctatagaaaacaaaaacaaaaacttttgctataaccttgattattcagagaaaataaggtttctgctacacagcagggacaggacatggttggcaactgggaaagacactcagcaaatattacagataccagaaggaacctggagaaactctgattctttttcattttgttcttaaaaagcaggcgtctgaaatgtgcccaacttcagctaaagaaaaaaacactattgttgggtctagacacaaagcctgatttgctgattttatttttcttcatttagttattttattgttctgtaaatatggacttaccttttttgcttctttattttatcttttggtagaaccttgagcagggacaccctagacgttcaactgttccgtgtgatcagtgtctgccttaaaatgtctgaattcctgtactgcatttcccagtgaagtttagtgtttatggcaatcctcccgatggggagagaaatgagccggcgaggccaaaagcagcatctgtgacttgctaggatcagctggctctgtgtgcatgatttccacttcaaagggtacacagacaacttggtgatagtccatttattgcagcctggtcttgtcaattagtcaaagttatcttctatacagctacagtaagtaatgtaaaatcatttacaatataggtgttagaacagcagagacccttagagttcatgtatttgacttcctccttgcacagttgaggaaattatgaaatgcatgtctttagcttcttcattctacagtatttattgagatttttttatgaagaagaaggataaaaagatacaaacttgtatgaagttagggaactggagaagctaactcattttctcttttttttcctgtgtctttggcacctctattagatctggtccgtagtgggtctaaataagtatttattgaagaagtaatacatgctttataaatgatggccaaatagctgtttgaatggataaaaaagcttcataaagaaagtgatacttgtactacgtcttgcaggatgtgggagaattggaaaatgagagagaatagagaaattaaccaatattatagtccagccaacagcaaagattgaactaaaattctggtctggtctagaggtaaaccaataggctcactttccaaaagaaaatctgaagcatttaagattatttaataaggaagaatttcctctggtgtcctgaatgaggaatctttggggcaagaagggtcctgtcctatttattatccttaagaaattccttgctatttttagttctcaacatcagctacttctcattactaagtaaaagccagattacttaacttgcactcaccctaattcatcttatccactggcagcaaattccttccttagaatacttccccactggtttttgagaagtgaaaaggattaacatatatggcagtggagtgttttatgtaatagtctttttattaaccccattatccagctgttggggtgctgggtagagaaggaagggaggaggaggaaagtagttgttggcactgggggttcagagccgccccagctccttgagatgaagggatgaaaataaatcctctgtattactgaagcatgtgaatgccatgaagtagtgggacctgaatcaatacattgcatttacagcagagcaaaagaaagaatagggttttcagagtttatttatcctgcttctctgaaaaatacccgtgtgaactattgggctgagagtgttgagtccattgaatttgactctttcactgccatatctttggagagaatgccttcccaaagagtcatatccaaatgtaatgtccctcccttctcttatgagtgacttacttttggtattccactgggtggaaaaaagcttttcttacaggatatatgaactaataatagttatacgactgcttcggatttgtcgcgctccccttggataagtttaatatgattttgtacacattaattaattatcttaataacagacaaaatagaaggaagccactaccgtcctttccagtgcatcagatgaatcaaaatgaatcaaagggctgggcatggtggcccacacttgcaatcccattactttgggaggctgacaccagtaaatcacttgaggccaagagttcaaaaccagcctcagcaatatagtgagaacccatcactacaaattcctttttttaaattagctggacatggtgacccatgcctgtagtcccagctacttgggtggctgagtcaggagggttgcttgagcgcaggggttctagactgcagtgagttatgatcaccactgcagtccaacctgggtgacagagtcagaccttgtctctaaaaaaataaatttaaaaataacattaattaattaaaatggatcaaataaacacatacatattgtggagattgtgagaaataagccttgttctatgtgtctcaggtttacctgaactccaagtagccctgatgactatatggcagttatcacaataagcaacagcataaaggactttgagaaatcaacagatcttatttttaaaaatgaattttcttaaacatgtattcactcagctggcagtggtggctcatgcctgtaatcccagcaattttagaggctgaggcgggcagatcacgaggtcaagagatcaagaccatcctggccaacatggtgaaaccccgtctctactaaaaatacaaaaattacccgggtgtggtgacacacacctgtagtcccagctactcgggaggctgaggcaggagaatcacttgaacccgggagtcagaggttgcagtgagccgagatcacgccactgcactccagcctggtgacagagcaagaccccatctcaaaaaaaaaaagaaagaaagaaaaaaagaaaaaaaatgtattcactcaatatgattaagtacctactctgggctagatattaattagatcattgagagtgtaggtgtaagccaggcagccagacatcaattctcatggacttgcattctagaaggagattgaagagatgaggcaacagttgtagagaacaccttactgctcatgggatagaaaattaccactgggatgagggaaagttgctacttttgattgtggtcaagaaaagcttttcaggagatcacccttggcttgaggctcattgataagaagaggccagccatgcaaacatctgggggaagaggaaagagcaagtgcaaagatcccaaagccacagagatgtttatgtgctgggagaacagaagaaatcccagtgcttgtagtgcagtgagcaaaaggaagtatgaggccaggtaaagtaagaaaggttggcaagggtcagatcatggagggcctttggggctgttgtaaagagtttcatttcattctaaggcaattggaatccatttgagaattgtgagcgggagagtggtagggaccaatggccagtatgtgatgacaggtaatgtgatctatgctcctatttttaggggcaggcctccttaaagatccatttattgatttaacaatattaaatgaaagttcactatatgccatgctatagtgttctagggtttcagcagtgactatgacaggtctccagctttattgagcttacatcttattgaggagaggcagacaaaaacgaataagaaccgtgaagaaaatatagagtttatatgataaaaattaatgggatgaagtgctggaaatttcactggattggagaccactagggctacttcagtaattagttttgaggtctcctgttgttgtttctcagccctgatggtcaagaaattctttcctgttttgcttgtttccatttctgtctactgctttttattctgttgtcctcttaggtagtacacagccctttttctgaaagtcttatctctgatgaagaaaacactttttctcttcaaacagtaacttagtcttttgctttatttcctagagactctgatttcctaaagtttttcatatttgttctatgtattcattcttttcattatttttgttgctctccacataaaaatataaaaacttatcctgtaaagaagtattaatttagacatcatttagccagaatatagcagaagaattattttacagttcttataaggtacctactaatcctccctcctccctgccccctccctgtcttctcttttctcctttccttcctttctttttctcctatcccaaaatactagttaaatagtttctctcctttaaagtactttaaagataacttcttcataatgaactcttgtgtgcataagcatttcttttcctgttaagaagcagtggacaatttttttgttttaaagacattctagaagattttaaaaaattattgtggtaagaacacctaactgtgagatctatcttcttaatagatttctaagtgtacaatacagtattagtaactgtagacattatgttgtgcaggagatctccataacttattcatcttgcattactgaaattttatacctgttgattaaaactaaagatccttttcaaaaaatacttcttaagccatggcttcccctggttgtggactgtaacccttgatgttattgaccatcttgggattaagttccattaagaaagacagtgttagacattgtggagaaataatagcaaggaaatgtttgttctggtccaccaaaatattgagggaccaattttaacctccacatcgttccttctggggttttcaggataagaaaaaaggagctgtggcttgctgctatttcagtagtcaaataaatatttttaaattgcttgtttcattagtaggatgtttttctgaaaagacagagtatatacccctcaggatatttctgccaatgtgttaaagtatttgtaaaaaaaaataaaataaatggctttgtagaatgttcttgtttcccaaatggctactgattttcttaagaaaaaggtagcagcaatttgctgaaaaacaaaaatgaccttttattagtcaagagaaataagataactaatttagattgaatgtgtttatcctaccagggtccaaaatttctattttcatgtattctccttttcttataaaggctccctttggaactatctaggaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaaccgcataatcctccttcaacttgacgtcctttatgtgttttgagatggcccccatgggcttccaagtgtttctggctaaatatcctgagctcatacatgtgttcttcatacagcagcactttgaggcctctctccatgctggttaccttcctcccaagtctgagttttaatgtcctgtttaaaatgttatgaacacagctacttagaaagctgtgcagtcatctcagagtagaatcagacaaggacctccttcacacgaagtgcttcctgtgaggacctatgtaatctgctctgtcttctgctatcatttgtttcttcccttctctcctttgcatcatccactccagcgacactggtttccttgctgttcctcacacaagccaagcaccctttaacttccttttaaagccctttacccttatttcctctgccttgaactctcctccttcagaagacatggggcattctccctctctgcactcagattactattgctgtcccctcagaggggcctgcccttcccaacccattctaaacagccctcccccatcatgactaccccttgtcatgcttttattagcccttgaaattcccagacattatgttatcattccatttatttgtttattgtctgctatcattattagagtatgatctctattaagtcaaggactttgctagttcctgaatgtcttttcagtacccagaaaagggtctagcatatagaaggagcataataaatatttgtgaatgtattgactaatttactatccatgcagattatctttaggcagaggatagagaataagactttttagtacatatttaacagtgtgtgtagccatccatacagtaaagaattctgcaactcacagtcaccccaaacagcatttgagcttttagatactatagagcaacctgtgtctgtgtgtgcatagatatgtgtgtacatgtacacacttatgtatatacatacacacatacattcgtatacatgcgtgtacatttatgtatgtattatgtgtatatctctgattaaatgggtgaacatgtggtttggggacccgtgtccaagccctctagattgtagaagctggaaatgacaaaagtgaatgaagtgagggaaagtgagccagcaggactgctcactgcacatgaatttccaaggatacagttgttcttgaacaatcacagtcagtatatcaaaataagcgctttattgagtagggtaaaaggagttgctggaaagactgtaaattctctcgcagaacaaatgataactgagcccaggagcccttttgttcttgggggagggggcataaattccctgaaagtatctgtcgcagggaattgctctgcattcatcatgtccgcctcctgcatcattcatgaatgtcataagactctaaagaattggcacttcatagtgaagatgattaaatagccactatacttgtcttttctgctgcacagtgctttttaaaggaattccatttaggttgtagcatgccccttcgaatcccttcgcatttcttgcaacctgaggtctctgacatcagaggaaggcccttgcttgttgggactggacagagctggtgggctagcacttcagtttgcttattttcctttgatggagacaataggatctggaaaaaaaaatgccataaagctcaaagcaaatcattttttagggagtatagaaattgctgtttagattctgcagtgaatgagctgtaatttttttcagatattttcacttctcttatcacttccttgtggactaagaataatgaatcagaacaagacacttttatatatgatttgctattttatatattcaaatataaggcctcaagtcattttgtagccaataaagcctatgtatgcagtgtaaatactgatgtaacagagtataagatatagaatcggccaggcgcagtggctcacgcctgcaatcccagctctctgggaggccgaggcgggcggatcacctgaggtcaggagtttgagaccagcctggctaacatggtgaaaccccgtctctactaaaaactataaaaattagccgggtgtggtggcaggtgcctgtaattccagctgcttgggaggctgaggcaggagaatcacttgaacctgggaggtggaggttgcagtgagctgagattgcaccactgcactccagcctgggcaacagagggaaactccatctcaaaaaaaaaaaaaaaaaaaaaaaagatatagaatcttacttctgtcctctcccctgcatgcatttcttgtcatgtatacatattctctttctctctctccctctctccacacatactcactccctctctctctctaagtgccctagagtaattcttacttcccaaacagcatccttaagtgacagagtgcaaatgattgaattaacatttatctactcaggtatatgtagaatctaaaacagttgaactcctagaagtacatagtagaatagtggttaccagaggcctcaggttgggggttggaaggagcagatgttggtcaaagggtacaaaatttcagttaggagaaatacatttttgagatctattgcatagcatggtgactacagctaataataatggattgtaaattgcaaaattgccaagaataaatttcaaaagttctcaccacaaaaaataataagtatctgaggtgatggatgtgttaattagcttgatttacatcattccacatagtttacatatatcataacatcacattgtaccccataattatatataattatgatttgtcaattaaaaataaggccaggggcggtggctcacgtctgtaatcccagcactttggtaggccgaggtgggaggatctcttgaggtcaggagtttgagaccagcctggccaacatggcgaaaatataaaagttatctctactaaaattataaaagttagctgagcatgagggcacatgcctgtaatcccagctacttgggaggctgaggcacgagaatcacttgaacttgagagacagaggttgcagtgggccgggctcacgccactgcactccagcctgggcaacagagtgagactctgtctcaaaaaaaaaaaaattaaaattaaattaaaaatataaagttggtcaataaacaaattttcataagcacttatgttagaggcaacagaaagtatttagagagaacagcagactgtaattaggagagaggagctctgatttgtttccaccagtcatcactgtcacctcagacaaattctgtaacttcccagggcctcaggatttgcatctgcaaatgaggacacaaatggtggctccaggattctccttccactcttatgacacatggctttatgtgtcaggaggggctcagccatcaggagggaacagaaaaaaaaaaaaaaaagctcaggatatcaccactatttctgaggaactcataatttaatgatctctgcaatctctaagctctgctgggaaatgagctccagcataacacgggttctgggtctgtagtggcatcgctgactgaaagataggtcatttttaaaatagtggtatgacctttggctgtgatttcctcataataaacataatatgatttttgtgccaattttctgttaattatgggcttctcctaaaagtttatgagtttaggaagaatgttctttttaaagtagaactttggacacatgttaggagatccaattaaatagatggatcatggaaattgggtcatcactggttgttaccagtaagaggatcccttagagataatgtgttcacctgttaccatagaagtcttatgagctgtgcctgtaagttaccagtggcttcaaggcaggtagaccttttgagctttaatttgttcctagaaggaacctcttcacttctcattatccagactttccctagaagtgggagggctgatcaaaatgccagccttggccctttgcattctgctgctccagccatgtgggtctgatttgttcttactgctggtttaagagagattaaaaggagcaaagctgttctctaagtttcttgatctgcaccgtggcagccagagtcagaggaaatggagacaatgggaaagggactaaatcctagagagtgatgtgtctgggatctcgggaagcagacccagcgttcaaatgcaggcttcaaatactaggtcattgctttggagaatcttcttgcacccaaaacaacttgccacaacctatgtggcccaatgtgcagcaaaagctgagcctgagataaggacagacaggatatatggctgaataaagaactttcaatttccttttcttagtagacggacaagtatcccatcattaaaaaaaaatagccacataaaaaagcagtttccaatctaagtgcacatggggtatgccaaaatctttgcacatgattgacttaatcagaaggcccaatctaatggagagaagtactgtattaatttaaatatggcaggtgctttctaagtttattgcaagagttaaagaccaattatcttgtatttttccataaaattgcattttctaaaaagagactggtgtgtctgaatacatccatcataataaatcttcaagcttggatggaagtgactgctgtttatttgcagcatgtcatatctgtactattgaatcaatgctaaagttatcatattagaactaagatgagggcccggaaaatgagtttttatagactcacagcgtgattttgtgaataaaagcataagaccaggaccaggtgtagaaagtgccttattccagggcctgatgacctggaaggcaattttcaaatgtagggattatgcagtcacctctcacaaggtccagggtgaagaacaagtaagaaactttctattttctggggaataggcacactttcaaaggaggaagaggtattgagatgagacagagaaattgagatggaaagtgtatttgaaatatgtgtaattaggcaggagaaatgagaatcacaaaacactagcaaaagtcattgtcttgctaaaaataataaaggaagaaaaacaaagtataagctaaggctttgaaggtgataaaatattaagaaattttgcttctgtatttataggaaatcagtttttaaaagtataaactaattactaatatattacataataatgcagtgatgttgcttgtccatgataaaaggtaataaataaaaatttgtttaatgaataatgaaaaatagctttcacatttggagttgattttgattcattttgatctcttatgtggctcttggctgtagactatctttgttttaagaagagcaaacccatttgtcctaatattcctggagaattatttcattcaaaagaataaaaatatcagccaggcgtggtggctcacacctgtaatcccagaactttgggaggcagaggcaggtggaacacctgaggtcaggagtttgagaccagcctggccaacatgctgaaacagagatggtgccactgcactccagcctggacgacagaacgagactctgtctcaaaaaaataaataaataaaaataaaagtaaaaatgtcatgtatataatatagagagaggttcaaatacgctaagagaaaaagaagccaagatcatgtaagcattatgattacaaccacatgcagactatgtttttcttctggctgaaggccagagagaaaggcaagtagctgtatattcagtgggtgttatttggtcaaatcgatttacatagtcttgcaggtcttccaaatactaaatattaagtacttggaaaatagctgagcaaaatctgagtgcattctatgatgatacagtagcacagtcttgcttgggacttaaaatcatggttgtttatggtcatggagttctaaccaaacccttgaacacaaaattcagtgagctcaaaatgaaactaacactttcacattctaatctgtatttccttttctatctactattttatttgtccaaatttgaaaactctgaaccaaccccagatccttctttttttactccccaaatatcaaatagatcacaaaaggcttttattcttcatgtctttcatatctgcttcccctgatttctcatgctcactgatccaattccaattttcatctctcgtgtctggggtattgcagcagtcttcctctaaatccccatggtcacacattatcctccctccatcttctctactgcagacaaagttatttttctcaaactgtgcattttcccactgatcaatgtagtcattctccaactttttaaatactaaaatcactctttgaaaaattgatatggaactttgtttttttttttaagacagagtctcgctctgtcaccaggctggagtgcagtggcgtgatctcggctcactgcaacctctgcctcccaggttcaagcgattctgttgcctcaaccttccaagaagctgggactacaggtgcatgccaccaagcccagttaatttttgtatttttagtagagacggggtttcaccatgttggccacgatggtctcgatctcctgaccttgtgatccacctgcctaggcctcccaaagtgatgggattacaagcatgcaccaccaggcctggctacttttgtatttttagtagagacagggtttctccatgttggtcaggctggtctcgaactcccaacctcaggtgatctgcccaccttggcctcccaaagtgctgggaatacaggcatgagtcaccgtgcccagcccaatcatatattctttaacattgttgtattatttcccagcagtttgtagcttattttgttttaatgctttattttcctagtaacaaattctaaaacgatgttgaataatattgtgataatgaacatctctattttcctgattttaatggcaaaggctatataattttgccatttagtatgacaatactttgctgttgataatctctatcatatttagaacatcttaattctatcttaattaaattttagagggaatggctgctgaattttttccaatacttaaaaaaaatcctgagtaaaattatattcaaattctactttaattaggtaaagtaatgaattttgttaacagatatctttaagctgaaatacactacttttcatgtttctgaaatcatatttttcttctaatataccattgaaatgctattcaaaaaatgtttatcaatttttgtaagtgaaattaaagtgttttgtttttgtgtagcatatttattaggtattggtattaagattatgttggatttacaaatgaattggaaaatttcttagtctgtttgggccactataacaaaataccataaactgagcagttttgtaaacaacagaattttgtatttcatagttctggcggctgagaagttcaagatctaggtagattgtattggtctctggtgagaatctcttttctcttcataggcaacatcttcttctataacctcacatggtgaaaccttacatggtgatgtctgttttataagatcgtttgtccccaccatctcccaaagaccttaccctataataggaacacattgaaagttaggatttcaacataggaatttgcagggggatcataggcattgcagtccatttcatgaagatttctaaccttgcctgtagtatggtataaaatggagtaatttagaaattatctcttatcttaaaagttatgttgaaaggtagatgaaaattacctgtaaaatcacctagatctgtattttttaattattaaaacttgaatctcctttccaatggtgtctatggtcattagcctattgagtttttctactttttcttataaatctttgacaagttatactttttcctagaaatgatccattccttctgactttcaaatatattgctttaaagttgtacaaagtatgattttatatttgtaatcttttctattgtgatggttatataatttctaatgttctatttttctcctttagtttttatttctgtttttttagaggtttatatattttctttgacattttaaagagcaaactttgggatatttttaacttttatattatttcaaatattatcgggtaaatttcagcttttatttttaatcatcaaaaaccatcttatttatcttatttttgtaatagtgcattaaggtgaaagttcagtttatttatgtttattttccttattattatttgagacattttcttctgagtttctgagtaaagctttatctgaagtttatatgacttgatatataaagctgtctcttcattaatactctaattattaggttttggtcttttttactgtatattttaagattgtatgtataaagagtactgtttgttcaataacttaattatagaaatcattaaggatttctttgtcaacaagaatattatcagtttaacaaatgttccaatttgaaatatatacgaattactgaatatgcttctttggtaaaattcctgagttgcttatcacccaatcatcatggtcattctttgccaatttatttaagcacttactgtgcccctatgtgttccaggcactgtgataggtaccaggaattctttcatatccaaactcttctagttgtgaaagaacccaaatttgaactagcttagactacatgagttagctattaaaagttgtgtataagaaagacctggccaggcacagtggctcatgcttataatcccagcattttgggaggccaagacgggcggatcacttgaacccaggagtttgagaccagcctggacaacatagtgaaaccctgtctctactaaaaatacaaaaattatccgagcatagtggcgggtgcctgtaatcccagctactctggaggctgagacaggagaatctcttgaacctggaggcagaggttgctgtgagccctgatcaccccactacactccagcctgggtgacagagcgagactctgtcaaaagaaaagaaaggagaagagaggagaggagaggagaggagaggaagagaagcagaggagaggagaggataggagaggagagggacaaaggcacaacttcacaatatagattataaaaactaggtattttaaaaatgataagatttttctctctgtggccagatctaaattcaacagcttgtctttactctttcagtcaggattgattttctcatgactttctccccataagcagaaatgtggccacggcagctgtgtgtctcttatgtcacagttttatcatcagagaggcactgatggagtgtttctctggttccaggtttaaaaaaaaaaaaaaaaagttcattgaagttctctagcctagcttgggttaattgattacaccttagtccatctgctgtatataagagcagaatcttttacggacatgacaatttcagttcaaatcacatgataaatatggaggaaaataataatttctttgtgaagaggcttaatgtttcaagatagagacagaggatgtgctgcgccgatagaataatgaaagtctcctatagtcaaaaaacaaacaaataaacttgaggcagattcttcacttcaaggtgctcaccataaaatggcaatactaaactatttctagaactctatatagagtgcctgttagttattttgatcctgttacaactctttcagatgatgaggtagaagtgttgtcgccttcttaatcatggagaaactgaggctcagtgaagataaatgattgttttagaacagaagcatggactttaatagttgggatttgttcttttcatccaattctgacctgggttctatgattaagaggtatgtgtctcatagaatcaaatcatcacccttcaaaaatattagccagcttttccagaaaaatcgtgttgtatgaattaaagccacaaatacaccaaagtcatccgtttacagcccctggcctcttgtaagtatgaggatcatataaatcaggcatttaaatcaaagcactggaaataagcaactgctttttatgtgtattgtttttccagagaatattcaatacttagctaccccttcattgttcttattaaaaaaggtatttcaaggctgtgaaataaaaggaggaaaagaagacaaatgtgtatgttccaaacttctcctttcctctaatcatgtctcatgtcatcagaaggaatgcacttctgaaaaataaaatgctacagaaaaggctgctgagtaattataaaatgattacttttgtttttcctttattcatttatattttgcttatgaacaaatgtatatatggtctttgcttttagttaatgctctgtaaaatagaataacgtggctatccttaaagatgtcacgttgcttttctgttgtacatccctgttaggttaaatctgagatgcacttatctatttatttttacaaaaacaatttgcaatgtgatttagaaatggaggagtaacataaaacaatttgactaaaaatgggtgtgattttcttatctgagactgccaaaaattcaccaaagaaaaatcattcaaatgtctttgtggttaggtttcttttataaattgaaagttgtgttctatttcatcatgagagatgctgtgagctctaactgatgagcatttataaaatatttccacgttgagatgaaatgacaaaaaggcaagatgaattaatgaacattgtatattcttattcctttattcccattctactccatgcctgaatggcaacgtgaagatatgtaagcataggtaagccaggtttcattgattagttcaacagcatttatttcctgtgcattcacagtgttgagagataaataaattaaacagccctggcttccaggagctcgtagtagagaagcattctggatttccattttgtttgacaataaaacttaatatttattttcttaagcctgaatactgtgcaatttcctagaacttattttgttttgctatataagaaactagcatggttatgaaagttaagttggctgtgagttaatttctcacatagacctcattataaatttacccttcagaatttagagttgtctgagtgtggtataattaatcaggaatggactattatctgaccttactttattcactttataagaggacaacctcatgtaaaaccactgtcatttaagtaagataaaatgagtacctctatactgccagttgcattgtgaaaggattgggttttcatcttgtttgctgtttttgttttgtttttaattttggccacatattagaaagccattgtccttctttccatcatcatcaggtaaatggtgagaatattagagatacagtttgacataatgaaaagaatgtagattgttgagttagacctggattaaagtcctaattccattcgatatttggtaaaagatcttggcaagtagttttaccttattctatagcttccctcatctttaaaaccaagatagtaactgttatgagctgaattatgtcccctctacaaattcagatattaaagtcataaccctcagtatctcagaatgtgactgcatttgaagatagggttttctgaatgtggtgtaattcatcgggagtgggctatttctgaccttgctttatttttcagtttcagaggttattttggtgggccctcatccaataagactgatgctcttataagaaaaggaaattagggcatagattggtacaaagggaaaaccatgggaagatacagggagaagatgattgtctacaagccaatagagaagctgtagaaaaagccagcactgctaacactttgatcttgaaattctagcctccagaattgcaagacaatgaatttctgttgttaaagttacccagcctgtggtacattttacacagccctagcaaactaacacagcaaaaaatatttcaagtgaaaaatatagagttttgaaatattatactgtatactaagatatataataaataatatatacacatagctggtattagtattaatattgatattaacattagtctagagttagtattgccaaacagtaccaaagagtttgtgaaagaaataattgtcccaaaggaaaaacaatgagcttatgaaaattcctttaagcaagagggaatttgagtgtgtccgtggaagctttatttttaggtcaattttagcgtctacagcattgcgtattctaccactaatcatctttttccttagcggaagtatcctgaaatttgatgagtaaaaatgactttcttttatatttttgtgatataacagcttctaaagtaatgtgtttctgaaaatgtcattacccctaagacttacttacaaagggtcatgatgtgtttgtcaaaactcatcagtgtgtccagaaactatgtgcgtgtgtattttagtcaaactttctgggagttaaagtatatataaggtaacacagcaatggaacatcgcaatagttggcatcagatttgcaaatggcacaattatttgtttcctcttcactggtccttgaaaaatacataatgttcccatcaaaagttccagccaagcatatttgtaagaacagggtttgaacataacctattatatcatgaagaatggctctcttccatggtatttaccaccagaattaagtagtggtagacttttttttattcatggaaaacatttagtgaatgggtagaatgttatttgttttatatttttctctcatcagctcctttggagactttggcatcgggcagaaaaagggtctcactctgcacaccaatttgagttcccatgttatcaaacagatttaatgctaaactaaactggtgtttgttctgcttataagtctttgagttgaagccttgtttctggaatattgggacatgctctgaaatgttgcctctgtagatcctagaaagtaatgatgttttctgctttcatgcgatttagttttaattattcttccttcaacagagagaaatagattgccccacagggagggaaccctcaccttgcttgagcattgtctaagaaatggctttttctcatgatgtacttaactgttaggcaatgttgtcagtttctcagcttactgagcagcaaatctgctcatttctttgccaaggaaaaagaatgttcttaaaaatagatgaactttctctcttaatgttcagtgcattcaatgttgctttatttaaggctgctttatcatcagttctggtgtttatttcaaaaaattcaaagtagataaaacagatcattcactaaattccatctattcaataaataatttgcagagctgtttttaaaatgtgtatcatttaccctgtactccctagtggctccctctgtaatgcagaggccttgtttgcagtttttccatctgttattcacctttctcccctccttttggagctcttgatctctagggatgtttttagggagtctttatcccattagtcattgggacagctttggagaagagggcatagttaagaaagggaggatctgattctattctcaactccactacttagcaacagatcaagttgtttaatctccttgagcatcaattttcttttttattaaaatagtaaccaaaatatttgccattaatatttcagtgagtgttgagggaagaggcatcagatgagacactccaaaagaaagcaatttgaaaatcatttaattctatggcaatataaggcccagctgttataaaatagtgaacattattcactcctaaaacagccagagagatgagcggcagaggaaaaccatagaacaaactaagtaaaagaaattgagaaaatgtattctttggaaaatcagatattacgagatccttcagttaaatttatgtctctatttgctagaagagatatttatcagttccaaagcaacaagcctttcccttttggttttattagctacatggtaattgatatgaatttaaaagataggtttaatttgatagcaataactacatctactggcaggatatattttatgtcattgatagtccttttattttccaaaaggatttaccagtttatagtaaaaaaacacgaatgtggataagcttgtgaaagagtaataaaaaagaaataaagaataagaaacctgaaatgatagaggaagaccaacataccttaccattatgagattttatactaagtcctgaggcaatgatcaaagagaactagagcaggagactgacatcttgtttctcatcctagtttatctatcatgtactttgcacataattgttatacttattttattacttaatttattgttctacttgttataattgtccacaagtaaattatccagttctccttaaatttaactctcagaggccgggtgtggtggctcatgcctgtaatcccagcactttgggaggctgaggtgggtggatcacctgaggtcaggagttcgagaccagcctgaccaacatggtgaaaccccgtctctactaaaaatacaaaattagccaggtgtggtggtgcatgcctgtaatcccagctacttgggaggctgagagaggagaatcgcttgaacccaggaggcagagtttacagtgagccaagatcatgccattgcactccagcctgggtgacaagagcaaaactccatctcaaaaaaaataaataaataagtaaaataataaatttaactctcagatttcccctgggagatgcttccaaaacttgttccattttaacatcaatagaattatttgagggaaggctattttgatatatatatatacacacatatatgtatatatatatataaaaaaatacatgaatgagaaaaaattatattcctcattctcttaaagaaacgatagatcactcacttaattagctatatatatatatacacacacatacatatattcacatatatatatacacacacacacaaccaatattgtattattgtattttagtacttttattaagccattttacctgtaattatttgatggggtaaataataaatgaattctagtctattgtattttttaactgaaccttttttgtttttcacacacatgcatgcacacacacatagacaaatatatatatgcttatgtatatgtatatgtgcatacacaatgaatgtatatgtatatgtacatacacatatgtatgtatatgtatatgtacatacacatatgtatgtatatattatttgtatatctaaagtgaatcttaagacaagaattctatttctgttgatagtctcccagaaaaagtaatatgctatttggctataagactggaaatagaacccatgccataaaggcagggccagggggtttctaagtcaaaacaacaacaacaataaaataattacctaagtgatcctaaataaagaaaaagtaaattgccatcaacaattatattctaatacaataagcaataaaatgcacccaaaatttaagaaccttggagaaatatgtggatgagaaaaaattatattcctcattctcttgaagaaactataggtcacccacttaattagcttgttccgtaactttcacccaggactcctttatgatcgcatggaagactgtttgatccttttcttctgctggatcaccatcccaagcacacactcacagaacacataccaaaacactctgtcaatatcaccatcagctccatcacagtaagtagttagccaattatgaaaacaataagccaggcccattatttgcaggttgtgagttaaaaaaaaaagagtcatccttgttgactatttgaagatgagatgtatcctcttaatctttgttagtggtgactgtgtagagatttcattcctggaatactgtgttggttaaaactcagcaaagcaacctcagctgcttgcaaacttgcaaatcctgcagtgttaaatggccaaaatgctactatagcaattttttcttcagttgaattggtcagtttttgccaacaaggatgaaatttacatgattctgaatataaacataagtagtatgatcttgcatcagcatactgaacacggtgagaaaccagcaatcagaagtacgaggctcaggggagaaagcatgtaatgtggtatagcatgcctcagaaatgaaaatctttgatgaattaagaggaggttcttatagttcccaggattttcccaagaagttgatttgtaatccacattttaaagtaacacaattaacttttttatttgaatatgtaaaacaaaataattctatgtttcctgtaggactctaggcattttatattaaaattaacacgaagtatgtatttacctttaaaaaccatgcaagatggcaaagcatgaaatgtaaagagaaaaaacaataacaacatcagagtagaaagttataattgttaattaccttcctctaatgtcccacagtattggactatgggagcattcagggcctttattcactcttaccagcaaatactttaccaagaatagatattttcatatttttttcttcatagcaaagtaatcatatgccaggtactttgtatcttttatgctttcttcacctataaagttagaatcatctaacatagtgacatcataaattcagaataacaaaagcaatacaaataattttaaatcaaatttttagtctatcctatcaaatattgtcatagtgaagttttgttttttgtttatttaaagattaaagccactgtgactttctaaccatatataagaaattatatatttatgtattaaaatattcttctcctttgtattggagcactgagaattactggtaggattgtggatgaaaactacaagtaaaatgcttaaagttgttgatatggtgagatggccagacaagcttttgaaaacatgccaaatttgggggctgtgactttgttttcattctgctttagtctgataaaaagatgtgaaaagaactaagtacagacaactgtttgccccattggtgtagtttattgatacagtttattgtgtaattacattggtatgtggtgaaaaaaggctttcagaggtagaaggctcaggctggagacttgaaagtggtactatttaaatcagataattgagtctctgtttccaaatctgtaaaacagtgttaagatataaaatatcccatacaattgttgcaaagattcagcaaatgaatttgaaaatattttgcaaactgtaaagcagcatgtatatgctgctatcaattttttgacttgttatttttgtagtgacaaaattatttcctgatagagtatgaatttatctctgtagcagaatccactatatatttaggatagaaaagtaaaagatttttataaattgccatgaaatgtcacaggctgatttgcattttctggtgattctatacattaatcactgagtaaccttcagttttccaaataaagaataaagagagtggtgatgacatttgtaaccatctacagaggaattatttaaattcttcacagatggagcgatatcaagggtaaatcattatagccacatttctaattttaagaagctttgagggtgtttgtggatggtaggaagtaaacattgttttgcatatagaattaatcatagactttgcataccacaattccaaatcctccagatgagtgtagagggctttcgagacaccatcccctaaggatcgagaaattcataaaaggaaaataatgttatgctacatgtaatatacaaattgagcaaattggagcaactagaatagtgacctttcaaagaagacaaattagattctgtatgcctcagaatttaatgagtcttagtgctttaggaaggatgacatatgacacatattcttaattctagtctcacaagagttaactttattatttctcaacaagatgaataactcacttcttctttggtcaacataattctacctaatattctctgtaaactagctctggaaatacatgcggaccagtgcttgagatttttagtaaatgtaaaaggtatctgaatggttgtataatgctgctttaaaagagttttaagggttggaacatggtcactgagaaatacacaagaaaatctgttaccaaatgtgctctgaattttgagatgagtaacccgtggaagtattcgctatgggtaacaccacttgcctaaaaccacagaggcaacaaatggcatagcctttctggtcaccaaatctaaatgattttctccaactgaaattaaaaatgtgtttcttgaaatgtactttttataatttctgaattacaaatattttctttatttttattcccatttgctttgtaagtagttctaaattaatatattcttagtaactcctgagttcatatggataatagtaaaaacacaagtaaagagtaaacatactggtaaacccactaatcataattgacaactaccacttgtcatgttcaaatctcattatcctgtgatgttttttctgtttcttgtatcttcttcctaagatttagtttgaaaaaggaaaagaaaatgtatttaatgccagataaataccaccactagggaacaaaaaaaaggtccatttttaaaggactcctggaggccaggtacggtggctcacgcctgtaatctcagcactttgggtggccaaggcagtcagatcacaaggtcaggagattgagaccattctggctaacatggtgaaactccgtctctactaaaaatacaaaaaaattagccgggcgtggtggcacgtgcctgtagtcccagctactcgggaagctaaggcaggagaattgcttgaacccaggaggcaaagggtgcagtgagccgaggttgcgccactgcactccagcctgggcaacagagagagactccatctcagaaagaaaaaaaaactcctagaaatcatttttgttaccatgtttatagcaacacaatagtgaaataggcaaatgcatttagtcacataacttggttttcttgggccactgctttctttcctgtgggagtgggagaaggtacaagcaggagagacatgatgcctttggactgctctgttaccttcagttttgtaaggctcctggctccactgaccagattatgctgatagataagagataggggactagttttctaccttgtgcctgtcctggccaagatgcaaaattaagcctactgttgaggaagaccagaaagttgtttattgcaatgtacccaggctcccagacttaggatgttatttaccctccaccgttatgcagcgggaacttaagatgttaagaacgactcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatgtctccctctctccttgcttttgcagctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagtgagtacagggccttggcctggattttcttatgttactggtggtctgagttagtgattcaggtagacgcagcagaacattctagatcaatatggcaaaggtgcacatgcttataaaaattgttttcagatgtgaaccatcatatttacagggttcctgggggaaaaaaacttaaaaactcttccttcttccccatgtatatagggaggaaaaagaaattcattctttgcaggctcccttcccaactgtgtggcttggcctgtggcagaatatttagcagacttctagggtatatttaagagatttacctggtgtggatcttacctggtgcaagcagcaaagccaagtggaatgttaacaatctcctaggctgggatttggcaaaccttctgtaaagagacgtatagtaaatattttggactttgcaggtcagatagtctctctcagagctactcagttctgcctttgtaatgtgaaggcagccacagacaatacatttttttgaaatgcatgagactgtattccaataaaaatgcatctataaaaacaagctgcaggccgtaatttagtgacccctgtcctaggcttcaagcatcactgtaagagatgtaataaatgtgtgataaaaactgagaccagagtgccagagtgggcggggcaaaagggaaacagaacagtgatcaagagttgagtaattcatgtgtattgcatactcaacattttgcttttggtcttgtacatatgcacttaatagcactgcacccttaatccctgtagatcataagaacacagcaaaggctaagaaattaaaaatgatttagaagaaaaaattcttttgttataaggatggaaaatatttttacagcaacaattaacccattttatcacctgtgcagtctgcagttaagaaagtaggctaaagagagatatgattctcatccataagtacccaaagtgcagtctccaagagcaaagagaggaattgttctcattagttagcaatgacaaggctagaaagaatggatttaatttggagcaataagaatttagtttaaatagcaggaggaaaaggcagttaagaaaaaagatcaactggggattactaccaacctccaaaaaggaggaaaaggaacattgattaggaatctctgaatcagagttttgctaatgtgcaggtgtatagagagaagcagaggatacaatttcattgctggtctctggagttggagatggctggccggaatcatgcatgacaagcccagctcccacagcagtgcgcatgtctgacacttgctcttccagcatgccttggaaatgagagcagcttaaagtcctaggcttgagctggaagtcggtctagccccagtataagccagatcagggcaagactctgcttaggagcttaaggaagaactggttagagatgatcaccttcaaaatgtggtggaggagtcttgaatagagttgtgaacttttcaattttttctcagatgcttcaggaaccatatggtgctatgagcctgagctaacacattttaaaaagctatgccaaggagcaaaaagaaaggcagccatacttactacactttatctttatttggcctctaagaaccaccataatttacaaaactctgtgagatttatgctacatataacttaatgactatttcatggcagctataactaggctgttattaccagctcacttgcatttccacagtgatttatcttctttttttgttcattgtgactgcctaagaaaaatatgatttggcacagacatgagcatctttttgagtcaaatagtgtactattgttttatccattcctgctcattcatgttttgtagaacatctccacttttaagagagaggttttcctattttctgatggtttacttgaaattagcagtgttttaataaaattgtcatgcagattgtggtaacttctaggaggaaccagaacattccagtatattttaatataccattataaagctctgtcatttctttggggtctttgaaaagtgaatactctaaacatactttgagattcaggtaacatccattgtgtgcatttattagtgtgtgtattctgtataagcatacccattagatttgacatagtataatattattttctttgtatgagcaaaattaccagacattttatatcaaaatgtaaagagccccctgggatactgtagacacttgggtgatacagccgattgcttaaacgttctgtgaaagcccagtagattttcctccaaatcttagattaggaaatgatgtcacctgaccctttcagaaaaaaggaaaaaaggatcctatgctgtggggaatctgtgtgattctagagtgaccctgacatgttcatggccctctcgagcaccaggccccttcatgggtctagtcatttgaagccatattttatttccttgcagattatctctttgtctactctgaagaaggcaggtttctcatcatacttgaaagtaaagaaatctaagtagaagactaaatggcttaattatgaaaccagctttttgttttggacatttaagtagatacatcagggaaacaaagccataaatacttattaagatacttttataacttttacaatctgtaaaaggtggttctgtttgttgaatggtttgttttcttgtactaaagaaaattactgaagagagaaagagctttggggccattaatgaaagtggaagggattgagcataaggcagaagatgctatttctccttacagtttgcctagaagagaaacctcctgggaaaaagaaaaagtgatagaagacacaagggggagatgaaggcaggtggttttctcagtttttttactgctataacagaatatttgagatttggtaatttataaggaacataaattaatttctcacagttctggaggctgggaagtctaagatcaaggtactggcaggtctggtgtcttgtgagggcccagtcttcacctctaaggcgagcactgcatcctcaggaggggaggaaccccatgttttcacatggcagaagggcagaaagagtgaacccactcttgcaagccctttttaggatagcattaggcagagccctcatgacctaagcgctttccaaaggtcatacctcccaacactgtggcatcggtgatcaagtttccagcacatggaattttgggagacatattcagagcatagcagcagaatatatttgcagcagaatatattccagggataagggaagaggacagggctctgcctaccgatgtgcttcaacaagggattacatgggggcaaagcttcattctttgaatatgagtgttctttataaaataacaacaacaataaaaacctaaagtactttggtgctacttgtgagtggtggtcaggctagtaaagttggtcaaaaacaaagtacaaactccaaaattagccagcggtgtatatgtgtgtgtgtgtgagagagagagagaaagagagagagagagtgtgtgtgtgtgtgtgtgagagagagagagagagagaaagagagagagagtgtgtgtgtgtgtgtgtgtgtgtgtgtgtgtgtgtgtgtgtgtgttggggagaaggagaagagacaaagaaagtttgtatttttttaactttcaaagaagacaattcctagaaattcctgaagtgttttgagcaacatcaacattgtcgttggaatatttcctttttacccccaagtggacttatttgaaggaagagaaaatgctcttccaagaacactagagagcctgaccctggggtaagcacccactctagaatagccccagggcaggagtggcaaataggcttcatcttgcctgaaaattctcagtgcctcactctctctcttcaagctttacaccaggaagatttatgagaacagcgggcaaatccacaggtaggagatctagcttccattagtcatgtctgccacatgtgccgatgtgaggttttgtgaacgtgcactacacattcatcacatctgctttaagctccacagtattcctccacacgtgctccaattttcccatttcttttcctttgttatcctgaaatccctatgtattaaaatttctttggaaaagcagtatcttaagctcatgttgcactgcaagtcctggaatgatttatcaattcatctgaagtagtcaatcttattgccatccttctcataccagcctaaagtcagctcctgtgacagaatttaagttttgataggagagttggacagaaaggaagaaaagtggccatggctagtttggggatgtgcaatgttgtgtgggatggtagaaatgagtgggaaaacttgggcaaaatgaaggcatttgtgtcctagattgagtaactggggcaaatgaagaaagggtcaccaagacagttgagtgctatgagcacttttcttcttttatgtatgtattttaagttcaggggtacaagtgcaggtttgtaggcttgttacataggtaaactcgtgtcatgggggtttgttgtacagattatttcatcgcccaggtattaagcttaatatccattagttatttttcttgatcctctccctcctcccaccctccaccctcccaaaggcccagtgtgtgttgttctcctctatgtgtccatgtgttctcatcatttagcttccacttataagggagaacatgcagtatttggttttctgttcctgtgttactttgctaaagatgatggcctccagctccatccatgtccctgcaaagaacatgatttcattcttttttatggctgaagagcacattttttctatttcatgatttgctcagattgtctttcattctggccaagggagcagaggctcttatttctcttgctactttcttttaaacctaaagtcttcccactcatctgggccttataaaagttaaataggttttgacaaaaagtgttgaacaacacaggcctttggtcattttaaaaaatcagagagggccaggagataaaaatgatttagaaattgcttgcttcaaattaactaacatttctttgtttttggttcacattccatgatgcaatattttctgaatgaattataaactgttatattaataaaattttgaattaagcatgtttgaaaaaggcaaagagatctttattgaagtatatgtgcatgaaatgagattctgtagagcgagggtgtcttagggtagaggaattttttaaaatctatttcaaatgttagtttccttccattgaaatcgattgttgaggaattaaagctcaattttggagaaaagctgctatcgcttgcgagtgacatctgcctattgaccccacatctaggctttaaggagcggtgtcatgttacactcaccttcatttatacaacagggaaaaaaaactgaataggactagagaagagattggcatgaagtgcttgttattactatcatgaaactcttgtcaacctctttcaccatctgcaaaatagaaggtcggggagaactgggcaataattagcttccctttatgtagttaatgctgagtgtaaaaaagacatcctattaatttctttctctctgtatgtaatttacagtaaatcctcttggattcattttttaattatgagcctttcaggaacagtgaaaatttatgtgttaagatatctgttttgtttgacaagaatctataaccttccccaactatttccttcctgacttaaaatgtagattgttacatacacgaggatgaggggcagacaaagaactgctgtccagactgacccccatttcacggtggcaaagtgttctccttccaaaaactggaactttgaaaacagattgataatattctatcagtgtcatatttggggaaactggatatttattaagtttcacttgtatattattgtttttacatagtttatagcacccaacgagagtcctgtagaataaatggaagtaaagctgaatgatgatgaatggtctgttcctcccatctattgcatttataaattgccagcctggatgcttcatttgggctgtctctatgtgggatatttacagtaaacgatcagcatctgctgggatagtccttagtaaggttaggtggctgttagcttagattcatctctgggtttggccagtgacagaattggatttgagtcaagaactgtatttggggaactttccagtggagtacagaagaatgttggtgtttttgagactggtaacgcaaataaaaaaggaacgaacaagaaaacaacagaggtatccaacagatgcaatttcgtttcccatggagtgctgtgcactgcaggttgactccgtatttccttccatcgctatttgttcttagtgaaaaagacctctttgggatttctgagcttaggagtttttccagatcattagccacttatacggagaggacctgctgggcattgtctctccagctttcagcttagccatgctatcccagcagagtcggagaagaaggtgggagaagggagtagaagtgatgattggatgaagtgactgcttatgtaacctggactagaggcagctctctgcaggggagctggtgtgtgttttctcagatctctattattcccatgatatttctatctaaatctgtttactttgattccacacatggttttgagaggcagcaagccatagtagaaagatgtgcttaatttgaaaccaaaaaaaagttggatttgagttccatttttcaatccatttctgtcagtgagctatgtgactttcagcaagtcattctactacttggagcttcagcttcctcttcttataaatgggcataaaatattatgttgcagggttttctcaaagatcaagtgaaataaaatatttagaagctgttcattatcagcaaaacactgcactaatggagaatggtggttttcctaataaaatgggtgctgtagaggtgatgactgcattagagaaacatatatagaaggaaagttttagtttaattgtttgtataagtctgcttggactttttaggcaaaattttttaatttctgtttcatctgatcaaatgtcaattttatgaattaaccagattcacaatgaagacttttggagcatctctttagcataaagtgaagaagcagttacctctgagggaatttaggtcatgaccttggttaggtcaataggataagtgaccctatagcctccttggtgtctcattatatagcgttgtgtctctatccctgttacaagatgataatgcattgcgcttctattctctttagtataagcttccaaagggctctagactcagcagtgaaattgtcgcctgccttgccctgaagtttattctttaattttatcgaccatgggaaatgggaatatgccactttgcatgaaaacagggaaagaagagaagaaggaagagagggaaagaggaggaggaaggaggaggagaataaggaaaataaaagagcaagaagaagatgacaatagccatgaccatcaccaccaccaatagaagtagtagcagtaggaaagcaaaacctttctagataggcctagtatcaaaatggttttagactctccttgggtaccagataaagtcacaaagagcttggtcgtatactcggggatagagcccccacaaaatgttgctagaaccaaagtcctaatggaggtacagccagactgtggggagctaagtaggtcttgccaccaagtacactggaaacctaaaaccagaaatataaacagaaatacttcatagatttggattccccaaaatatgaaggaaaagtgaattataaatttactatgcaaatgaaatgtacaataatgcaatcataaaaatcaagctgacaaagtgtgtggaaaataggttatggctgataggaaattatgagaaggaaaggccaaatggctatatctttctcatttatggttcatacaagagcccttagactgttagttaatgacagttatgtttcagaatcctcaatgcatacaaataagaattttgaaaaactaagatgaagagaatttagctcctgagcatcattcattttatatatatataaattgagtttttattatgtgtcaggaaaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaagatttttcttcaactaactcattttaactcaaaaacttgttatattttattttcctaagcaatgaataaactttaatcaggcctctgaaatttgaaatgaagcaatataaaattctaaggagctgggatattactgatttaaagacagctgggtggcacatatactgggttattgcagttatcaagctagctgaataagttctgaatagcagaagctttttagatatatgaatctaaaatgcaacaagcaaggcaaactctaagtgccatcacgtgaatgctggggctcacaggacttaatggcaagcctcccttaacaccatcagttggatgaattatctcattgacccaccgcttacactgctccttgtcattactcctggggtattgttcagtgcaacagggcaagaaataactcattgactccctgaagctatagatgatggattttagatccctagctgtattcagaaggcataggagctcagtgtattgatgggggaattcattagccacccactccacagaatcagtttcttagatcctggtgctgtcactgctgctgttgcaacttgttagtgtttcagggacagacgtcagagggaactgtataactacattagcctcacagatagtaccgacagccagacctgtcatttcctggcctgcgatgacacctctggagcctagaatcacttaaagatatttagataggccctgttgatacgaccaagctaaccttcatcctgaaatcaattcatactcaggatgacaggaaatgagttgtcattaaggctcatattctatttttgagtccttagttaacctcttataattcagtttatttttcctcctccatttctgtaaaatggcaggtaatttaatgacatagattattacttcctacatttactcgggagcatgtgtttcagagaccatcttacattgataccattactatcactttccgctaatattgattgacaaaataccaggtaccagacactgtgcaagaactttgtttacactgtcttataatgagctcatgaccactcagtgaggtagtcactattaatatcctcattttataattggggcaactaaagtttgaagaagctaaagcattttcccaagatagcactactaataaacagctgaatgggctttcaaatgcaattctgacccttaattactattacacccctaatgaaagttttagagtagaaagcatagtggtaataattttaactcaattcatacttatgaaacagcaatttacttgggattgttggagatgtgaagaaagttaatatctagccggggggtagaggggaatgaaaatcatatgtacgaatctttttaaaaacagaatcagctatataccaaagaaggtaaaaatactgctggttgctgagatttttttttttaatgtacatagatgggatgggacagattttgactagtggaatctgaagaaagagcatacctgatgaagataccagcatgagtgtcatatcaaaggaaatacaggatgtgttctcaaattcatgaattcaattggaccgtaatgaatggcataagaaaagaggcaggtaatatggattagcacaaagaacatatgatttaggggcaattggtctctgattcaaggtctagttctgcctccaactagttctgtagcctcggatgaattatttgactactccgtaaaatgcagatggcaataatgccaatttgtagctctgtgaatatttataacctatggaaaaatgcccagtgaattatctggtacatagtggatgttccattaatgatagccatgttcttgtgttttcttcccaggtactttagggacatagtgtagaagatttgagttttataccaatgatcgattgtttctgaaagcaaaaggaagacatttaaagatttttttagaagaagatgaaatgcccagcacttaatttttagggagattattttggctctgttaaaagaatgttgttcagtgggttcaaggaaaacagcagggtcttgagtaagtgtttctagagaaacgtctttaaagacttattctatgatgatgcatataggaaggtaatgaggataaaaccaaagaacagttcagagattgaatcggcaggtgttgtcagcaggttggattaaaaaggagagaactgagaaatgtctagattgggaaggttgtgatttcattaccaaaaacaaaacaggggacagataagtaaaacagataagagtttgactttagtgatgcaaaacataaggcatccaagagccaggctattgaaatttccaattggaaatacatgatgaactcagaggagagataagggctagaggtgggggcctagagaattcacagcttggcagtgacagtggaaggtttaaggagtgctaatgtctcaagggagatgaataggaacttgggaaatatatacatatttttatatatttaaatatatattattttatatatttatacaaatatatataatgtatattaaatatatacatatacaagataaaggaggaaaggaagagaactaaaaaggaaaggctagagggtaggggataacctagatagtgaagttttacagaaatcaaaacaaatgagagacttccaaacacaagttgttccagagctgttttttctatacctgttaggcctctttcatctgaaatcagtttacagagatgtcttcttcatctttattggtatttattatggtgtaatctttgccacttcagtcctcttaccagtattctgcatttcttctctgtcacgggcatcattaactttgagccagaggacccagcatctactcctagagagctgccaccaattagcagttaccctatgtaaatggtagaggtgtagctactattctgccaccctcgtaatattgtgggaaaaatccaatgacagaatgcaagtgagcatgccgtgtcatcattgaaaagtcctacaaaataaataaagtcgtttttatatcaatattggtatacctaccactcagcacagctcttggtacctaaggagatggtgattggagacctggaaatgaagaccaaagagatgctgagatggttgtagtttccaataggaagattagcaaccaggcaagtggcagatcagagcccaaatgtgagtggctcaactgctggaccctgtaagctgttgtggttctcaaatgatgtccttatcttgttcatctctcagctcttggcacctcaccttttggagcttcagtttggaaagggcaattcggatttaaatcatactgcagtttcctaaatagaacaaatcccctgatcctagtgatcatgtgcaatgaggcatggaatctgattacccttatcattatcttagcttggatagctacaaacgttactaaatggttatgaaattatctagccctttattaagtgcaaaaggtagtacttaggttactaaacttttttgaaaataattccgctggctgacttttcatggctaaaaacccatattcttatctgtggagtgtatctttttgtaatcacatctgtgtttgctgtttttttaattgtccaggcagtatgttagccattttgtgtctatcagcccatttggtcctgacaacactgttaaactagtggcattacctctattttatgaagtaaaaaattaagcctaagaggattaagtaaccatttgttaaaggtgttaaggaaagaaaagaggacttagacttaatcattgatatgtttgttttcagtgtcatagatatagatatatactgcttttcataattttctattcaatataatataatatatatgtaatatatgttggatgtgttgaatttagcaggacctgtaatatttatttaaatccacagttaagaatgataaacaggactagagaatggaacacagaattttggctaaagcagcatacataacttaaaataagtcactttctttttggattcaaagaaactcattttacattacattttttgcttcccagtatttgtttttctcaatgacgttaaggcacctaattacccccaagccactttcttaaatactcctatgcaaaatgaaaagattggcctggagactaatctgaggttttgaatgcagtgcggtagaataagtgttttagaggtaactttagttcccaaatctcaataaaaacacttccaaatttagtgtatcaaagaaaagattattggataatgcattctcatctttcggtgtatgataaatgccatatcagaagtcctcaaatactcttgattaaaaacgctaaatgatctcaaataacacaaaaacccatttattcctactggagtcagtatttaattttctatatttgtaatttaaatccagatgtgggtgtcttcacagcgaccatggcctgtcatcccttggtctgttagcttctaatgtctagcagcagagtatagtaaatacttgaaaggtagaccttcacactgaaaatcacatttattgaagtgggagcagattccatttaaattgtcccttacctgatgcctaattcctaaggttaacaggttttcatgtttgctacttatatcagcagtactggagctggtttttttgcatggctaaacagcaaagcttaaattcaatactagagcgtgaaagaggaaaatgagttttggtgtgacgtgtgaatgacgtggttttcctaaataccatgaatgcacaatgaatgatccacaaagcacagccgcctcttaaaagaagacaaaaatctccctgaggtttagttgagaaaagatacaggagcatatagcaaaaactacaacatgatacacttacgtaagatgcaggtgggaagaatagaatttccaaattaaaattagccaggccagcagaaatgagtaacctaatgttatggcttggatccgtgtccccatccaaatgtcctgttcaattgtaatccccagtattggaggtgggccttggagggaggtggttggatcatgggagtggtttttaatggtttagcaccgtccccctagtgctgtccttgtgatagagttctcataagatctggttgtgtaaaagtgtgtagcaccttcccctctctcttcctcttgctccagacatgtaagatgtgctagcttcccctttgcctcctgccatgattgtaagtttcctgaggcctccccagccatgcttcctatataccctatggaaccatgagccaattaaaccccttttcttataaattacccactctcaggtatttctttatatcaatgccagaaaggactaatacacttactttcgtgaaaacaacttttctcttaaccacctcctactgtctgtcaagtgtagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagttaacaggcagggaggatctccttcaaacttttgttttcatctttgtatttttctttctttgccaaatttccactttaatctctttcattctaatatgctcacgagtcacttaatgaggaggatatgttctgggaaatgccctgccaggcaatcttattgttgtgtgaacatcatagagtgtacttacacaaacctagatgttatagcctactacactcctagctatatggtatagcctattgcatccaggctataaacctgcacagcgtgttcctgtgacgaatactgtaggcaattgtaatgcagtggtatgtgtgtagctaaacatgtctaaataaaaaagcacagtaaaaatgcagtattgtaattttatgggaatgtaacaacccagtgggttctgtttgtccactgcccagatggagccaatttatcaagacaggtgaattgcagtagagaaagagtttaatacatgtagagctggctaaatgggagaccaaagtttgattatcactcaaatcagtctccttgaaaatttggaggctagggtttttccaagacagctcggcaggtaggggtctgggggatgggtgctgctgattggttagggatgcaattatgggatctggaaaatggtccttatgcactgagtctgcttctgggtgggggccacaggactggttgagtcaagagttgtgggcccaggtgggggacatctgattgtcagaagtgcaaaagcctgaaatgacatctcaaaaaggccaatcttagctgctacaattagggatgttcattataggagtaagtgggaaagttgcaaatcttgtgacctccggaataatggttggtaattatttaactctgcctgcatcttagcataattcaggtgtctctcatcctcttaacctggtggctttcattagttttacaaagcagtttagtttttgtgaatggttattatcatttaaactctaaactaaatttctcccaaagttagcttggcccatgcccaggaatgaccaaggtcaaagaagtttggaggttagggcaagatggaattggttagatcaggtctctttcactgtcataattttctcactgttatatattttgcaacagcagtttcaggaccaccttcacatactcagtctatcattaaccaaaatgtcactgtgttgctcatgactgtaatcaaaaaagcacagagagctctctcgctatctggttctatttctaccaccctgacaaccactatagtttgttttcaacaccaaaagaaaataacaaaaaaatagcatcttcaccctcgattctagtttcttttttcttgaaatgactatggccatttctattatttcattttgaaattgtgcagaattccttctgaacatccatctacatttcacagacaacaaattgctaaaaacacctaaacaccactaacctgggggggagaaaaaaaaacaaccaaaaacaaccaaacaaaccaaagaaaacaaatcaaccaaatgaaaacccaccctctctggtggaaagactgcaccatttttggtaaagactttgcaatcctgcctagactggatgactgcctattgccctaacactttccttcctacccccagttatttacaagatcaccccttatggtaacagtattagtacaaatgaggtttttccctttacttaactgaatgctagaagaaacagaatggaaccacatgttccctttgattcacacccaaacactgcaaaacacagagtattcgcttcctttttcaagctgtgtgtgcacattaaacacatgcaaacattggactgaaacagacacagtaagtcagctctaggggaaaactatagaagtctttttattttgtttctctaaatctcaatcttttatttaagctaggtctttgcagagattcaaagaatgatattttgtaatggttctccaaagagcagttagatgtgtctcatccaaatttgtgtatttaccttatcatcacagatactgttctggaactgggaacttagcattagctctcttcttagaaatgactattaatttttgataaaaagaataaaaaacaccacattacataatggatataagagaacatagacggcatgataggaatattctgcctgtgtttccatgaattgcttctttgttaaaaagtgtttggtataaattaggccagtggtgtcccagcactttgggaggccaaggcaggaggattgcttgaggtgaggtgtttggtataaacagtatattaacaaagaattctcctatggtataaaccctaactctagcaggaagatcaaatttctctttgaggcatgcagtctgagctccagtgactctctgcaagagaaaagctgatattgtcacattgtgagtcatagtgactcccaaggatgtatttgtgtggatgtggttggtcagaaggctttgtgtgcactgtgacatctttatgctgcagatgccaagatcacagggtccacacagagcagttcatttcacacagtgggaaatgatgcgtgtgtgtgtgtgggtgggtgtgtgtgtgtgttttaaaaaacctaaacagagcaacactgttctgtgcactcaaactctacagctaaccgccaagggccatcttataaatttggacattgaattgctaaaatttgaaaacacagccactcctattcacactctaccatctggaaataaaccctaagtcactgtgggtgtccatatggaagtcactgttctgcttccttttatcttcatggtagttcaaggttcgatttcctcctagggagactttctgttgttcccattgagccagctctgctgtccccactggtcacgaaccggatcagtacatggagattcctgagcatatgcagggcagcggcatgagagcatctaaaatagagtcattcccattgccccagcacatccttccttcctacattcctgggagaaaagagcagaaacaaaggcttttctttcttctctcttttggatgtttggtgatttgcatacagaagttaactcacttcatctactggattccaatcattcccttcctggttcctgatcttagagtacagggtgcttcttgccttccccttgtcaatataagggctttagaaaacgtgcccagctggtattctttaaacctcctccaacgcacaaatatatttttaaatgcagatatttcatatacaagttgatatttctagtttctttttgaaaatcggaaggtttaactctactgggccagtgttattcatagcattggtcaactggagctgaggagccattgccatttttatggatattcttttaagccccccaatctccaccactccctgtcacctcactcagcttcatccatctgcctgacccctggagacatttgattttgtgcttcctctcacacagaacttgtgttcacaatttggggtcataccttcacatattatatgtaaacagcactctggaacgttttcaaagtcacagctattttaggtatttagtttagaagaggttagaagttgacttttacattagtatcttaaaggaatatatttgcctgctcagaaacatctggggcccacatattcagatctttcgtacatataatttgctatatagcataacacattgaatgattttgactcagtagctcgacttattttttgtgttcttttaaaatctttcatattaagcatagaattgtaatttattgatgaatattttattttctgagaaaagttggttattattcttaaaatacattacctataatgttcatgtttcctatgttttaatatataatattacaatattgatgtgtcgtgattttttttggttgttctctaattaggggtctttatatgaatctctgattacttagcagttctctgaagggggcagtctttcagagatgcatttaagagctctgaattctgttaagaatattaaggaacacaatttttaatctttactttttactccagggctttgggctgtctgtatcaaaatgcttcagatacttcctctagggattgctttgcctgttccatccttaagagagtaaagaatttcttctccccaccaccccccaactcctgacaatttcagctaaatttttttcttccattgctttaggccattgcttcaagttatatcaccttctgagactatgaataattctttcccttcaattatattgttaccttgaaggtatttataggctgtgatcaaggcccctggagtcactgctttggcagactttataaatttagctcttaccacttctcctcacattttttatcttccagcctttgtagcactccttttgtgtgtgtgcgtgcctatctgtgtagcttctctgatattttaatatccttcctaaactagggaggtcagaatagcacatcatattccaggtattactgtgagtatcagattttagagagtgaaatcaagggagaggattaccttgaaattgaacttaatctattttgtgactcagaaaaatagacaaaatggtagaaaaagctaacggggcactgtcaacatgttttcatatattttaacgtactgttagagcaatcctggaagcttaagggggaaatgatgatttttcttagagagaattctggcttccattagatgcttgaacgtgtcctttagagtaagattttctttacaaatccaggcttcaaatatggctatgtaataagatgggttttttccatagtacatgagctcttaaatctgtattattgttattattattattattaatattatcagacctgtctttgtggcttaaaattaagaaacatcattaaacatttaattttacaatgaagaaaacaaattgctacgtaaaccatcttgctactagctttaagctctagtccaggtcattctgcattttgtcaatatagtaaattgagtaacagcctctgagggccctgcaaagagccaaggcccaatttaactccctagtgccagggtctccaaatgtttttggttgtctatacatactagaaaaaaattaactctgcaccaattaaaaatatgtatatatgtatgtagaatacacacattgcttatattatcacacatacagaaacatcaggcattttaaaagataagattagatacatatatatcccagtattattccctgaagttcccatgaaccaaccttggcacccctgtggatgcccaccccaacttggagaccactgctgtggtgggaaaaccatggtgacaaacggagccaccaccctcagcagttcccaggaggaaccccagtatcaatggttatgtactgcagagcctataagcgaatatttagttcagacactcattttagatatgaagatatggaggtgcagtgacttacctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaaattatttatctatgactcagtttcctcatccgttgaaattggggataaaaaagttccataggggttgatgtgagcattaaatgacacctgtaaagcactcggctcactgcctgatcccacgctaatggccctttatatgttagctatttttattattttattctaattcttcctaaaagcttaaagcacagtccttcatatcactgcatcgcatttcattttgtaacatgttcttgtgctacatgtttcaccatgtgctacatggtgaaaggcattttcctacccgctttacaaaaacagacaccgaggcccatgtttagggccaaaatcagtgctgaatgccaggacagactcccaattcagtgtctcgtatcaaactgcatttcctttcaagatgaaaattgttactcaaaaccctatgcagctgggcgggaacacagattccatggtttcctttttcttcctgtttccccaaagcaaagcatctcctctctttgcatgggggatctatccctccagaagtctacccagcctgaggataatggcagctgcagggttacaggggtaactgtccatctgtctgaattctcagttgtgtgagagcctgtgttacaaccttagtagcttctgcacctcactagcttttcccactcccttggagtgcttccattttctccagctttcggtatcagggagtgttattaaatgataaggagctggctggctggttgtgtattgtgagaggctgagaaacaatgagtgttacaacacattagattgcatgttagctctgattttgggaactttgtatcacagagctcatcatgcaacaggactgcatctgggatactgcctcccttccccagagggttattaatgggccttcatacctgggaggacagattacaggagagatgtgataattagagatacttcactgatcataagcaggcccccgagcaccaagggctagcagctgtgttacacatatgaggcaagctccatgctccagagacaaaagtgaagtagaatttgctgcagtgaccttacctaaaagaggtcatctcaaaaatggtcacccatggacattgattggcaattggtttgaatagagaaagagtgttctgagctgaggatcagaagacctgagtttcatttctagttctgccatcatagagctatagggtcttgatgaagagtcacttaacttgtgacagtttttttatataagaaaaatgggagctacatatgtcttacttatcacaagagattgcaactcaaatacttcttcttccaaggtagtagggtggcaacaagagtgtgtgtgtgttctgacgataaaggaaatataagaatattttgaagcaaaagaaggagccagtacaaaggcagaaattgacaacgcatgggagcagaagtggataaaattaaccaagctggggcagaagaaggcagggaagggtgagagaaaaacagtagacggcttaatgtcatcaccaccacaacaaatgatggtgataacttgatgctggtgatgatttggagctcttcctatggagtaagaaagaatgcaagaattgggtcattgaccagaaactctgaggaggaaattaaagaaaattcatatctaggtgtcttaaacttctcagtaaagaaagttttaagctcatcaatcaacaggggcaggggtagatttagggacttgaagaaagtataagatttttagaatgatctctttgggggatcccaaaataagtcaacaaggcatcttttcaatgttgtcttgatctcggagtcagaacaacttgggtttcaacctagctctatcttttttcctcctagagcacccttaagcagatagatgcccataccttacccatcagtactttagggttataatctatatcttgcaggcatgttatgaaaattaaatatgatcacatatgcagtgtgcataacatcatgtttggcacatagtagcctgtcattattttggaaaagtgaccataatgaaagagaatgcatcaaatatataggattgttaaataacaatgtccaatttagaagctgagttgtgttggcctatctgcttgcaccaagattaaataatattctttacaggtgtctacacctttttctctccaaggcatgtcttcagcctcagtgctttcatggctcatattttctcctctcatgctttcctacctgctcatatgatgaaccacatagaggaggtgattctccgaggatttataatgtgtttcctgtgctcctgaattggtgccaatggcacaccaatccagtcgggtgggcctcaaggcacaccttgctcctgactgagaaggaaaaaatctttgtggagtttgcacaggtataccaagtaattgagcatttgcattagtatggaaccacctactacagacaccgggctcgtttcactcaaaggatagcctagaataagcatgaaggacctcctttcagaatcttgtttatgtaaagcccttcttggatttcctctttattatattttacataattgatcacaaatgtgaacatctatggaaatgagttggagtataggcgataattaacctggaagggaagaaaacccttcaccagaagcaaatagatacccctgcaaatatctggtaatttcggccgggcgtggtggctcacacctgtagtcccagcactttgggaggctgagatgggcggatcacgagctcaggagatcaagaccatcctggctaacacgttgaaactccacctctactaaaaatacaaaaaattagccgggcatggtggcaggcacctgtagtcccagctactcgggaggctgaggcaggagaatggcgtgaacctgggaggcagagcttgcagtgagccgagatcacgccactgcactccagcgtgggggacagagcaatactccatctcaaaaaaaaaaaaaaaaaaaaaatctggtaatttctctttcattagaaagctccaagtgaggtacaaactcaattcaaatattctatgagaataaaaacaggcttatacccaaagataggcaataacaaatgctggtgataacatggagaaaagggaaccactgaacactgttggttggaatgtaaattagtacaatcactatagagaacagtttggaggttcctcaaaaactaaaaaattgagctaccatatgatctatcaatcccactgctgggtaaatacccaaaagaaagaaaatcagtatatcaaagagatatctgcagtcctatgtttgttgcagcacttttcacaatagctaatgaatggaagcaacctaagtgtccattaacagatgaatggatagaaaaaatgtggtacatatacacaatggagtactattcagtcataaaaaaagaataagatccagtcatttgcaatcatatggctggaactagagaacattatgttaagtgaaataagccaagcacagagagacaaatatcatacgttcttacatatttgtgggatctgaaaatcaaaacaattgaactcatgggcatagagaatagaaggatggttaccagaggctgggaagggaagtgggggttgggggaggtgggggtggttaatgagtattaaaaaaaaaatagaaggaatgaataaaacttatctggtagcacaacagggtgactgtagtcgataataactcatctgtacattttaaagtaaagagtataattggattgtttgcaactcaatggataaatgtttgaggggatggatactgcattcttcatgatgtgattattgcacattgcatgcctgtatcaaaacatctcacatacttcataaatatatacacctactatgtacccacaaatttaaaaaaaatgaataaaaacatccttcaaacgaagtggctattttgttgcaaaaaataactattacttctcaagcactgactgagtgccagggtgtatatgtatgtgagtatgtgcgtgtgtgtgttttgttctgttttttctcttgtaaatccgtcaaagattgcaaaggtaggaactattatcctgatttttcaagtcagaatccaaaatttagtgaggttaagtgacttgccaccatgcttgctgctcacaagtagctgaggcaaaatttgaatccattttgcctggagcccaagcccaggttctttctcctaactgggatgtcctgatgcctacacaatctgctcagtgaattactcagcctccatgtttttctattctatggcacccctacgtcatactagccactagagtgaaaagtgataagatgaaaccaagagattgtcttatcagcttctccattcacatgtcttaaatgatttctacctttactaacaagagaaaaatccaggtacattctggggaaaccattagtgcttagttggtaaaatcttgagacttttatcttactagtagaccctcaacatttttccaaagaggcactaatgtaccctgtaaagaaatgacatttttcgtctcaaaaaaaagcaaaaacaaaaaagaaatggctacttttcaccctaaaataaaaaagtgtgtgtgtgtgtgtgagagaaagagagagagagagagagaatgaatctatctccaaatgccaatgagcatgatggactagtggcaagactttctacagaatatgtaatttggtttaggcagggcaatctcctttgtatgaagtaaatagtaaattcagttacagtatatataaacattaagaagaatcttcttctgtttaaatattgcttcttaaaatttgttttgctatttaaaaaattcattttgaagttacaagtgtctctcctaaggagacaattctctgacaaacataaccaactggcaattacaaatcataattgtgactcagaccaatattaagtgagcaccttcctgctttctcgtagatgaatgtctataagttgttagtgcacatactgaactagaaagcccacatcaggaaggtactgctctttttttgttactgttaaatttgcttggccaactcagaatgaatatccagatttctcaactcttgagttagtggatatataaactccaaaaaaattaattaaaattgaagtttaaattttaatactgagaaaaatagttgattagctagaaaaatcaccctaaacataattatatgtatcagtaagtcaaggaaaaaattaaatttgtcaataggtccctattctccagtgctgtcttttcaaagttactttgcaaggtattcagttttagtgctaacgtatcaatcttttttttttggtgggcgggggatgggggcagggtctcactctgttgcccaggctggagtgcagtggcgccatctcgccttaccacaacccctgtcacccaggttcaagtgattctcctgccttagcctcttgagtagctgggattacaggcacgtgctaccatgcccagctaacttttgtacctttagtaaagatgggttttcgccgtgttggccaggatggtctcgaactccagacctcaatgatccacctgccttgtcctcccaaagtgctgggattacaggggttagccaccatgcctggctaatgtatcattttctagaatacatttatcaatgaaattttcaaagaaccttattggtatggtgaattatgtaaagtctcagaagattacttttgactttccacggccagatactcttgactcacttctatcaatcatgcattggaaatactctgacatcgtcaattctaccgtgatctactcaagcatctcacctgtttccttccagaaagcatgttttaatgttggagattcattggctagtaaatgtatagtgtcttaaatgatgtcaaatgaagaaatgccaaaaacatgcccaacaggaacagcaaagtatttaccttcatgtgtaaaatgccagtgtgagatagcccaatgtgatattgaactggatcaatggtggggtgccagcacatgaggaatcgacattaattcaagttgggacacagaagttggcattgtgaagatttttaaattctaggactaaatggatgatccactgggaggcaatgtccagacagatcaataccacacaaaacgttaattgcttttcttggtgaatcctaagaaagtgctggggctttagggaaattgagagagatttcttttcttccccctccacaaaaggtaattaatgagtacaacagacaattcaaagcaagaaaatagaatctgaaagcttgaaagccatacattcagaatccatttagagatttacagaagggctttagcccagaacagtgcctacaggagctacagtggtgacagtgtctccttgatagatgcatcctggaatcttctactgggcaagcatccaaaaatatttgaacaaatgaggtatgccttccagcatagctgggtagttagaaaagagtcaaacatatagaaaaaaagcatagtgactgaagtcatcttaaagctagtttacaaatgtagtctgaaatacactctatcacgggatgaataggtatggattttattccaactatgatctactgtgctttctgggactgtaaaaagtgactacaccatccattaataatatataggaaggcagtttgggaatgtcaacccaaagcctcttcgtaccttgaaattcccatgcaatttggttacacagagtatatcattactcaggttaatattataagacaagtattagcattatgtttgaacaaaggttttcacaaggtctatattaactttacaaaggttctgctgtatactgaatgacaaaggctgtcacagtagcgaccaatttgttccaatttgcttacttctccagatctctctgtcagactttaagttccttgaatatagggtcctagtcttcttgcccatccttgtatacatggtaggtgttccatcaatgtttcttgaatgaatgtataaaaagtgtattttaattgaaatcttaacaagtatgcattaaatgtatagttggtgcttggtactaattctctcaccagtttattgaaatttgactatatttgagcttgaaatggtatacctacagatatagatcattaaaaccaaacaaaaccctttctttatgatatcaagagatttgcctcctaacataaaaatgaataatcactgtctaccctaatggattagactttcttcattagcctcctgtttcttctgagaaatggctacattttcagaaactctgactcctaaagggggtcagtaactctgggaagactatttctattacgtgaaaatttcaaataatctcctagaaacttgaaaactggttatacacagaaagcaaaagaggtgaaaagtgagttgcagtttcattaaacatggtcatcctccaacaccgtctttcttaccagccttgcatgaaacgtcattaagatgcatcttttatgcaagggaccaaaaagggtactacttttaaaatatagcaaaaacaggggttgcagttgcccttttattgagggtcagtttatatatgtagtctgatatatatttcatccagaaatatagttttttaaactttttatcgtgaaataattttagatttgcagaaaagttgtaaagattatatagtttctttaaacccttcactgagcttccactaacgttaaaatattatgtaaccgtgatacatggtttgaaactaagaaattaacatctgtacaatacaatttgctcagataatcccagtttttccactactgtcctttgtatgtgtcagaatccaatccaggataccacattttatgtagctgtcctgtctccttagtttcttctaatttgtgataatctacaaatactttttaattgaaagaattatctaaacgtatatttgtcagatcaataccgtcctttctatctttcctttctccactgaacttgggcgtcagtctctttcttggctactaactctaatttatgcattggatattttactactttgggctcattattttaaaaatctgcaagcagacacagtagtctaggactgttcctgaggctggagggccagggtatagcatgtgcgcaggccaccaaggccagccttgtcattgattctgctttgttaccaagcaactgagatcgctcccactaaagaaaaagaagcaccacttccacttcaaaggtaaatgtgttgaaaaaagaacagaattgacacagcttcctttatcccttaggtacaaggatgccatgcctagtcagagttctgaattcaggttctcaaagcaggaacagggagatgcagcagctgcagttgggaactcttctttctttctacattttttttttctttttgaaagtccacatctctatcaatccagaatcctaattacatatgatataaagggccctcaaaagacccattacccctgttaaagtatgtaaattcaggggcaaattatatgaataatggctaacatttattgagcgcttattacatgtcaggcactgttcttctaagcattttacatttaatccttacaacaaccctgtgatgtaggactgattattaatactattttacagataagaaaactgaaatacacaatagataggaaaattgctcaaagttgcacagctagtaattgaataatcttccaaaatcttttttatttaggtaatagtatttttgataaataatttatatattttatgaagacctttacaatgatggtgttattccatttccaccctagattaaattagcatcttgagaaaaagccataaacccagtgatcaaagtcgatggtatttattttatgtttaaaaggtgtcatctctatcgagtagtcaagtgctaaaaaaaaaaaacaaaaaacaaaaaaacaaaaaatccagtcaacagaaacttaaacacttgagggcaaacattgagcaatgttggggttttgttaccttgcactaattttgggtttaagaagggaaggaaatgatgttcgtaatccagtgttctggaaggaggagtgcttttggtagattaatttacaaagttttctgctgacaaaagaaagggaaaggaaaaaaatcagataataattccctttacaggcctaatttgaacttaattctctctctctctctctctctctcacacacacacacacacagacacacacacacacacacacgacaactgtgagctgtaaatccatggtcatctagttactagcgcagtaagagcagttgtctgatctgatcaaagagtgtcatgctccaaaaaatctgatctgtggtgaaaatagattccccctggatactatccagggattagatattttcagagaccaaaaatacagtgaagtgccctcagcaagatagaacacagtgtagtcattcttggtgaattggaaggattttgccgcagggctgtcattatgaacatcagtgatcattgtaagaatatggaaaagtgctagtgaataggagtcccaattacagaacactgggtgatacagcctttgctataattatagtgtgtttagattgatgggcctaatgagcagtgttccttaatctaaatgttgattttggagcgagttaaaattagaggtaaaactgtgatagtaagtttgtttactagattgactatgtggctccacgtagaattcagattagttcaactaacacttcctcagcaccaaacccttgtcaggccttgggctaggtcctggagacccaaaagcagatgaagtcctcagggagttacagcccagcatgggagagggcatttcaacggcattagtaatagcagtggatatgaattgagcctttgccagatgctaaacacttgttctaaaccctctgcgggtattaatccatttactcactccaccataaccccacaaagttgggactaggtgagaggggagccaacaggcctggaagactacagtaacttttccaagcttatatgtgtgataagtggcagagcagagcttaaacctggtccggaccttgggttcttaactctaaccttagtattccagagaagatttcaatatacagtagttcactgtcctgggaccaagaagaggtacaattaaccatgttgcctatgctgctggtgatgaagccagaacgtaaacagaatgatttatcctcactcctttgttcgtgaacaaaggaaccataatcccccatgaaccattctggcctctttactatcctccagacaggttgatcttgtttctacctcagagcctttgctcttgttgacctgagtgtcccatcccagataccgttgtatggcccttccactcaatcctttcccacctccctccaaatgttaccttattaatgaagacttccctagctcattctattttatctgcctttcttccttatcccacctccctgcagttccttctcccttaccctgccttactttttcccacagattttaccattagcaatactattaatttctttttacttgggtttttgttggtttgtgtgtctgcctccccacactagaacacaggctcccaggggttagtgactttttaaatattgtttgtcactgaatttccaatgcctaaaataggacctgaccacatctgagtttaatatatacttttagatttagtgaattaaaaagccagaatgaggctgggcacggtggctcacgcctgtaatcccagcactttgggaggccgaggtgggtggatcacgaggtcaggagctcgagaccagcctggccaacatagtgaaaccccgtctctactaaaatacaaaaattaactgggcatagtggtgcgcccctgtagtcccagctacttggaaggctgaggcaagagaatcacttgaacccaggatgcagaggttgtggtgagccgagatcatgccactgcactccagcctaggcaacagagcgagattctgtctcagaaaacaaacaaacaaacaaacaaaaaaaaccaggaagaacatattccaaagtgtttaaaatagttatatctgagcgtcggaattatactattttaaatacacttttaccaagtttcctataatgagcatgcgttctatgagaaaagggctaaaaatagatgaaagttaaacattagtcactaattcatctcataaacctacttactcctgggaactattaacttctgtgttattattgcacattgggtttttatacatggtagatgctattatcgaggatcccttggggaaggtttgtgtatgaaatgatcatttctttcctgcttactccagattgagattgccagccttgactcacctgagcgggagactcacatgtgagactgcccgtgtgaagagcttccactgtgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatctctactactcgaagccactcgagtcatctcttacctgaattgctgcaagcactttccagctggtatgtttgtttccaatcttttatttcattattttttaagagacagggtcttgctctgtgtcccatgctggagtgcagtggcacaatcatagctcactacagcctcaaactcctagagtcaagtgatgctcctgtctcagcctcttgagtagttgggactacaggcacacaccattatgcccagttaacttttttctttctatagaaatggaggtctcactatgttgctcagggtggtcttgaattcctctttctagttttctctgacactctcactccctgccaatcttttctcctcaaagaagccagaatggtattttttaaaaaatataatcagcctttattaccaaccacccccaattaaaatcctcatgtagctttatattatattaccaatccaatctaagtgcattaccaaagctttgaagaccctgtttgatcctacctctcaataccctccagaacatcctcctcgtctaccactttcctccacatctaccacaccctgggctgtttgtcaaacatgcctggtttgttctagctttgagcttttctctgtctgggagacttcttccttcagcaccagagctgacttttccttgttttatacatagtgagatgtcagctcagatgttacctcctcaaaatgatctttttgatcatcataacttagtaagctctctccctccaccagtcacactgtcccacatctcttcattctgtccagtattagtctgtaattaccatgtgcttacatgtttaatatctgcctcacttttgaatgaaagtatcaaggggaaaaggaatgtgactgtttaaatcactgctataacttcagtatccaaaacagtgcctggctcatagtgaacccttcataaatagtcactgaatgaaggaataaaggattggagcaatgaatgtttttgtgacatctagatgaaaattagagatgataaccggtgcaattttgatcatctatctcccttcataccagccaccctaatctaggggactagaataccgaaagaaaatttgcttctacgaacaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttttgagaatacaaagaaaggtgcttctgtttctgtttatgggaagtcactttacagacatttatctttaagtcatgatagatgaatttctcatatgggcagttttcctaaatctgagttttagcataatgagatctggagaaaaagaaggcaaaaaaaaaaaaaaaaaaaacccataggaaatgatacagagactaatgatcatttacccaaataaaacagataccattcaaagttagacactgagcctctggtaatccctgttcttctccttcatcttgagcgagggatactgaaaaagactgggctggctactgtttaatcagggaatgatgaatacttttcattagcccaagaaaagttagtttctattccagaaatattttgtaaagaccagttaaaattattaactattatgcatcacttgtcaactataggaagcattactgcaacctctccatagatgattagaataattgctgtcctttcatctttcccatctaacaatactcacccagtacctcccactttcgtttgtgtcttagtatgctgcatgtatctgctttgctaagagaacatcaaggcttggcataattgggctatttccctgtcatactggtttgcttctaaatctgcctcctctgtgggttgcagtgaggtcaatcagatgcagtcaaatggcagagaagatattaaaagtacatatatcctagaactaaatatacaccatctgtgaacttcagttacaaagggaaacttctcttaatatgaccttaggtaaagccattggcagttttattgtatctgtcagcaatcaccaatagctttgattaacaacatgactaatacataagttatgttggtctctttttttcataaataataagagatagggtttctaccaacacaacatttctcatacttgcctgatcattagaccaactgtggcacctgagaaaaatatgccacagacctactaaatcaaaagttccaacaggcctagggatctgtatagttcataaaaactccaggggatttgattatcaggcgaagtttggggagctttgtatgaataatattcaatgaattgtttgtatgtctgtccgatgctttccagactgggttaatgcctgggtctctttctttaattaagctttgattaagatgctcccagcaaatcccacactgaacatttccattgccccctccctcccccgcttctactatgagagaccgagatccatgtgaggtattctgtgatgaagatcttgttctgtttttattattaagcgtacatcttccccttttctgatattaccactatgcatcatcagttaagctgtcaccaacctgacctctgaggcattggaatcattcacttgatgaagcttactttggcataagctaagggttaggaaaaccaacagatttctaaaatattgtgcatggaagggccactggaagtcctccatcacagcctgatagctacaaaaatgagggaacaaaggcccttgagggacttgccaaagtcaaatagtcaattacagtgagagtttggactaaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtcggagaggaaggacagaggtggggcttcccctagttatatttttatctgattgggatattgaaattatattaagaatttatttggaaaagccacttctgttactttttaaaaaaagatgtagaggcacaaggctagatgttgatccttgagtgcagatctgattcttacatttggagatccttagaaaagaagtctgtgaaggcaagcatttgtccttttttgtcataaaacctgattcttgggtattcagtgaatgacactcattgaccaactgcaggtctggcatgatcatcacaaagaattggcactttgaaagtgagagaacagtgggaagagaaattcttaggaagcaagctatcttttctaatcctctttaaaaggccaaaatgttcacaactttcccctaaaacagaaaggtgacattgctccttaagcagcagtatcatgcatgctgtcctctgccttcctaagaagtgcagacagagggcagaccctccgagtgaagtacctttttttcttatttgagcctgctctgcattgagggagagtttgacacacctctttagggttctgagaatagttaacagctctaagaaagagatttttgttcataagaaaaaacaagagaaactggaagcagttctcattcatattctctctctcgccacaccccccaccccacctcctcccgcctctccctctccctcttcctctctctccctctcttcagtatctaatgtaaacccaggctttctttatgttctgtgcagttggcctgagttctcttctgttttggtcaagattcaagtggaaaagacctgagcctgtgtctgcctcctttctcctaattttggtttctaatgttttacccaagaagggactagacctttgtttccctactcctttatcatagcatgctggttctcagaccttttctgcacactgctaacatccttctcacctttctttgcttggctttttttttcactgcaagctctcccatgttcatttctcatttgccatcagatttagagtaactggcttatggcatcaaagaatgaatcagatgggagcagctaagtaaactgaatgaagctgcttcctttctcttttcccatccacaaatgataaaatagcctgcccagccaagtgacgtggcattcaggggttatggtggcttggccatttgtttaagtttgcttatttgcagtcacagttctttagtatttcagtgatttggttatcactcaacagtgcacacatttcttctataaaatttgatagttacttatctatctctgatttttccctctgtgttttattatatctagtttaatttttcccctttgttgatttctgttttgtatatcttgttgcgggatatacatggaagggagacgagtttccaaagataatatagatcccagtttgcctgtaaattgataacaccatttggaaacaaatcttaaaacctcactgacacagcataaatagaatttacagatcttcttgaagcaaatccaaatctccagactctactttctccattctcccccactcatcctaaccttcacgtacagggaccgcgttaccaagtgagccaactagactctttcacacctctctgcctctgcacatgctgttccttggccagaaatgccttttttttctgctttacctgacacatttagattagtcttttaagacctaatagaaatgtcaagtgctctgatatgccttcccagatgcccatgagcaaagtcagatgttctgccttctgttcccctatggtactttactgatgtccctgtgacagcttcctgccactccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctggtggatctatcttctatatattcctactataatgtacactcttaccaggtaccaatcagttgtttcaaaccacatttctactaaatgacctctctgaagtgattctgaactggcttccctattagatgaagaccaaacctctactctaagcacttaagacaaatggttgcattcatctcaatgctccttactcctcaatattatccattacatttttttgagacagattgttattctctgacagattgttattccttcatcgtccaaaaggagtcctcactttgcttagactggaacacaaaattttatctattttaatgttccgtcatataattataattatattctgttatctattccaaattttcagaattttatctattgcaaattttaagtattccaagttataaacttacgtcttccaaaaagactaccaggattaaaccaaccactgaatcatcatttcattacttcatattactacaagttagatttgggacactgtaatattttagccctgattttgccctttttatagtgtccatagataatttaacttctttgtataaacttccattataaaatgaagttttttatatatatatatgtatatatatatatatatataaaacattacacatttaggacatttcatgatgaaataaaagtgtttcaaatagaaaatgatggtttatttgggtttataaatcaagaattctcaagagggtatgaaacccacttctcccttatcaactctagggattttctgtagttttgaaatttgaaaagcataaagtaaaattattatcattttgatttgcttgtagtcataatatttaattcacttagaaatatcaaataacattaaaagaaaggtgtgaaaatggctgcgctcagtggctcacacttgtaatcccagcactttgggaggcccaggtgggcagatcacctgaggtcaggagtttgagaccagcctgaacaacatggcgaaagcccatctctactaaaaatacaaaaattagccaggtgtggtggtgcatgcctgtaatcccagctactggggaggccgaggcaggagaatcgcttgaacttaggaggtgaaggttgcagtgagccaagatcatgccgttgctctccagcctgggcaacaagagtgaaactccatctcaaaaaaaaaaaaaaaaggtgtgaaaaatagggtagaccacgtgtgctgttacagtagaccccaaacataaaagatgtttatctcactcatatacacagtccaatatggttccagttggtgagggttagggttgtcattctgggagttggccagtagagatgctaccatcttcagcatgtcttccaaaagcttcctggtatcaaaatccaattgttgaaagcagagagaacatgaataagttcatatggaaggattttatggactaagactaaaagtagtccacattaattcagttcacattccactaaccacatggacacccctaacttcattggtgactaagaaatgtagtctagactattcccaggaataagaggaaatggttatactggagaactagatgtctaatatatattaccttacatagttatcaaagtcatttttagtttggacatggtctttactaatgggttgcaaatgctctttatgcagatgttttatgttttatattactttcctatgcccaacagcataaaatatagaagtctggatggattaggcacttgatgtgtgtattagcttttgattgctatgtaacaaatgaccacaatgttagtggcataaaacaacatatgtttattgtgtcacagtttctgtgggtcaggagtctaggcacagtgtgactaggtccccagcaaggctgtaatccagtcgttgatcaagactgtatttctcatctaaagactcaacaggggaagggtctgcttccaagctagctcaggttgttgtcagattttactttcttgtggcagcatgattctttgaagaatcaagaattcatggttgcttgcttcttcaaagccagcaacagagactaaatcaaatctagccagatggtcttatataatgtaagataactacaggagtgacatcccaacacctttgtaatattggttaagcaaattacaggtctcatatacattcaaggggaggggattttacaaaagaatgactaccaagaagcaggatcactggagcctgtccaccacagtaaatgactgaaaaaatctgggtattccagagaactaccactttacctgaacatagctctttacacaaaactacacagaattatgaaagatctcaagagaaaagtgttccttattgccaagagctggttattatgctagtaaaatcagcagtgctcaggaacaatatttgctaagtttcacagttatcaaccttaacccacacaatcatctttagaattggatccagaacaagatgggaccatcttaaacctggtacattctcataaggttcattctcataagaccctaaagccttcattatatggcatttttgaaactcctttgtcattttaaatttttgtctttcctagctcccttttcctctactattctatctaacttaggcagcattgaatttcatttttttttctccttagtctttctgtttgacattttcccttctagcttcatttgtcctttaagacaaccccataacctttcatctaggggaaagaaatctaaaagaaagctctagaatgagattttagttgacatattcaatttgctttagaggggcatcacccatacctcttcttccactagtgagatctcctgagaggtgaaaatatgagagaatcagagctgcttatttatatatcaactatggaaagatctttcctgcctaatctgacctcttctttgaaactccaaaagtgactttttgtggttaattcttccaggatatctatgatgcagtcccacagatattaaaggttcagggcatcaaactgaaagatataacagctctaatagacagagtcacatttctaaaaaggaaaaccaaattctgaagatattttctggctctgtgaacagctaaaaatacaaggataatcgttcctatagtcctggacttttaacacggaagctaacttggaaggaaaaatgacactgagctataggaagagaagaatagaacagacttcagtgaaatcggccgcttttcttttcaaggcacttattcctagattagctcatctatctttaagtttcatatgatttttactatttggcatgacttaaaactaccaagttggtgaaaggtacataggaactctctgtactattttgcaacttctatgtgtctaaaattattttaaaataaaaggtagcaaacatacaaacaaaacaaattattgagctgggaagtgttccccttgcaaaagtctagcaactggggtaaaattgtttctttgaatacaaatgcctagtctctgattaataaaataccaggaagaggaaaagaaggagctgaagaaagagagaaagaaatagagaaatggggatttccagttgctgtagatcttgagtaggcaggaccttagcacatggtatctaggtgcatattgcctgtcacttttcaattatctttgctggccctgcctcaatcaaagcccaaaccataccccaagggcactctgcatcgttgaatttatagatgagatctttcttttgggataaagagctattctcaacttgactattataccttggccttcattccctaaagaaaatgggcagggaggcttgcagacagaagtatatagtgtggaaaatgaaccacctcttttgactctttgcaagatttgtgatgtcctactgggatgcctgggcccaggcacattcaccttgattctacatcagagacttctgtgtcttctttctcatagtatgggttattgggttgagcaaatactttgtcatcagtgtgtcttatggagtaattgagagccttggatttgaactcatatctatttgggctctattttgggctgtgtcacttatgaactgcatgaccttgagcaaatcactgaaactctctacagtccagattcgtaatctattaaatggggctaataatacctcatgcatatggctgccaacgggagttagtgaaataatgtacatgaaatatttaacactaaacttggtgcctaatgtatcttcagtaaatgataactattgtcatagtcatcattgcttttatacttttcggcttccagtgatttccagtgactacagccctaaggccattgggggatatcttttttataactgaattttctttataaaacaataactgattttttttttttttttaagacagagtctcgctcttcttgcccaggttggagtgcagtggcacgatcttggctcactgcaaccttcatctcccgggtacaagtgattctcctgcctcagcctcccaagtaactgggattacaggtgcctgctaccacgcccggctagtttttttgtatttttagtagagatggggtttcaccatgttggccaggctggtcttgaactcctgacctcaggtgatccgcccgcctcggccttccaaagtgctgggattacaggtgtgagccaccgcgcctggcctaaaacaataactgattttttaaagaaacatactcatgactatttgtcattttagtcaaagaggatggagaaaaacagggttcagttttattttcagttcaatgtttcgaccatgacatccagtgctggcttgattacattttaggaaactgaattccttctctaaagaaatagtccaaaattaaacacatatggttactgtaatcaataataatgctaaccaagcatgctggctcatgcctataatcacagcactttgggaggcagaggcgggtggatcatttgaggatcacaggagtttgagatcagcctggccaacatggtgaaaccccgtctctactaaaaatacaaaaattagccggttctggtggcacggacctgtaatctcagctagtcagatggctgaggcacaagacttgcttgaacctgggaggcggagttggagtgagccaaaatcgtgccactgcactcaagtctgggtgacagagcaagactctgtctcaaaaataataataataataataatgctttgtgcatttcaaaattactaaaagagtgtaatcccaggacttttggaggccaaagcgagcagatcacttgagatcaggagtttgagaccagcttgccaatatggtgaaaccatgtctctactaaaaatacacacacgcaaaaatattagccaggcatcatggcgtgtgcctgtagtcccagctacttgggaggctgaggcaggagaatggcttgaactcaggaggcggaggctgcagtgagccaagatcccaccactgctctacagcctggccaatagaggaaggctctgtctcaaaaaaatatatatatattatatatatgtgtgtgtgtgtgtgcatgtatgtatatatatatgtgtgtatatatgtatatatgtgtatatatgtatatatgaaaagagcagaatttaaatgtttttaccactaaaaaagatatgtgaagtgatagatgtattaattagcttgatttaatcatttcacaatgtcaacatatataaaaaatcacatcatactccgtaaatatataaaattgtaagtcaactaaaaataaaattttaaaaagggaaacataataacttttattattttgtatttttaaaaatcaaagttaggacacatattgagtttctctgctactcaatgaactgaaggttttggaaaacaagaccaaaaaacaacaacctccaaaaaagaaataaaagaagatcatagttaaggcctttcatgcagtcagctcagggatcaagggtagatctcaacccgcctgtcactgagtatgcagtgctcacagatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaaggaagaagatctaggggttctcgggattcgttgaatttgatgccatggctgaaaaattaagtggagatacactgtatgccattggagtcaggcactcatgtgaaagatcagcactcacatttaggaattggatacagctaacagcaggggaattgataggctcatgaaaagagcatgggtagaggatgacatagaaaattaagcacagttagggaagacttaccagccaggttacaagaagcaaacacctatcccaccgattcagaataccttgcctcactcctgcatgacaggacatgtgtgttctttacgttaactgagaaactgaggccagataggaagacagatgtggccagaagaagttgacattagtaatgagagaaataaacgaagtgattttggggctggcgttaactatctagaactacccaggagggtagatttagagacacttccatctttgaaatacccagaagtctgtttctccaatgccttgactctgcctaaagcagtctaccattaatctctgaggaatctcttcaaacagctttctgccaatgtatcactgaagccttttgagaaataagtgctgttccagcttagtcatatctcaaggcagcgtggcatgggaggtggagactacgagtaattaaaaataactcccagctcaagcagggagagggctgtccctgcctcatctgtattcccatcacaggctccccagtgagaccccagctgttgagcaagagactctgtagtgtctgatgcactcaatcttgagttgatcacaaaagaatgttaacaacgttaagggcatggagttctaggttttggaagaattcttaatgattctgttaaagaggaagaaataggaaaaagaccaaaaagacagggacaaacaggaaaaacggacccagctctactgcagtaatagccattgatcactttacctcccttggcagtctgatcagtttcactggaaagatagcaagtggaaaaagtgtgcagagatatgatgtgaaaattatattcaagctttagctccccagcacgtctctaaggaaagcactataggaacagctgctggagatataaacaaaggcccaggaacatctctgccattcatgtcaggatctgagagagccaagggaaggacaagaggggaattagctcccagacatgcttgagtctctaagctgttactccgtgatccccatgttctaggtgcagaagcattgcgtctctaagcaattcccttaccaccagctatctaatgctgtcagaggaccaactatttgctgttaacagtaatgctcatttgaagctattcagcctagattttctttgtattaggtaactgtttaataaattaattccaaacagtacctcccatctctctcagtctgaccattgagcgctcttagtcaatctttgcaaacttgtccccatttagttgttaaacctgctccatcaacccaataatgaatcaacctatatttgaggactatggtttgtgcctgctccaaatcctatgttttctctgatttcagaccccttgcctcaactggatgaacttttcaagctcagaacaaataagtgttaaaaaacattattaaacaaacatattcacctttctacaagtttggaaaataacagctaaggaaaaagcttgtaatcaatattttttgttgttgttcttgttgttgtttgagacagttttgctcttgttgcccaggctggagtgcaatggtgcgatctcagctcactgcaacctctgcctcccgggttcaagtgattctcctgtctcagcctcccaagtagctgggattacaggtgtgtgccaccatgcccggctaattttgtatttttagtagagatggggtttcaccatgttggtcaggctgatcttgaactcctgacctcaggtgatctgcctgactcggcctcccaaagggctgaaattacaggcgagagccactgtgcccggccttataataaatagatgtatcaattgtagcttaccagcaccaaaaacaatagttagtaagagtgtggagtctagaatttgactgtttagagaaattatgcctcatcttggggaaaatttcctaatgtgtccaatctcctgtttccttatccataaaatggagataattgtaggacctcctccagatgactattaggaagagatgatacatataaaactcacagcactgtgtcaggcataaaataagtaatctataaacaatgttatttaacacttttatgataaaaatatagaaatagaaaataatagtttcagtgacagatcaatgttgaagcctcaattcaaaacataataaaattgctctttatggttcttacgatgtacatttatttcaaatagtaacaatgctgttcatggtgaaacgtattgattttaagattgagaaattggacaaacaaggctagtccacaatagtgggattgcagtagaccctagaatatgtataccactttggaaggtataattaatatgtttatatgtgtcgtccccaatctttccattctttattaccaccattatacctccatttactccacagtccgtctcttctagaatgaaagctcccacaaatcagcaattgcatctgtataacctattctgtatggcataacacctatatacttttccaaaaagaggtggagagaatatttattgacttaggtatgtctgtgatgatctaatgaaatgtcatggaacaacttaaagtcatagccaaaggaagaggaatgttaatatgtaagaatttgcagatagattattaacatggaatgatgccaaaatagcacagtagaaaaactaaaataaattaaataggcctggatttgctgggtaacctggggtataaccccataaggatggtgtatgtagaagaaaagtcagtgaatcattagtaattcataaactgtgttttttctcaggtgttcaaacattggaaagctatcttttgcaacctgatgctttccctggaatatgcagtgtttcttgactcgtgcagtaatggctgatggagtaggtgttcagacattttatttgttggttttatgtatccaggtagagaactcctgtctaaaattatcaagagttggtggtgcattcaggacaggaatttagattttctgactccaaggacatttcaccacccactaaaccaccctttgccatgagctcccaggaagagcaattgttcagtctggtacagtgagggaataatctgtccctagcacaggaggctgaacacagcagtgaataaaagaagacaaaaccagttctacaatataaatgacacattccattaatacaagtggatccaaatgaactaatttcattcaatagtactttcacattctgtagctatatgggcttggatacaaattgtaatgtcagtctgtcaggagagtggatggcagtgcataattacaagttcttgttcagcacttcaggagctaatcagagcaaggatgtgaatctgtaatttgcaaatgtgcaaagacagaggttactatggcactaacgactctgctgataacattcttgccaccacatcataggactgtgagcacaaattctacaaaatcatttgacctcctgtttagtcgtttgcaagaaacagcctgctggcagtacctagggacatttataagtttaatgttgttcaaaaatctaaaatgtcactatacaataaattaatacttacattctaagggactatacacaatcgtaaagcaatatatagagcaaattaatacataaaatacagagaaatatagaaaattaatatactacatcatgcaacctgcttctaaacaagtgtttctttcataggactgaatcaggaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcagcattttagagttcagtactggcctaaaattcaagcctctctctaaaagattatagaatttcgctgtcctctcagttcacagcagcaagcagaataatttctgcttgccattttcctcaacttagtcctgcaaaagtaacatcattggtctctgcttctttcctcccattattacctgatcctgctctacagcagatgcttcctcagagaaagaaatacctcgaacatctccatcaacttcttcatggtagtaacccttaaccctaaacttttcttgtgtagagatgggtgcatcatgttgaggattcattgaccattctgttaatatatgaatttaatcaattttaattttaaagaatcaggagtgattacgtgcatcacaactttcaggttaaataattttatcatgggtgctaagctagaaccatggctcacctggtcagatggctataggagagtcagcacaatagaagcttcaggcaatgtgaatcctgctgctccctaccagggatcaaaactgaggtcactgtgtggtatgtggaagtcaaatgactgcttctctttaaaaagtgttggaatgatgcgttttctctcaccgattctgtctagggggtaatgtgctagggtgcagtaagttaagtgttagtcacatatttgcagggttaaatcttagttccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgcaggatgtttattaaggtgtgcctttgagatcaatacctgtgaaaagtagggaaagaaagcagatgaggcatagggaaaaggtggactgccacaggcaacccagcgaacctcaccagcagctctggagctaaaatagctcttcagaattgtccagagttgggctgaggaggccagaattttatttgtgttcccacgatgatgactcagtggatggggtcatttcaggaagagagcagggcatcaaccttgagcaagaaaggtcactgcagcttagtctaaccctgaagaggctggcagctcagggcatctgttgacagtattccaaggaggcagggcgactagaactttagcaaaggaagatggcacatcacagtgatcatcacagtccccagtcataaagagtagtttcttacatgtgcataccccttagccttgttttcatttctcctcctcccgccttcctgtcttcctcttcctctcccttccttttcttctttttcttcttattttgattttgttttactttatggaattaaacctccataattctgtagtgtgccaagtatgagggggaaaaagtctctttcccccattaatagataatgacaccttgacagataagtgagcaattctgcattgattcattggggaaaactatggcaggaagtgggtagcagtgtttagcgtggcataaaatacatatgctatctaaagaggtggcttctttcccttctgggggatttatgtgcttaaatcagggcccacaaactcaaagcacgcatttgggctaaaggaagcttggctaagagtaaaaggagagccaacagggaaagggccttgtaggctgtgacctttcaagctaaactgcccctagagaaagagagacttatttgaatttacagatgccttaggactccagtgagccacagctctggctcttttcctctggggcactacaaagcttaggtctttgcagatcaattaaagtcattagcgctccatctaatgaatgttgatttccatgaggaggctgagccagctggcctgccctaaacagcgcaaaggcaagcagggtaccagagttagagcaaatggcaataagccacttgaattagaaggcccccagcttgcagcagagttaatgctgcctgttttccaggtgacctcaatcactgcctggggcagacactggactcagatgctctccagtcacaagagagtttgtaaatatgatttaaaaattgtcactggctgctcaactagcaggagtgttcagaaagctgcaaggtatgagacactggatgcacagatgtgttttcatctggggaatgttgcatttttacaattttctctcctggctattatgatgggagatttctagtttttaaattcagtgtgctttttaaatttttgaatagataataagatgattgcaaaaaaaattaatgctgcctctcatttctgttcttcatctactcaagaaaccagttattctttttgtgtgattctagagttttctgatatatgtacaagcaaaggaaagtgtatagtctcatattctcatagtcccacctactaaacaaataacaacatactgtatatataattctgcatctcgcttttcttctcttttaatatatcacagctgccttaccgtatcagaacaaagagaaattctttttttttacagctctgtcatatttcattgaatgaacatgccttatttacttaactgttcctttactgtttgcagttacaaataatactgcaggtaacctcaaatatgtttcattttttacgcatgtttgagagtatgtgttgaatacaatctcagaagtagaatgacttctaggaggtatatgcatttgtaatttcaatagatagaaggattgccaaattgtccttgagaagtattacacaaatgtacagccccccccccctcaacgaatgggagcgcttccccacacctcaccaatagagactgtggtcacacttttagaaatttgtccatctggtatgtgaaaatggaatttcagtgtagttttattttctttttcttatgatgagtgagattgtacatctgtttatatgtttaggaactttttagaaatcgtttgtatgaactttctattgatattttttgaccacttttgtagtagtttgctgcttttgtttttaattgatttctactagagagactaatctccatgatatgggatgcaaatatccttttcctcccctagttttttgtttgccttttgattttccttacagcttttgcccctgagcttttagattttataatgttgaagttatcagacttttcttttatggcatccttatttcgacacttaattagaagggaggacttcatattctagagtggtaaagtaattcttcatggttttctcttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcacttttattctgctgtattggtctgtcagtgcacatttttcaattctgaaacctgtacaatagatttcagaatctaaaagggctaattctcccttattactttttctttcagagttttcctgactttcctttttttttttttttttttttttttttgagacagtgtctcagtttgtcatccaggctggagtacagtggtgcgatctcggttcactgcaacctccacctcctgggttcaagcaattttcctgcctcagcctgctgagtagctgggattacaggcaagcgccaccacacctggctaatttttgcattttagcagagacagggtttcatcatgttggtcaggcaggtctcaaactcctgacctcatgtgatccacccgcttcagcctcccaaagtgttgggattacaggcgtgagccacggcacccagcccacttttcttttatatttttttatagaagcattagagtatataagcagtttcttttaataatttgtatatgttagcatatgtatatataaattagataatgttaatttacaaattaaggagagctataacttctatgacctatatgtgtctttctatttagtgacatgatctgtctctccttttgcttaaattttattttatataatttcatatgtctcatattttgttaggtttatctctaaaagttttttcttctctgtacctaattatgaatggttcttttctgttattacttctactaatgagctgtgtgtgtatatatacatgaagatcatgaattaaggcatactaattctgcatcctgcttccttacagaatcttcttgttaatagtaatcattttcagttgtttcttctgagaactccaggtgctcagtcatatcatctaaacataattttatcactctctttccagttttatatctccaatttctcttgtttaattgcattagataataatcctatctaataatatagtaatgatattgtggatactttagcctcgttactgactttagtaagagtgattctgatgtttccacaatcattatgagcctggcttttgcaaacatatacatccctatggtttcttaacactgaatggtctggtccttacattctcaagttaaatcccgttagcattgagtattctttataatatagaactagatccttgtaaacaatttaattattttctttttctatgccacagaacaattaacttggcattaaaattctctactctttaaaagcttggaatgatttatctgtgaccttttctgggcctcgtgctttctttttctaagggtggctcaggtgacagacaacttcctccatttcatcaatggaaatgaataggttttgaatatgtatcccctttagaattatttttaggcaattacacttttctaggatattctctatctcccaagttttcatatatatttgcacagagttagccaagactatttttgtcatttttctgtgcttattttccacttactatttttaaattttatgtatctgcaattttcttcctctttttcatgatgagataatctaatgtttaccctttttaatttttttgtaacagaaactttaaatatattaattttaccacttttgcatttcctagaatattaaattctccttttccctatatgaattggccctttatgtttttcttaaacatattttatgtttgtttaaaaattttgtattaaaaatattgaattgattttgttattttctcctgtcaatataaatatgtaagaccaaagatttcctctaagcatggcttttcctgtttcccatagattatagaatatgagtgcttttacatttttattgttctaggaaacctgcaaaatgggctgtattacattcgacccaagaattaagagagagttttaaaatttctgattggaatgggattctgtttccgatcttgttgttaacatctagttattacactgtgatcagaaaatgtgtacaatagtatttcttttttttttttttttttgaaaaagttgcagttttctttttggactgcatacagttacatttgtgattatcatgtggattcttaaaaagatttttttaattttcaatgcataagtctttaagtgtactgtttgatataccttataaattatgctatttaggtcaattatagtcttacttttgactacttcatctatcattgaataagcaagatgatttaaagtgtcttatttctgttttttggctgaatgtttcttcagataactcttaagttttctgttttttgaatgttatttttatttcatttggttcataactagttataattctgacaccttcattgcgaatttcatcttttaacattttaaacaaaaaggtcttttctcaattatttaaaacctgaataccactttctctgattttaagatccctatcgctgatttatttttgtttgcattcttccggcatgccttggttgaacctcttattttcaacgtgattaacaaatttaattgttttatttatttacttatttattttaattatactttaagttctgggatacttgtgcagaacatacaggtttgttacataggtatacacctgccatggtggtttgctgcacccatcaacctgtcatctacattaggtatttcacctaatgctgtccctcccctagccctctaccctctgacagtccccagtgtatgatgttcccctccctgttccatgtgttctcattgttcaactcccacttatgagaacatgcagtgtttagtttctgttcctgtgttagtttgctgagaatgatggtttccagcttcatccatgtccctgcaaaggacatgaactcatccttttttatgcctgcatagtattccatgttgtatatgtgccacattttctttatcactggtcattagagaaatgcaaatcaaaaccacaatgagataccatctcatgcaagttagaatgacagtcatcgaaaagtcaggaaacagcagatgctggagaggatgtggagaagtaggaatgcttttacactttggtgggagtgtaaattagttcaaccattgtggaaaacagtgtggcgattcctcaaggatctagaacaagaaataccatttgacccagcaatgccattactgggtatatacccaaaggattataaattattctactataaagacacatgcacatgtatgtttattgcagcactgtttacaatagcaaagacttggaaccaacccaaatgcccatcaatgatagactggataatgagttgttttttaaagcaagtctcttgttcatagcacaaagttggttctgctttgtgatctattgtaaaagttgaaagtctttgtcttttaataggtatattaagccagtttatatctaattatgtgatagatatatttgttcctggtcctctcctgttactttatcatatagtttctctttttcttattttgtttgtttgcttgtttgtaatgtgttctatgcatgtctatatgtatgttttgctatttaagagtttgcattttctcccttgtcatttttacagttataatgtattatatttttagtgctcaatatatttaaaccagagcttctcatccaatataccacactcagggcttttggatagaccctctggccatgaacaatcttgtcttctcctctcagtctcgacaaatatattatttgctttttgacctatcatttgaaaaatattgggaaatgtcactttaaggaatatgcactagctctttactatgagcagtgaatcatctttcttaatatttaatacagaaaaaaacatgcatgtattaaaattaattgagttgatactttatatattatcctttgactcctagcaatcagataatttacttcctactttctgtcctcttctaactatttttagttgtattacttctgtattgtcagggtttattccattttcattctggtcttcagcatattattcccattaggttagacatagttcttctttaaaaactatactctgtgcttaccttcaatttcattgtcatagttattctaattatgttttggttgatcaaagtcatttcctagtagtttcctcaatattcccagtgttcctgaaggtaaataccatttgtaaactatcattgagtatagtttggctggatataaaatgttgggtcatattttgctttttgttgggaggatgtttctataaacttattaatacagtcctggtgagtcagagaagcctttcttgaagaggcattgtctatgtttaatctctaatggatgatcgtcacagaaacatagacagaggaaatggttccaggcagaatcaatggaattgaaaaaaatcatggtacttctgtggaacaggtagttggatgactgtaatgcacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaagaaaaaataaagaattacagttcttgggtatatagtcttgtacctctgtaatctgtgaactgtctttcttccaaggatcccatggaaacctttacaaatctagctgatattcactatagttctaaaacatttccttccttagctgttccatggggagttttctgtgatctcgcagtttcaagctactttttggggaccttccatacttcattcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggttgtggaatttccactgaaggctggagatgaaaaacatactcatttacactgtgtgcgaacttggtggactaacattggttaaactttgaaattaagagatttttttttcctgatttttggccatctctttaatgcaatttcaggtagccacatggttcttaaaaccccaaatgcagctatcttcagtaagtacaaaatgaaaatatgttgcatcctaacagataagaatttcttctttctcatgatgagagctgttacctaaaggagcaaagctttaatggggtctcagcttgattttgccatgtttatatacaaaagagatgaggcaagctttgttttgaagatgttaattgattctgtccaccatgctgtctaacagccaattccctgaaaatgtagtgatggaaaaaaaatctgttccaattactgtataagtaaaatgcttcccttccacctccactaaagaaaaaaatggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcaggttcacatccttgtgccctgaagtttcaaagtgtccagttgctgtaggagctttttctattctgatattactgatactgagactggataggaagcataccctgtttagctgcacatctaaataatcggtaatgagaacatccttgacaaaactatcttgcggaggagaggtcaggtcttacctgcatgcctgcgaccttcagcaaacaaaggcagagatctaaggagaaaacaggatgtgggatgtttccagtggaccttggcagtggacttgctttgtgtttgcaatggaagaaggaactagaggggggataacctcatggttgtcttttcttctaaatttctaagacaaccagtgaagcttgaggccttttctccagaactatacaatctttgcctccagcaagctctgtttttactaataaccagattgtcaggtggaaaactttttctaagtggaccttacttctctaagtaaaaaaacaaatcccctgaggcatgaagacctccattttacacttttgttatatacttcacaggtacctgaaatggttctggacaaaggatatgatgatcgacaataaagaaatcaaagatcatattcataattataaccaacaaaaaataattctggggataatattgtcaaaatggattccactgcaaacaggcagtaggatttactttgacaatattctccccagaattattctggatatcactgtagggaccaaaggagagtttttcccttggccttccaaagattctctgaaaaatcaacttgcaaaatgcaaattgatcagagaaaaagtgtacacatttatttaatgtgtatacacaggagccttcaaaatgaagacccaaagatacaggagaaattgttcatttttatgcttaggttcaaccaagtgtggacatctgtgtagaaatatgattggacaaaaagggtatgatctaatggtaatggactgaggcagaaaacccagcgaggcctggccgtgtagactcttcttggcctctctgagcccacattcctttttttctgggtagggggcaaaactttttctgaaatgggggtcttatgacctataatcaaacaaggtagtcaggcagtttctgcgtggtcagtttttacacagaaaggcagagggaaattggagtaatatttttaggtcttatgactagctttgaggaagagggatcctagtttctatggctagcattggggaagaatgggactgagaaacaggagggcaggggaaggtcagaaaaacttttgcttctgaggccttcattttggggtattgtttactgagccccaacaccacctcgagggtttccaggtatattttttaaagaccttctaacaaatgttccttttatttatacatccatttaattattggtgctagttccaatgcaagacttaaaaaattccacttctaattccccacctgcatggagggcacaaatctccaactcatgatcagaatttcctgcaatccgtatgtcatttaatgaattccactctattcttctggaaatcgaacactctagaaacatagttttccttttagctgcaaacctattaatgctggcagccataaaataaatgcagtcacaactattccccacaaatgaatcagtcagctcagattaaaatatactctttgcatatcactgaagggctcttcctggtcagcttgtaagtgttctgttttcattgcgtggtattcattttccttttagcattgcacttgatttgtgaagtagtgttgactgctagattcccatcattaacattaagttttattgccttaaatctctgtcttatgttcactataaatgttttaagtcaacataatgctagcaagaggtgctgggttaacagactacagttggcatatgattctcatttggggcagggaattgtgcagggttattaggagctttctacctttttatttatttatttagggacagggtctcactctgttgctcaggctggagtgcagtggcacaatcatagctcactgcagcttctgacccctgggctcaagggatcctctcaactccgcctccagagtagttaggaccacaggcacatgccaccatacccacctaattttttttctttttttgagacggagttttgcttttgttgcccaggctggagtgcaatggcgtgatctcggctcactgcaacctccacctcctgggttcaagcaattctcctgcctcagcctcccgagtagctgggattacaggcatgtgccaccacgcccagctaattttgtatttttagtagagacggggtttcttcatgttggtcaggctggtctcaacctcgcaacctcaggtgatctgcctgccttggcctcccaaagtgctgcgattacaagtgtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttcccatggtgaatttatatgttccgccaattcaaccaacatcaaatatttattagctgcataccgtgtgccagatacagagccagacactcaattttgcagacacagtatacctgctgtcctagagtttagactctaatgagggagagagataataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaaaaaaaaaaaaaaaaaaaagactgctttaggatttaaggaagagtagtgtggcgggttagagatggtggttagaagaggctttctagaggatcccaaaatgatgaggagattgtggatggaaagtggtctcttaagcagaagaaaaagcatggaagaaatactagggtcagggaagataaaaaatattacgctgttatgaacaatcaattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgccaaaaaaaaaaaaaaaaaaagaaagaaaaaagtaatggcagtagtagcaggagtagtagtagtaacagataaaacctatcattggcagcaacccaggcaagcatttatttctatatcttgctgatggggttgatggggttagcaattgctatagtctccctagtaggggatttaggagacagatgaaaaactgttagactatttacgtatttaaccaaaaggttccattttggggtattcatcctatggaaatagtcatgaaagtaggtaaagatttagttccagagatgtttattatagtttcttgtgaacattcttatttgaaaagaagataagtgcccaataatatcagattgattacagtacactcaagcggttagcacagatattcatcatagctgtacttgataacagttgttactattatcatgttcttgtgtgagaggtaaagggagataagattaaactttttgatgttataaacaccatcacatacttcaatctaatattttagaagaatatttaatactattttaggtttactgttgaattacatcaacagatgtttgtaaaacacagagcaaaaagtagagtaagttatacaagatcaatttagtcacatctctatgtgagtatgtttgcatcaaataaatactggaatgatatatgtgtgtgtatatatatgtatatacagtatattcaaatgtgaacagtgagtagtgagattacaggtaattttgattctttttgtttgtttgtttaacattatgttctaaaatgtgtatggtaaaaaaaaaaagtagtttttttttatttctaagactagaaaattatttagcaaacaagtggaccaaagatattacagatagcatttcctaaacatgatgtgccttttgtcatggaaaaaatggatgattttgttttcttcttcagcttaatatgcgatataataagctcagtcatcgaagagtgaagtgcagcatactgaaaaagtatgatttggtttcacacagatcttggtttaaatcccagcttcatctctcattaatgatcacatcctgaacaagttaatatgtatgtctcggtcttctctttagaaagctgacaatggggacatgtatgttaagtgactagcacagcgcttaccagaggaccattctcccgctgtagcaggacgagccgcagacgaaacctctcagacaccaaattgtaaaaggaagggctttattcagctgggagtatgggccagctactctctcaaaatccgagctctctgagtgcacaatttctgtcccttttaatggctcacaacactaaagatttcacgtgaaagggtggtgattgatttgagcaagcaggcggtacgtgacaggggctgcatgcaccggtggtcagagagaaacagaacagggcagggagtttcaaaatgttcttctatacaatgtctggaatctatgagtaacatcggtttctaagttatgagttgatttttagctactgggtttaggccaggcaggcccaggcctggtttcgggcctggcgccgggctgcctgtctttgattttacttccttgttgttttttcttaaaacaggtactgagtataaaacaatataaaacaatatgagagggtctctctcttccctcaccacatatgtgagaaaagagaaaatatggctaagtcatgtacttaactgagtattaaaacacatgtcttaccagaaatagcaatttttcaagtgtgtgaaacacattaaaaataaactttgaaactccaaaaatctttaaaatatgtaaattcatttagactttactagaaaaataaagttatctctctgaaattttgttgttaaatatttgtagaaaaggatgtaaagtggaatgaggtctagagagagaattttgatggatgtgtgtatttgagtcagttttcatcccactgaatctttagtcaaatcaaataaaaatgaaggtaatttgtcagcttgcagaatcatgccaagcaaagtcgaaaactgccagcctatgttcattctcatggtttgaacaaaccgaactccaagtaattcattgtttggttttgaattacttatattcactctgttgatcccattttgctttgaaattgtactttcatgtttattttctgtagtccagaatggaggtaggaggaggaaatatctggaaatacctaaaaacatcttgaacataccttaaaagtaacatgtttaggaggtccctgagttagttttattagcacctctgagtgttacagaaatgattgcaaatctccaaactcacagacatttgcccagagtccccacctataatcatgtgctgggagagctttagtataattattaggccagtgtaggacaagcagcagcgtgcacatagtcacatttaaagtgaggatttaaatgacaacaaaaagcaaagcaaaatgacactctatataacttgggattgtttttatttaaatcaaaatttaaaaaattttaattatacatatgtcctggggtatgagtggaggggtggctatggggatgggtacacaggcatgaatgaacacaggagactatgaaagatgcttcagatgccccccggacaaagatggagaaggaaatgttttctgtaccatctctatatgggcagttcagctttctctctgtgcttgttttctctgctctctctgtttggatttgaagaaaaagaggttttttgttttttttttttcctttttcttttgtctctatcttatttattttttaagtagactgtcaaaattttagctgtgattgaagaaaagaaataagacaaataaaattagtgggaaaccaaggagggggaaatgggattgccacttcctcttgtacagagtcagcagttttaatacctgtaaacaaaaagttctttgctggaactctttttagaatggaaaatgggatgaataggtacagcattatcaaaccatttgttgtgctccctttttcttgaattgatggaaaatatagaaataacacaaaccaaagttgacactcttgaaatgacttgtccttagaatttattgtttatctcacggaaacatgaagaaatgtcttcattaatgtttttgatctcagagccccatttccttttatctcccagcagaagtgttgcagtgtcctcacatttggattgagaatttagatagataagaattcaaccctctagtcccatttactgcaattgtatttaaataccagcttaattagctgtactcatcctccttcccaatcctctttgaagtaggaaagtcccattgcttccgtttagctaatgctatgctcataccctagtttttaagctttgtagaaagtacagatatgactgccccatgtgatctctaagaagtctagatatttgatccacagaagcattttgttccatggaggacgtggagtttgttgctttggatttgagcttcatttaaagcatttgcttatttttcatcttgcaaaattaatctaaatcaacttaatgaagggtagaacattgagatatatacctgttaatagtagaataatatgacatggcacagtatccaggtatggaaaaggtgaatagggatagtgttatgagatttttagagtacgttaattttataaagcatgcttatgggaaaagccaaacattgatgacatttcgcagaaaatgttatgttcaggtttggcaaataccaataaggtcagagaaaaagcaatatgaatcagtattaagaaaattataagatagtgtatgtctaggtcatgatctttagtatcatcaataaaaccactaaggatgcctcactatagctgtgagatgggttcggaccatgatatccagtttaatactatttgggagcagaagtaactagatatatttatcctatgatattttacacttattggacacctgttgaatctctgttggcttgagatttaatttgctaagagaaaagcaactgaagttactaaggtaatagacataacatatgatctaaaaattgagagtacgttaatcaaggggagtgagcagaaattattctcgtcaatcatccatgtgtccctctatatccttcacctttattgctgttagatttggaggaaattctgagcaatgttccgtgatcaggggtgaaaagtgtcatttctgggctgaggcagtttatagtcatttgcaccttttctataccactctctttccctgccttctcttctcaatgttctgaaaatcttgtgttctaaagggacttgaataagatggagatagagtgccaacccacattagcatttatagcatatatggagcaagaaatgaacacgtgtgtatgtctttatgtaagttacagatacttatctatgatacctatcctgactattgcaacatgttaagctttccactgataattaaatttcatatataaatagataattaattttgatatttaaaaaatgtaagttacaaaagcactatgctactctgagaggaaattgagaaatactaaagttttctttcatggagccccatagttggaccttcacaaaggcttcaaaagctagtttcctaaccagtaaaagtcagcatgagacacagtgggctgagataacaggcccctcagcctaggggtggtttgctgaagtaggaggccagagcctctggatgagtcatcttcagttgttacgacggcttactctgtggaccatgcaaataatatcattttcgatgtgttccatgatgcgaaaaagttagagaagtaccataggtctttgtatcaggcaccaatataaccacccctacactccagatcttctttccccatactcatttctccactctcctccaagtcctgcctcaaacgagttattattttcacataaaactgagaaggaactgttgaaatgactgacatcttcagcaaataaaatagttgtcaaattaataaataaatgtcacttgaggcacttctgagcttctcaatatgtcttcttttggaggactatttgttggcataggagaagatttcctagcaaccctcaaaatctttccaattaggaacctaaattctattcccaaaggttatgatataaagaggaaacttgaaaatttgtaactgaactctattgaagtatggggtatttcaattgagtaagcccaatatttacctgcatcacaaaaaaactagattttaataatttcttatcaagtgtttatgccatgtaccatatttaacatatatttactcattagtttttcaaaattcttatgaaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaataggatgaaggtgaagttctcagcttgatatttttgtttcattcagtgcaaagtgtcatcttctaccccagtgccaaaaattacttcaaagaaaacagctttttgactaccgacagttatgtacaagaggtgtgatttggggttttaagagcttactttgacacagctcagatcccttttttggtagtgaaaattatgctgttatctcctaaaaaacatcatctgctctgtccccacctctttaatttgacaggtgattccatatccatgtaagagcattttggtgtctgaaaaacaataaaaatcgtcccagtaaacccatgttctattcaaaaaattttggcatattgattgtctggggtaaggttcaaaattgcataaacttccttgccccacaaatcactttgttgcatcgacaataataatcacaattattgatagtaaaataatttggccattctatgaatagtaaggactgcacatgttaaaaagaggcaaaagaatggatagatgatcagaatccattctcagtaaccagagctaaggaaacagctcaagtaaaaacgctcagcttacttaatgctctatagtaattaatagtaattgataacaacttgtagcaattaagatctaatgcacttaatttgcaaatgtactccttaactttgaatacacttttttctctaaggcgaaagtctagaattggagactcttggattcttcttcccattcttttccttcttccttggaaaaaatcagaaacaatctcgaaatgtggcctgttggagctggaaaagagcttagagattgttctagtacagttgtgtcaaactacaggtgaaaactttgaatcttggagaagaccactggtttattccacctctctagccatcggcatgaatgtctattggtatacttggtttagctgcccaatttatggccaagactgggacatgatatggtacaaaatatggtgtttttgtataaagagctatctcttgttccttcgttgtaaggggactgagggcacaagagttctaagactgataatcccatcaacttaatatattaaaagaggttttatatctaaagcatccaacacagtgtctggcctagaggaggcactatatctatagaacaaataaacgaatgttcgaacatagcctctctaaattctatttgaatgacttaacacaaagatcagaaatttgcatagctgtttgtgttagccctttaaaacaaaactctcctaggggaacatatgtgaattctattcagagtttaaaaacagattcatgggagagccccaaaccaatcaaaaacatggcaaggtttaaaaaacaaaaaagacaaaaaacaaaccagaaaaaaaaaattatgaaaagaccctgcctgccaagagtgacttgtttgcaattgaaaacctggagatatgagtacataatagaaacgtggcaatgatcatctgggcaaaaacacaatttgtatgacaatgaatcaggaaatgtcctggaacaccagaagatgaaaaacctgggattttataaggcacattcaagttgctgcgcatgcgtcacaccatgaattttcctgtggtctgacatcctgttaaaagcattggtctctttctaaacattggtagtagaagtgtaccacaacaggcaaccttacatttaaagaaagaatgtaatagatacctgtggaaactgtcaaaagtgtcttctagagctatttttgaggtctcttttattccttcattcctgatctgaaattcattaaggctaagagtgccccttaaattacgttctgctgtatcctggaggaacacctgaagaagttaataataaaccctagagattaggcaagtggaaagaattatgaaataaaacaaagcaaagaaattgtgtaaacaaattaattaattgtctgaaagtgaaagcatgtttgtaattttgcccttgtcaaagaaaaattggagttcattatgctcgctgactgatttaaaagcttcttcccgcgtagcatcaccgggagaatgagtgtgttgtgagtgcaaagcatggatcggttgcagcatcaattaaaatagaaattcattattgaaacctccagagtaaaaggtttgtgctttctgctttgaggatgggaggaagcttttcttttcttatttttaagttttgtttattttttttctctcctctctccaattggtataggaacatttattttggatttccagtagcaggcattctacctttttgtaataaattatattaatacctgttatacattgagcacatgctatataccaggcattctatatactttatcatctttaaccctcagagcaatcatgtggtgaaaggtatccatcagtatcacttgaggaaactgaagctcacggaggtaaaattgaacagctactaagtgatgatgccaaggatttaacacaccctaggtttgtctgactaggaacttctggtctctccaggacacaacagagccttctaaggcaggtttactgtgttgagttgggtttgcccctataacaaggctatcaaagatatatgtgtgtatccaggataggcattctgtattcagttacgtgttggagtgctatcgagagcccagtgggattataggtggaataagataccttcaacacagccatctgctgcatatggtgacccttgtgctctccaaatgagcagaagctcaaccagctttgctgaaatgtgtttgatgagaggatggtgtgttttacttttgtgacatctttccccagaggtggttgcctgaagagttgaactttagagaacaaaaagaaagaaatgtaggatccatttatggtctctcctagaatcatgccatatgttggactctatatggaaagggaggaggaataaaatgaagaaagaggagtacacagagcatggaaaaccataagtacgtgtgatccatgattacatcattgcaccttgcaaaaacttgttgattttagctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgcattccatggtggtttgcagtacctatcaacccatcacctaagtattaagccctgcatgcattaactatttatcctgatgctctctctccttctactccccagcaggccccagtgagttttgttcccctctctgtgtccatgtgttctcattgttcagctcccacttataagtgagaatatgcagtgtttggttttctattcctgcattagtttgctgaggataatggcttccagctccctccatgtccctgaaaaggacatgatcttattgcttttaatggctgcatagtattccatggtatctatataccacattgtctttgtccagtctatcattgatgggcatttaggttgattctgtgtctttgctgttgtgaatagtgctccaatgaacatatgtgtgcatgtatccttataacagaatgatttatgttcctttgggtatacatcttgtaataggattgctgggtctaatggtatttctggttctagatctttgaggaattgccacactgttttccataatgtttgaactaatttacattcccaccaacagtgtaaaagcattcctacttctccacagcctcactagcatctgttgtttcttgactttttaataatcaccattctgactgtcatgagatggagtctcattgtggttttgattttcatttctctaatgatcagtgatgttgttgagctttttttcatgtttgtcggctgcataaatgttttcttttgagaagtgtctgttcgtgtcctttgcccacttttttttttattatactttaagctttagggtacatgtgcccaacgtgcaggttagttacatatgtatacatgtgccatgttggtgtgctgcacccattaacttgtcatttaacattaggtatatctcctaatgctatccctccccctccctgcaccccacaacaggccccggtgtgtgatgttccccttcctgtgcccatgtgttctcattgttcaattcccacctatgagtgacaacatgcagtgtttggtttttttgtccttgcaatagtttgctgagaatgatggtttccagcttcatccatgtccctacaaaggacatgaactcatcattttctatggctgcatagtattccatggtgtatatgtgccacattttcttaatccagtctatcattgttggacatttgggttggttccaagtctttgctattgtgaatagtgccgcaataaacatatgtgtgcatgtgtctttatagcaccatgatttataatcctttgggtatatacccactaatgggattgctgggtcaaatggtatttctagttcaagatccctgaggaatcgccacactgacttccacaatggttgaactagtttacagtcccaccaacagtgtcaaagtgttcctatttctccacatcctctccagcacctgttgtttcctaactttttaatgattaccattctaactggtatgagatggtgtctcattgtggttttgatttgcatttctctgatggccggtgatgatgagcattttttcatgtgtctttcagctgcataaatgtcttcttttgagaagtgtctgttcatatcctttgcccactttttgatggggttgtttgtttttttcttgtaaatttgtttgagttcattgtagattctggatattagccctttgtcagatgagtagattacagaaattttctcccattttgtaggttgcttgttcactctgatggtagtttcttttgctgtgcagaagctctttagtttaattagatcccatttgttagttttggcttttgttgccattgctttttgtgttttagacatgaagtccttgcccatgcctatgtcctgaatggtattgcctaggttttcttctagggtttttatggtttcaggtctaacatttaagtctttaatccatcttgaatatcttgaattaatttttgtataaggtgtaaggaagggatccagtttcagctttctacatatggctagccagttttcccagcaccatttattaaatagggaatcgtttccccacttcttaatggggtggtttgtttttttcttgtgaatttgtttacgttccttgtagattctggatattagacctctgtcagatggatagtttgcaacatttttctcccattctctaggttgcctgttcactgtgatgatagtttagtttgccaatcgcagccacttttaacactgttactctgggtaggttatttggtctgagtgtcagtccctccttctgtaaaatggggggaattcctgaaggacagtgttaggatgaaatcacattacttataatgtcgaattcctctgtcaatgcttatatgcttctcattcattatttctaagtcaagcatttttaaagcatttaacatgcaattattcatttttgtttataaagtgaccctgtgaacttatccctattttacagttgatgaatctgagacactgagagattaaataacctacctaagatcatccagctataaagtgatcgagacaggttttgtttgttggttggttggttttgagatggagtcttgctctgtcacccagcctggagtgcagtggcacgatcttggctcactgcaacctccacctcccagtaatggtgcaattacaggcatgcaccaccacacctggctaattttttttttgtatttttagcagagactgggtttcaccacgttggccaggttggtcttgaactcctgacctcaaatcatccacccacctgggcctcccaaagtgctgggactacaggtgccccgctcaagacagattttaaacctagcattcttgctccagaattcatgctgttaatcactgctattctgcctctctgttgactctcagaacctctcttggtcaaagcaagaaggtatcgaacagacttcctgtgctgttttataagctgcctcaaatccttccaggacagggcaatgtctatataaatagatgttataaaaagtataatctaggccctatttatttttctctcagattcatgtctaattcataccagttgagccttgctatttgagtttcacttaaaagcattctgacatagctcacctcccctctttctcttatattgctacccataaggactagagaaaagatggataacataatcctgagtctatgagttgctagaaattcctcattataattgtgtgtcttctggcaaaaataaataaataactttctcttttaaagccacttataggagacaatgcacattctgtgttttttctctgtggctgtgcatggacacagactcttctgcccttctcttgcctgttccttgattcctcatgtttctgtctggtgcctacctgagatccaggtattcctctttacctcgtcgtcttgctattttttctagggacttttcttctcccaaagttatgttgaaacaggcaaaacacctagaaatgggtcatgtgggtgagtagaggggagtgagaaggagagggaaaaaattcccaaagctcatattaggcaattacagttctaatgaatagaagcagtctattcaggcttctggcaatattttatgctcacctagtgtagtctgtattcccttaaatgggtaaaagatgccttaaaaagattgctttgaaggatgaagagacttgaaacaactctctgaacaaaagaacttgtttattcattcatttattcagcttgcatttattatgtgctgggtattatgcatataaatattttcttaagttttgtttttaattaacacataatagtatatatttatggggcacagtgagatgtttgatacatgtagacattatgtaaaaatcaaaccagtgtgtttagcgtattcatcacctcatatatttacctttttcttctggtgagagcattcaaaatcttctcttctagctattttgaaatacaacaatacaatatttttatccctagtcaccctgctgtgcagtagaacaccggagcttattccctccatttaactgtaactttgtacctgttgaccaatcatggtccctattctaaaagtgtcacagcctaggtaggttgacaaacaggtaaatcaggattacaatacaaaagtaaaatagcctggatcaaggaaagcacaggttgttatggaaacacaagagaggacatgtaaataagattgagggaggttcaagaaggcttttcaggagagatgacttttgaactgagttttaaagaccactgggtagacaataggagaaaaaaacatttctggctaagaggttagtgtggatgagcaagtggctctgtatagctggaggagtgtctgaattttccaacatgaaaaggaccacaaacttggtggaatcaaacaaagattttttttttcttttgtcacagttctggaggttggaagtccaaaatcaaggtgtcagcaaggctggttccttctggaggttctgaaaatgaatcccttccatgcctctctcccagcttctggtgctggtggatgcatcactctgatctctggctgtctttacattgccttctctgtgtttctccttttctgcctgtatcttctcttcttctaaagacacttgccaggccaggagcggtggctcaaacctgtaatcccagcactttgggaggccaaggcaggcagaccacctgagtttgagaccagcctggccactgtggtgaaaccctgtctctactaaaaatacaaaaattagccgggtgtggtggcgcatgcctgtaatcccaacgattcaggaggccatggcaaaagaatcgcttgaaacccaggaggcggaggttgcagtgagccaagattgtgccattgcactccagcctgggcaacaagagcgaaactcatctcaaaaaaaaagatacttgccattggattcagagcccacctagataatccaggatgatctcatctagacagcctttactaattccatcttgcaaagactcttttttcaaataatgacacattcatacattccatatcttttggggagacactatttaacccactacaaggtataaagatgagctataggcctgatgaggtaggaaagaggcagggcaaggtctcccagacactcatgtacctgacaaggtgagtctcaagagacacaagaaaaccttggaactgtaattgtgaaattgacatctatctctggaaaatgactattactcctaatgcctctagccaaagactatcagaaacccacctgtagctgatggagttgcatttgttactcattgtttcgatgaggacacacatcatgaggaaccatcatgtctcagctagagggtgttggagaaaacctattgtaggaatttgactttggttgggtaatatgaggaagcgtccaagaaagcctagttcactttagattagatgctgtcagaaagcagaggcaattctaaaaatgtgtatcttgattaaatcttctctgtatggaacaagagtgaggataaagttgtaaatgataaagaagtagcaatcactagccaagagaggggactgtttgctattttgtgggtgaagcagtgactttgtttttctgtgcattgattaaattaagatgtagctttgttttgactcagtttatcatggtctcagagtgacttcttctgagattggtattctgtgacattgctcatgtgcaatagaagaataacaagatctagccatgagtgccaggttacgttccagatgtcacaggctgctcttttgttttgtttttctttttcaataccaagtgataagaatgagcatgcctaaaattccagcagttgtaataaaatacatcaaccaaaaggttcagactgtcctgtaagacccataataagagtctcaatgtgttcttaaaagaacattctttcttagcctacgtgaacatccttctctagacttaaattacttctgacccacatgttgggccgtatctattttaaagacaagaggagctaactgcaaagttccttgtctggtaagctgtttcatctgatagttgtaatagcattttctcccgtctcactgtagggcctaaccccacaagcatccttgtgaagaaagaccccacagtcctctttttaagctttctccctccctttcctggggtgccttatctatttaaatattagaggtgagtcaaatgtaattctctttaatgaaaaacaaacaagtgatagaaccctaaacgctcttttggcaaagatcccttcagaacaaacaatcttcttttaaaagaagtcagagctaggaaagggccacaggagagcagggatagccaactaaactatgcagcaggcttctctgaaaaaaagtgagtgacttttttggtgtggcaagaaaaaaaaaaagtaaagtttgatataactagtagtccttggaatgacaagtgacaagagaggtctcttccctccctatagtcccaaggagaaaagggctctgtaaaattaaaggcacaggtattcagttgaaaggacatatttttctcctctaacttataattagcctgcgatactggcttctgtaggctcttatgaaggcaaattgctcaggacagtgactctggcgatgtcagtcatacaggcaagcactgggatatctatcacaaacacatgccagttgtcatcttccaaggcatcacctgattgccaactcaggtcaggaagaaatcattcctctttcttcttctgtgatgttacttatctgttgcaacagaggagagggttagcacctttcatgacatattccagcatcctgttaaattgatcagaagaccaattgcacacagtgtcttctaccattgagattggaaacacagccaagggtggagatggtcagtgaggcttcccagtgtcttgcaagttccaggtcagttgtttatgcttagagtcccctgacagagagatggatgtgttagcaggttctagggcctgtggtttcccttgtggaaatgccagtggaccatgtgtgctccttgggtatcagggtgattgggcttgggttggttgtggccacagcatgaactggagagtcggctgtatttggcatgacaaggttggcacaggccagctgagaccttgaaaaatttggagctgatgcagaggtgaataaacacattgaaaacagaagctgcaacctcaaatttctacagggaccagacaggtaatatgcctgagtgaagcaggccaggtggcaaattgtacagtgcaggccccaatcaaagtgcacagtggccactcagctgccactggattataattgtgtagagatgtgagtttagagttgtcagcttttcaagagaagccaacagtctggtgtgtatgttaaatcccctgattctggcatctaattaatgcccttagcagtccaaaccaaacaatgtgtgagctgccatttttgcaaccttgagctaatggtgttaacgtccagtttctttgtttcataacatctatggaatggctttgtgaatgcaaatgttgaaacattgtgagtctcatccccaacagtgaaaataaatacaaaatttaggcaaaaaataaaaataaaaataaaaatacttcttaaatgtcacagcgcccccatggggctggctggggcaacaaattaagggacacagctgagctttcgattctgtcagtaactaagtagtaatggtgcctcagggggtctgagtcattgaacaagcgctacaggatagcacaatactaggtacacaaagtaggcgagcacaggctccctacctttgaaaagtttataagttcattaacagtattatgtttccatgcactggagcattagaggaaaaatgccacgataacatctaaacaagagtgcagtgggccctgagaagtatgatgattctgtttccttctttaaagcatctcttcttaataatgtgcagtagtagagagaatagaaaagcagcatgatggccatgtgacttgctggatggatgccatttctgttggatgagattggacatcaataggtaaaaccaataagaggttgtgtgcattttcagattctggaattctggaatctatgacatttttggaaaaatagctctcctaagacactggttctaaatatagcagtgggtttcaatagttctatgaattgaaatcaatagtactaaggagcgaagagcctagatcactctcccaagaatcattgcttagatgagtggttctcaaagtgtagtctctggccaccagcatcacctggcaacttgttacaaacgcatattgttgattctcattccacaactattgaatcagaaattctgggactgagtcctagcaatctgtgttttaaacaagccctccaagtgatttaatgcatgccaaatactaagaatcactgttatccttggaagaggggaaagctcagataacccacaattgaggtctagagatgttcatagtctcttctacaagtaagtcttaccagtgagctatagtagagataaccaagatagcatgtagctggaggagctgttgcttatttgactggattttttggtcattttttctttctcacttatgtgtttgttctccacttgttttcaagccccattgatttctgtattagctttctattgctgctatgataaattaccacacattttcatggcttaaagcaacacaaatttatgagagttctgaaggttagaagtccaatacaggtatctctggataaaatcaaggtgtcagaattagagcaaatcccttcttggggcctctcgggaacaatctacttccttgctttttccagcttctaaaggccacctgctttctttggctcatgggcccttttcttataaatgcagatgttgtttttaaaaatgaacaatgttaggctgccttcctcgaggggctgtctctcttgttctcactcttctgcctccccttccacctttaagtatcctgtgattacattgggtgcacctggatgataggcaagctccctattttaagatcaactgattagcaaatttattcccctgtgctatagaaggtaccatattcacatgcttcaagaattagaatatattgtatctttcatgggggaggtacattattctgcctaccataagagattgtattcggagggcttgtttttttttttgttgttgttgttttttcaccaggaaatggagcctggtgaaaaatgtaatatatagcctcttcctccacactactaaactacctttctgtgtcctacagagactgtgtaatattcactggtgaagacataagctttgtagtcacaaacctgagttgacgttcctactctggcacttactagattgatatggtttggctgtgtccccacccaaatctcatcttgaattcccatgtgttgtgggagggacccggtgggaggtaattgaatcatgggggtaggtatttcccagggtgttctcctgatagtgagtaagtctcatgaggtctgatggttattataagggggagcttctctgcacaagctctctttgcctgctgccatttcacgtaaggtgtgacttgctcctccttgccttctgccatgattgtgaggcctccccagccacatggaactgtaagtccaattaaacctctttcttttgtaaattgcccagtcttggatatgtctttatcagcaccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatgagtctcccaactgctagcgcaagtggtggatagattttcttttccactagatttacttcctgatatacacatttatcactcaagcatggactgttcatcaagtcattttccatctataaccccagctgaagcctgacaggttgtgtgtttattatgtactcttaaaaaactggagctcatttgcccctgctgcggggagagcagactcagacagatagagggataaggtcattcagtggaatgcccattcactgcagtcaagcctaaataatagagaggtgtaaaacaaccaggaaaagctctgattattgccagaaatcaaatattgatcagatagtcccctaacttaccaacttccctcttaatgatctgattcccatgtattcattcatcagttagttgagcccctcctatagaccaagccctgtgcatggctataaaaaacagtatgtccatgcccacttccccctctacactcaatctggagccatgagaaattaaataacctttaatttctgaagatcgggtgctcttataaaacatcagtacttataattgtatcctgcagtggaaaattgtgcaataatctttttctgaaggcatggccatgaattgtactatattactccatctatcttcttttaacactaaacaaaatgaagagaatacattgtgcatggcccctagaaatttaccttcaaatagaaacaaagctgctaactccacacacacatgatatgctgaaaactgaataaatattgaagaatctaaattcaattaattagcaagccaaatcttgcctcaaattatgttgacattatttattcctttgttgattaaatgagttgcctcttaagccaaaagagaagatcttaagctcttgtttcttcattccaggtctcttctctccaaggaatttgggaaggagcaagcacagcagaggccagttttactgcatgctggtgctcagagggaatagggttcatagagtagaagacagtgaggagagaaccagtaaggaggttggggagctggatagcatttacagcatgggttcattgattcattgggaggcttataaatttcctatgcatagaagcacctgtttttaaacagagacatgtattcaacacatgccttcgagaactaattggaaagagtctttgatggcctatcgttttgaatttgcatgaccagaactccactatccatgcaaacacagtggacttgctgcaattgtcctttgacttaggcaactttaacaatgcaggggaggaggggtgagaagaggctaggagaggaagtgtcagtgggagaagccaagaataattgaagtagtgtgttatttcttttttttttaactattaattttttttattattatactttaagttctgggatacatgtgcagaaggtgcaggtttgttacataggtatacatatgccatggtggtttgctgcactcatcaacccatcatctacattaggtatttctcctaatactatccctcccctagccctccacccacctgacaggtctcagtgtgtgatgttcccctccttgtgtccacgtattctcgttgttcaactcccacttatgagtgagaacatgcagtgtttggttttctgttcctgtgttagtttgctgagaatgatggtttccagcttcaccagtgtccctgcaaaggacatgaagtcattcttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaaaaaaaaaaaaacaaaaaaaatcatgttccctaaacacaaataacttcatctgctgcccaagcaaagaaacaaagagatgtctactaaaggcaaaaatgccaatgtcgtgcttcctgagcacagacattgcactgcacagaatggaccattttggagactttcaaagacagttttgactcagtaatctcctatgctgactttattacctaactgtgtcctgtggaggattaggtgatagtggcaggttaggtccatgggagattggattccactgtgatcagcaaacagaataaccagcatgtgtgaagtgacttttgtcagaggagtgatgaggagtgctctctgaattcagtgttttccctctttaatttttgctaatcatgggtcatttatctgtgagctactgcattgtttccactgcctgctttccaaccagggataggttttatctcaaaaaacagaagacaaaacctcttaacctaaaactaagactccctctgggagattccaaagagagacggctttgatgtaatgggaagggagctgatttagggtctaataaagtcttctaccagctgtgtgatctttggcagtttctagttccctaggtactatttgcctatctatagaaatggggttaacagcacctactgctgaagttggtatggacataatgagataccatacatgtaaggaaatgaaaagtattccacaaatactccttccctgagcttgttccttcctttcaccaaaacacacatattccatctttcaactctcctgctctacacgtgtatgcttgagtttagggccctggaataagcaatcctgggtcaacatctgctctgcaaacatcaaaaagtgtgagcaggggcagcctagccttggtattgatgtgtttcccatccacagccacattcaccattagacccagtattagtcactgggtccccggggccagcatttactgttgccttcaaaaatgcagactcattactaacaaaagtggtatgtccattattatgacctatttagtggcccagcaaatccccaaattctattgagccacatctgtctaccgaggggctctgcggttgattgtctgagacggatctgcttgcaaagaggctgatttgggaaagttcaacagccccacttagttgctctgtgacatcctgacttcctacaggttacttctcatattgttgggtgtttgtttgtttgttagtttgtttgtttgacagaggtctcactctgtcaccaggctggagtgcagtggcatgatctcggctcactgcaacctcctcctcccaggttcaagggattctcctgcctcagcctcccgaatagctgggactacatgcacaccccaccacaccaagctaatttttttattttttagtagagacgaggtttcaccatattggccaggatggtcttgatctcttgacctcatgatccacccgcctcagccttccaaagtgctgggattacaggcatgagccaccatgcctggcctcaatgttgtgttttaaagttcagctggaagatacccttattcctaagaaatccactaaagaaaactgttcttccaggagttccatttcattctctgggaagggtccatcccttgttcctgttccctttcctctgaattctataggacatatcacagcaccttcttgctgcctccttgtttgtgtctttcattaaactgtaagctccacacatgcagggactgtatttattttttcagagatgtgtcttcaacactgaatgcaacagtgacacttgacaaatatttttcaaacacattgaaatgagtttgatcaccacctgggcattcacagtagtccagaggtcccctgcactgtgagtgtgactaaagctcaggaaagtcagaaaggccagccaaggaaggaagatgctggcaagactcggaaagtgcaggagtgtatgagattgaatcacctggacaggggcacccaaacaaaggcgtctgctggctacgtgactttggttaagttgctgaacttctttgtccacagtttcctcaacactaaaacaaggagtaatcattatatctactttatagggctgttctggggattaaattagttaatatttataaagcatttaaaattatacatggtatgaaatgagcacaaataagtgggatgagggagacataaacaaaagttcctaaagtggaggttaattcagagccaaagacattgcctgggcattagaagtagtcagacatgaatttgagtcccagctaaggcatttatcaactgggtcggccttgaagaagccgcttgcattctgagtcttgctttccatagctatgaaatgttctcaatcacagttatctcccaggattgttaagagaagtttcctttaaatgttcagaatagtgaatggcatttcttatgtgcctaataaatattaactcatctactgccatcccttcctttctttccctctcattctttctcttttcctggcccataactttctgctcagaactggaaacatctttgaaggagggagaaggagcatgagagtcaggggcttgtttacaaaacaaaacatggaaatagtaaaaacaacaaatctaatagtctctgaaatgattttgtctcccactaggaccagaaaaagcagcagaattttatgttaatggattcggtggaaaatacggctttaatgaaacattgactatgattactctgttgtcatttctctgaatttctggtcctctttccatctctcttttaagaagatctgaatggttatttctcaacacaccaggattatgttttcttcgtcaagagtttgaggaacctagggtgcagcttgagctgctgagctgtctgtctttattctgacaggcgtggactccagtgtttagctcaagccccagggactggcttttgaacagcagctgttctcagtgaaactgaaatgcgcagaggggaggggaatagtacaccctgggaagtacagggagcaggtaagttgttttgctaatacatccctggggaagtttctagtgtttctgggcatggctgagcgcacagctcataaaaaatgcaccagatcattgttggcatttgatgtcagaagaagctacagtaccaagagacatggactgtctggtttcctgtgacatccaggtgacacaccaggtttccactgcttttcgtcattagcccagatgttcccagttacttggacagagagccttgtagatccctgtatatggagtcttccttcccgtggttcattagaaatggcaaagccaaactggcagtattcttcaatttgttgataagagtgcttcagtgcatgtatttacaaatacacattgttgttttcaatttgtttattcagtgaatcaaaatagcaaaacacattaactataagacaagagaaggataaggaagtaacatctattgggtacctgctatgttccaggcaatgacagagctgcttgacagaaaatgtttaatgtcttcctcattgtagctacatgtggtgtttcaggtatgattactgcatgttacagtgggaagtagcccagcattcttgaaagagtatagggtcctcactatctgtgtgaatttgagtagttacttaaaccctctgagctttattttatttctgtaaaggaatttaacaaagtggctaatagggtgtgtagggatgaagggacttttaagtttgctgaaataaactggaaatagattagcaggagagaaggcgtacaaatttattaacatgcagatgtgcacaggatccacacaaaatgggaagactcaaagaaaggccagatagttgaaggttaaatacccttttcataggggagagggaaatgggggacattgccaattttagagaaagagtaaataatttttagaggagatgagtggcctggaagaacagatgatagcctgggacaaagttcctctgcactatggggcaggtgatgacaagctataggaaagtgagggacagaactgcgcttcaaacaaaggttgttttattatacagataaagtctctaaggtaatggcccttagaagaataatgggaagaacaggtgaaaactctgtctgggtgtgttgtgggtgccctggaggtagagacttcttcttatctctcctgcatcagagttaatcttctctggttagtgtagatttcagggagcggtcaaagaccattgcattccttctggataaactttcttctggtgagagaacttcagagagagcccctccctacacttaggaaaggaatgtggggggtggggaaagctgtgcaggagaaagtcagagaaagaccttggttctgaggcctttcaaccttctttgttcaaagcaatcagtatgccaaagtaccatattttggggtatcattttctgagcctcaacaattgtcatgaagattgagtatgattgtaatataaagggctaacatttttacttgacctacatgagctgatcagtactgagagctcctcttacaagaaatggaccagagagggagggaaggggaaggggaggaaagggaagggaagggacaaaaagaaagaaaataaagaattgaggttcaggaaggttgaataatttaattcgcccaaaggcttacagctgctaggacgttcagccaaaaattacacccaggtctgatttcaaagacactaaaaccactgtttacttatagctacttagtgcaccccatctcatcccacccaatgccacctaactcccacctctattgtgagataactacatgcacgcactcatttggtaagtgggatcctggtgcctatttgactgacatttgagagttagcacatacaggtggcacaggtggtatctgcacagaaggaggaaggtggtgctgacacctctggatcttacacttgggtttagaacatagctggtcactaaagccacagggtagtggcagaacatttggatacatctttaaagactcaattagtatcccctcactgagtccccatcttattcattggttagccccctagactgaactgtcaaaaatgttctaagtctccttgtgttctctttatctttgtttttacaatcacaacacaataacaggagatactttttaatgaatgggcaggaactctccactgagatgtaaacatgttatactgggaattctgctgcagggttaatttatgatgatggagtcatctatatcatagctgaaagcaaggctttggggaagtgaaacccaggaaaggtcagttgtaatgcgcattgtctatattttaatgtaaaataccaattttgttgggaaaagggtggtcgggaaagaggtttgatccaaaaggttggaagttggggaaataattcaaaaagaaaactccaaataaacaacagagttggctggtcagttagccaaaggacaccggaggattcctgaaggtctgcatgtggtgagcacaaacttggtagggaaaaggcaggaatctgggtggggagaaggtactagaattcacaaggaagactcgtaaaatggaaactacggttgctgaaacacgttgtctactctattaattttctgccaaacatttcatgtgcttttagttcttcattgagcatgacatacttcaaatactcaaacctatttccttcttgtaggaatagctaggcatttcctcccacggtccaaggtgagactgaagataagtagaatctccacacttatttgtttactttggtccagactatagagtcaggttaaaagccatctggggaaatagccagtagccaatgcttattagcgtactacttgggtaggtgggaggatgcaagagctgtcaaacagcagccatcctgatgagaaagtgaagaaagccagaagcagcgtctcttctgtggcagtcacacagggtcccttgatactcagcccccaacatgagattgcctcttaggagaattctagaggttaggctaggcttgagacattatagagaacaggttacagcaccccatttttactttattggtaactgagaaagtaagatatattcctagcctcccagtcttagtagtaagaggtacttttaaactgttaatttttatgagcaacacagtggtatggccggcccttcctcctccttcagggagttcatttgatgtagtttggttgattcccatgcatgtggaatagctatgacatcatcaaattaagtgtacactatgtgctaacaattatcggggtgtcaagagtgaaacattcaggtcctattggcagttctaataggtgaatctcatctcactgttttatgtgttcagtgaagtaaatcttcagtaagtctggagtagctggggaagccttcgccaagaggtgaggtctgagctgggccttgagcattgctgagatctgaatgggtggaaaacagaagagaggtcattccagtcaaaagcaagatgtactcaaaaaatagcaaggaaaaacagatcacctggatgagatagcatttggggaagggtaagactatagtatggttggatttattgaacaggcacagtgtcaggaatccaactggctactttatatacactacttggtgttttatcctgcaaagtaaccctaataaccagtagcatttgctgagagtgtatgtgggtagcaggcaatgtatgagatgccgggaatacagagaaggatgattcgatgtttgccctcaagacctcagaatgtaagtctaggatatagtaacaaaataagtttattctagtataataggaatatatacactttaccaaggaagcatagagagcagaaccatttgctttgcctgctagatttcaaaatgacttctcagagatggtgagttctgagctgggtggtgaaggatgtgtaggagtttgtcagataaggagatgaaacaggcattccaggaaaagggaatagcaagttcagagacttggtatagtcctaaattatgtttgtcttcatttcagctagtgctatttcattgttgctggagataacacacacttggattccgttacgtattttcaccttgccaacttgctttgtttgcagaccataatttctgagtttatctctacagcaggttttcagccaaattgctctactaaaataaccctaaaaatctatcacctctgttttctgctgctgtcactggctgtttgtgtccttacttttcagtcaacctcaatggagactggaaagagaaatacaaattgccccagaaagagaacacaggcccctctcttcagcaacagggtgtgagtggatggggaccattatcacattatctacacagacaccgttttaatccacattgccaaggaggagaggaaaatgcatggccttcacagaacatcattaggagggtgggccattgtgcagcatctattgttaatgtcaatacctacaaacatgtccagactcttccattctttagcatactcattctctgagtggtattttatgtgtattattctctgagaggtaagcacggacaagtataattccatttttatgtaagggaaagctgagtaaagaagatgcttaaagaataggtggatagaaaaatgaaatgacttcagctcataagcattttgagtacctattatgttttagtcattatggtagaaacatggcaaatggatataaacaaaaaacatataattccatgcctctgttcagattgttgtctgcccctgagattcctctttttcccactccccttgactaactcaactagccctgctttttgtttgcctgtttgttctatttattttttggaggacagggtctcactctgtcacccaggctagagtgtagtgatgcaatcacaacccactgcagcctcaccctcctgggttcaagtgatcctcctgcctcagcctcccaagtagctgggactacaggcatgcaccatcacacctggataaaaattattttttgtgtaaagatgaggtctcactatgttgcccaggttggtctcaaacttctgggctcaagcagtcctcctggcttggcctcctaaagttctgggattataggcaccagccactgcacccagtcaactagccatgtcttttggtccaacccaatgttgcacctttgcataacaaaggcaattaaagaccacttcttccctcctgccccctgcaaaaacctaatagttctcaaacacattggttcatggaactcattatatatgaaaacccatcaacatccacacaattagcaaacttaaccctctgcagggttgacattgagttggaccttaagatatattcaaggctagttggctgggcttggcttgactcccccttagctctctctataaaagcaatgattactgtattatattggttttcaaagaattctgtcccacattctgttctacttattaccttctttgcttgactgtgatagattgaggccatctttctgtctgtccctgtattaatacattcaggctgctgtagcacaataccttagcgtgagcaaaggaagttaaagaccacctcctccccctgccccctgcaaaaacctagtagttctcagactcattggttcatagaactcattatatatgaaaacccatcaacatccatgtaattagcaaacttaacacacttgaaaatgctacctttcaagtcagtattcatattaggcagactttggagatgttgtggattctgcttcataccaccacaataacgtgattattgccataaagtgagtcacacaaattttttcgtttcccagtgcatataaaatttacgttgacattctactgtagtctattaaatgtgcaatagcattatatgtaaaagtaatgtacaaaccttaattataaatatttattgctaaaataatgctaaaaaattatcagagccttcagagagtcataaccttttggctgatggagggtcttgtcttgatgttgatagctactgacagggtggcagttgctggaggttggggtggctgtggaaatttcataaaataagacaataataaagtttggtgcatcaactgactcttcctttcatgaaagttttctctgtagcatgtaatgctgtttgatagcattttctaaatttatttcaaaattggagtccatcctctcaaacccagctgctcccttatcaactaagtttatgaaatattctacatcctttgttgtcatttcaacagtgttcacgacatgtttaccaaaagtagattccattttaagaaaccacttttcctcatccataagcagaaactcctcatccattcaaggtttctcatgagattgcagcaattccatcatatcttcaggctctacttctagttaccttgttctttccatcacatctgcaattccttcccccactgaagccttgaacccctgaaactcatccgtgagggttggaatcaacttttttcaaagtcttagtaatgttgatattttgacctcccatgaatcattgatgttcttcatggcatctagaatggtgaatcctttctagaagaatatttcaatgtacttcgtccagatccattagaagaatcagtgtctatggcacctatagccttatgaaaatatttcttgcatgataagacatgaaagtcaaaattattccttgatccatgaactgcagaatggatgctatgttatcagatatgaaagcaatcataatcttcctgtatatctctttcagagctcttgggtgattaggtacattgtcaatgatcagtaaaattttgataggatgttcttttctctctctctttttttttttttttctgagcagtagctctcaacagtaggcttaaataaaccatgatgtaaacagatgtgttgtcatccagactttattgttcctttgatagaacacaggcagagtaaatttatcacaattcttaagggagccctaggattttgggaatggcaaatgagcattgacttcaacttaatcaccaactgcagtagcctaaaacaagagagtcagcccaagactacaccttcgtccagcagaagactgttttgtctgcattgaaaatctagtgcagccatctttatcaatgatcttagctagaacttctgaatagcttgctgcagcttctccattagcatgtgctacttcaccttgcacttttatgtatggaggtgacttctttccttaaacctcatgaacaaacttctgctaagcttcctacttttttttcctacagcttcctcactcttcttagccttcatagacttgaagagagctagggccttgttctgggttaggctttggcttaaggaaagattgaggctggttggatattctgtccagacaactaaaactttctcatgtcagcaatcaggctgttttgctttcttatcatttgagtcttcactagagtaggactttcacttttctttaagaactttttctttgcatccactacttggctcagtgcttggcttagcttttagtctatcctggcttttgatatgtcttcctcaccaagcttactcacttctagctttttgtttaaagtgagagacatgagactcttcctttccctgaatacttacaggccattgtagggtcattattgacctacattcaatattgttgtgtctcagagaatagggagacccaaggaaaggggaagagattagcgagtggctggtcagtggagcagtcagaaaacacacatttatcaatccagtttgggcaaggtgtgtggcaccccaaaacagttacaatagtaacctcaaagatcactgatcacaggtcaccataacagatataataataatgaaaacatttgaaatattgtgagaattaccaagatgtgacacagagatgtgaagtgagcccatgctgttgaaaaaaaatagtgtggatagatttagatttgcctaacttaaggttgctacaaactttcaatttgtaaaaagcataatatctacaaagtgcaataaagaaaagtgcaataaaatgatgtttgcttgtagttttaaagttttgtatgaaaacagtagttggataaattgtttgcctaagcctcttttgtagtcagagggctattgtatgtacttggaaaaagtgtacatgctagggacttccagggcagcttgcatccctgaggacgggactaaaaataacagagtcccctgctttgtgggacctaaagcttgtacaatttgtgtgtgtgtgtgtgtaacgtcttgagtaaaaagaattcaaaatataaaaatgatttcatttaaaatgaaaaaagataatgaaaaattacagattttaagaagttggtaaatatcaccgaaatggataaattaatttactatttgcaactaactgcttgacattcttctataacacttttttctataaaattaataatgttcgctatgaatgccttttcatgtgaaaattctgtaatattcctttctacagataggatagaaaggtaattcagtctttcctctggcctggttcgtcaaactttctaaaaaattatggatagtttttagagtttatattggtaaatttaagtgaatttttaaaaaatgttataacttctggcaaacctctatcaaagtacaaattctggtcctgggtgaccagagaggacccctaggtaagacagcactgggggtgggaggagcatttctggaagccattttgacacctggacagtagcaataacttaattctacaaggacaagattgtaagcttttttttttttttttttttttttgagatggagtctctctctgttgcccaggctggagtgcaatggcacaatctcggctcactgcaacctccgcctcttgggttgaagccattcccctccctcagcctcccaaatagctagtactacaggcatgcacctccacgcctgggattacaagcatgtgccaccaggcctggctaatttttttgtatttttagtagagacagggtttcaccatgttggccaggctggtcttgaacccctgacctcaagtgatctgcctgccttgccctcccaaagtgctgggattacaggcataagccatcacacctggccgattgtgagctacttaaagataccccaccaaagaacttaaagtgttccatctcagcaccctggccctgtgttgtcaagctgctcccccttccatcatactgtgcactgtatggtgcctctttatgaaccagacgctgcttgtgcaacagaggctgatcccactgcagagactgtatttgtcttctctttattttactggaagtctttgccaccatccggctggtaattgctccacaccacttctgaatcgattgcttttagagttgttgagcttttattactactactcattggggagagaagagagaaagaagcaggttggcctgggctctgcaagagacggatgttgtcaaattgtctttctccagctgttgaatacaactcataatgctattcaataaaaccagaaagaaaatgagagtacaagggaaagaagagatgtcagaaagagagaacaagagaacatacgagtctgccttctcttggaatagacagcaaagccatattgtgatgttgactatatcatgcagtaatggtgaacaaatgtagcaagaagtaaaagacagagctatttaaatatatctgtgggcaattgcacaaatctgccacttttgtaggtatactgatgtttcctcattcctggagctgagaaaaagggtctatgttttgctttattttatttctttcatttagtttggtaggctatgtaatttgattcaagtatgatagaatttctccttagttatacacattactgttattttgctagtaagtggctttgtatccacaatcaggacactcttatgaactgtttacatctgctattgactgatctcgttgcgtttcctcatgctttcatcaaaaggtagcagttggcagggccattcactggagaatgaggaacacgcataattagatttagtgaagaacaccctcattccaattggaatctgtctttaagaaaagaaaagaaaaaaagctccaggttaaggagcttcgaaagactgaatactgatgtaacttttgttcatgctaattactcacaacccagataatacttcgtttaatgattttatcccatttgttatcccctataacattcatctgcataaattagtttcttgtcaacctttcagaaagggtttaatgacagttcatggtgtttacttattttctaaaagtagtctaagtgagtcattataaattgaacattcaagttaaatttgtctgaaacatatataagtatcatataaatttcagattttacacagggttctcctctactaagcaggtggaatataccccccatttcagaatgccagtttaaattacttgcctggggtaaaataccaaatcagagttggacataaaacccaggtatccttattctcattctactattctaataaccagatccaatgctataatgctgcaaattataggccctatttttcgagtaggatgcatgtgaatgtcatttgtctcttaaatgcatgaatagtgtcttcccttgtggtcgctctactgcttccagcctgtcatgtcaagcagcattgcctttattattgaaatgaagacgatacttagatcattgatctcaatggcatttggcaccataagaactaccagtctgttgtatcatataaaatgatactgcctggtatgcaaatcagccagtgtgtcaacaaaaatgctggcatcagatagaatgtccaaattgctatcactctgccagttttacacctacatccctattagttcctgtctaattaccaatgataaaagtactttgaagtcccactgatttccatgtaaatatcatacaaatttggatttgctttaacattataattccatcagcttagaagttaaaatttagaaaagctgtagttcattagtttaagtcacttcaaaacttaccttgcttagttttcagatagactcccatcctatacttctaggactgtacaaataaaaaaatgaattaaaagacatttcttgatgggtttaatgttttctactaattattttgacagacagtcataatctgttctgagttcttcttttctccttccatttcaattcttcataaaacatggaaaaaactttggagactgaataagatctatggtaatccacaatagatgaggccctgaacacaacatagggaaaacatataacccacccccaataagctcaacttactgtaaactcttgaggagtaattagggacttcagcagtctctctgaaaaagccaacgcattgtaaaacccttttagtttttacatgaatattaattctttgaaagtagatgaaagactttctttaatgctaaattcttatccatagagaataatattagagcgaggatctagtgtattattcccatttcatgaataggaaacggagaagtagagaattttagggaccataaaagtgacccaagtgccatgtgtcaaagctaatatacttaactcaagcctattccagtgggttctcacccttcacttgtgccctaaggcctggcagcttatttcaggagggacacccgttgttggtgtaaagagcaagatcttttatgggtatcagttttaaggggcttatgggaataatcaatatgctatggaagtaatgaagatatttaacgtcctgaaaattctagtctaagctttgagaatgtgaccataaaattgacagggattaactttaatatttgactagttaacggtaggattttttccgttacagtgcactgtgtcaaaatttggtctcgttaaataaattcctattctatcagggatgagcttcccacaaataatgttaaaaaaaaaaaaaaaaggagaaagcatgataaaccttttttcctgtttctcttcttctaaccacagggtgcactatggcagttgcagggcttggtaattgaattcagttctgcaacctgaatacatttctactgtaagtggatctccctcctctaccagagaaagaaaatggcctcaaatgattctgactggaacacagcagccacctctcttgtaaatagctgggtcttattgacttatcttggtagggagccaaaattgctgcccagatgagtccaagcagtagccagaagagaaccagctacttatggggtctctgtctttgtgaaataagtattaagagggtccatcttaaagaaggaagagaagtatggtcaggtgagtcaggcaatgatgcttagtgaagtacaacctcagagttacggtttttaataatacgcaaaattacatgtgtaagtgtattgatatgttttataatacagcatgcccagaatctcaaaaagattaaaaaaaaaaaaagatgttcctaggttctaagtatttttctttgcatagtggtttgagggcgagtcaagtttataggtgtgctgacctttaagagagttaggaataaaagagggcattgagagaaagtggtttgggtcgcagacaccatccctcaaatagctgacaatgaaggtctataataataattggcattatctcaatttgccaggtatctttagtagaatgtgctttatctaatacccaaggtagggtttcaacaatgttgagaatctatttatgaaaaggccaagatgataatgttagctaagtgctaaatataataaaaagtagtcatgaccaccattctagacaagcttcattgtcccgcacactttatctggacctgtggtttctggatggttaagcggcttgtactcacaaagacaaattgtgcattcttggaatacattcttggaggtctgagagttttctgtgagtggtgctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaacataaggaatgcatttatgtcaaggaaaaaataaaatgatgccagagtctgattttaaaaacaaagctatctcacgatttcaaatggagaaaacagggagggagaataaaatcacagcaagcttaattaggtgtgagcatcatgacctcaggagaacctgggccagagaagtcaggagtattaatgtttaccatggaactggtaatttcatttaaaccaagcagcatcagctgtcacattaaattaatattattgaaattttatagcatttatatttatttgtatttaatttataaatgggtgttggttgtgtaagtgctataagtataaatggattgtagctagttttatgtttgtgtatatatatgtgtgtgtatatatacatatatgtgtgtgtatatatacatatacacatgtgtgtgtgtatacatatacgcacacatgtgtatatacatatacacacacatgtgtgtgtatatatatatacatatgtgtgcgtatatgtatacacacacacatatgtatatatatgtaatgctaacaaaaaataatttgaatgattgccaggggtccccaagaatgagctttttcttttaaaattggcctgtactttctttgagaagccttgccacgggtagaggagctattcagtgcctattgagtcaaaatttggccttaatataaatggggaggttttcccttgccatgtttggtgcctgctaggtatagtcacttgctctaatttcagtagggtggtggaaattaccaataggcagaaaaagacagctttgctgacacctatttggttgaattttacaaaatggaaggatgaataatacctcaaaggcaatctggtagattctttgagggaaagagatgtgtctatttacagggaataaagctaagcacattgactgttcttaggttaatggaaaagaataaggctagtgtaggagccagcaaattatgtttcctccataattagagtcttataaaaatatcagcgtgaattacttgctaaatacaaattacaattgttaatgtttgttaagaaaaataattcaatttagagcaagaatgaaagaaatacaggcacccaagaacaggcacagaatacaatcactttaaccaaagcttagcatggattattttcccccacttcagcttcaagtttattctaatctttttctggggggcaggagacagtcggaggggaatgcatctgtatgtcccagctgtgtggcttctgagcctgacacccctgtgctctaacaagacccagggaagaaatccttagcaggctcttacccttatcagaacaaagctatttagttgccaccttaactccagtaattaactcagtggagcaaatttccttatttcatgtaagatgtgagccaaaactctccttgctgcacttcttctatctctgggataaagccaaacagagaagaaactcaaggaccatagaatctttccttgcttttagttttcctttgaggccctacctcccaactccctcctcacctctctccttgaccactgagtagtaccactactcagttaatactgaattttcttcttttccaagccctgcagtttactctagaatttctactgacaaagccaaatcttgctgtgatttttgcccccatggagaagcatgtattataggaacaactaaccctttataacttaggaggccctggggcttcattgcattacagagtcatacaaccataaatgcccagacatacatcaccagggttaaatcattttcagtatgaaatgatgtaatccaatttgaacactgcctcaaacccagtgcccttcatgtggtaagtattcaatacatacctaatattttaactttatttatttttacctcctccgatacaaaaaaatgtaaataaccctcaatgatctgtaaaaaatcacttagttggaacactttgttcatcctctagcaatgtctgataagttagttatcattacatcatgaatcatgatactcctcatcaggcagtaaaaatacagtaatttcgtttaattgaagggaaatacatgtttaccttggtaaaacttatatattatctttaaataaataaagggttatcttgttcaaatagcttaaacccataatcaaatgttgcttatagaggtcctgctttaaggatctcataatgatttgcatatcattagcttgtcagaataccatcctaaaccttgctgatatctgctctctttgcagttcattctttgttgcatccaagtattacagtaagttgttctctggcaatttgtttatactaatgatttgacagttattttttgacccttgaatgacataattatgttaaatacagtttaggctagcttgtgttcaaattgacatgaatttttaaattagtaatgttggtatctagtatatgacagaaatgaaaaataacgtattttgtatttatgcaagaaattatctgtaccgatcaaaactgacctccggacacaagaccagactggacttgcatatgttaatgggaaacaaaatggggaaggggctcctaattacttaagtttattaagaatcccaggatacctcttagaatggtagaggtgatgttagcccttatgtcctggacatgatccagtttaggtaattgctaattacaatctgtctacttaattcccacggcccttgcttctgaatgttattttcttcacttagcaatatttaactattatttgctcttggtgtgtgactgttggaacatctgctgattcctccttctacgttcggcatgatttgcttttcatttggttatttgataattattattttcatattatttttgttctaaatatgtctatagatagaaaacagaagccctgtaaaagttttagatattttttaactgcgtgggctggactatgctttgtcaatcgagcatacagactttctggatgtaagtttgggaacagtgggcataccactggcccatgaaacactcactataagatagtgtcaactcagaggtgaatcacagatagaccagggttttcagtgtcttcaaaactagggctgaaatcacagcacttaggggcttataagtagatccctctaaggatctatcctattctggagccattccaaaacaagagtacctctgttttgggtgctagagcatgctttatttcaatcacaattcaatggaactgaagaacagaattagaaagtgatgagtcaaaaattcttattcaccgcaaatacagggctagataaactccaggtattccacacagtttccatccctctgaaggaagcgagattactcttgtgtccgctcagctatgagcaccttgatttgggatatattgcttggagttcagatggagaagacatccaggttttatctataaactaccctccatatctctaaaagttacttagaggaaatcactgagttgaaacttcattcattccctagcattgtcagatgaactgaagcatctttttcaatagtcaatatatcctgagccttcttagtgaacacagtgcttagaactttcaatgaattcacctctctaagattatggactacatattccaaatgtgtagattttgacctaaattttacccattctacagaaaaccaacaaactccacctcagagagatgttctcactatatctacccaccagggtaccagtctaaaaggccccaatattttctcctgtgttttctgaataattgtgtttgagctagagccgggagactcctcctgtggcttttattaatggaccaaagtttggttcctgtgaggactgcaatgtgtgattcaaatgcccagtccatgattcagctagtgaggggagtaacccattttatcagttgtgctgtcttccactgctgttctctatattccatcagaggaaacaaatggcttctattgtgcataagaatgccatttagtcccaagcaccatttgaaatggaaatgaggagtaacagtaacagaagaacattggctaataattgtgctctgaatagccatttggccatgtgggcagggtaaaggtaattgtgtcctagagtaatacatcttctgagcattccctgagactataattgctatgttgatgggatgcatttttaaacatgtgattgcggctcttagacttaaaaaaaaatggctattttcagaatgatctgactttaagatgtcaggcaagattttgaagtcagaataacaacacacaaacacagatctaagatgtattattgtgtagctacttgtctaactgcatttttttttcttaagtctcaccctgtcttggtgatacacagattaatactaacctcctaccaaacaatccctgttgccactctactgaaaatacattcttgccttccacaagcagaaggctgagtgtctttgtggcttaggagagaacaaaaacacatctatgtattcattgccttgttcacttgcacaaacggagaaaactctttgaaaacatcttcctttctcctgagtgaaagaatgagcaggcgctgcctcccctgatttactgcacccatcctaatcagggtagatgattctgatcttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaagtgatccgcccacctcagcatcccaaagtgttgggcttacaggcgtgagccactgtgcctggccaacagaacatattttaatgtctgaaaaaaaagaagaatctactttaaacatcaccagaagggatacacccttcggtgtccccaggccttgctggcttgctgtgggtataaagcattaattcttgtcatttgctggttatagtcctccaccaaaactcttcagttcttggcctctaattcaagctttcttccaagtttctctccactctcactgtgtcatttctaggaggcctcagagttttccacgctagaacacagtcggtactctcatgtgtgttttcattttagcctctttgttgatgtctgctgcctgtcaatccacctgggtttgtaaagtccctgaagcaattcctgccatgagaatgttccttcatccagaatgctgccttctatgctccccaaactcaaagaccttcagggaccagtaaactcaactgcccaaagccaagcacagctgtccacagaattggggcagagattcttctccataggactctggcctggtgcataggtttggctgaggaaaagacatgcttttctccttccccttttcacttctatcccttttcaccaggactcttgaagaatattctcacaggcctcgtttcccctcaggtcagaaaatatgtgcggaacagaccctgagatgctgactgtgcaaggctgttcagacccagtcaggtcaggccctgaatccttgtgatatggaatgagatatgataaattggaaattgtctttaataaattgccattcgtgataattctagtgataattaatctgctgaggctgctataaaatatcatagactgagaggcttaaccaatgtatttccacatagttttggaggctggaagtccaggatcaagaacaaggtgctagccaattggctttctgtgagggatcacttcctggcttgcagtcagctgccttcttgctgtattctcatatcacctttcctaggcagatgcatgcagagagggcaagtgagctgagcaagctcactggagtcttttcttgtaagaacactaatcctattggatcagggccttcacttttgtgacctcatttatcctcaattccttagaggccccatctccaaattcagccatattaggggttagggcttcaacagatgatttttggggcaagtattcagtctatgacaatcctcatttaaactcatcagggaccattgataaaatgctattcattcttccctatgctggtgtggaaatttgccacccaatggatgcctgcaatatatgccagagactttaggtacgctgtggcatggcttagtgactatgagaagactgacatattagcttggactagcttttgttaagcaaatggactattttacaatccaagaaaatgaacaaaattccgttttacttactcaagataaaaatgcattgatactgcaagacatatcctcactgaaagatagggtcacttaaaatatcccatttaaatgcaaaggacactagaaagtatagcaagacaaggtaaagaaaataacaaccttgctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgccattcctccccattagtacacttgagtccaaaggagaggttcacagcatcgtgctcttttgtgatgtggtttagaagaaaaccagctcaggacaagtggactctgaaaatagcagactttcctttactcatcttttgagttttcagagaagagtagagattcagttcattggatattttctttgtactaggctccatgctagaaattggagaaaataataaatgagaacctatctttaattaccattctagaaagaagacatgtacattaaggataatatgtaatggatgtcataatataaatatgtacaaagacaaggtgtagcatagaaggcagatgaattgttatgttgattggagtgtggtttctgttaagggatgacattaatgaggtatcgcctttgcaacttcaagaatgaatagaagttaatcagacaagaaaagaaccatttcacaaggaacaatatgtacacataattcaagacagccagaatgtgaagtaagaggagactcaagttttgtcagcatattatataagtaagggtgagttttggctttgagagttgctttgttgtgtttttccagatagatgtttttcagatatcttctcccctgtgagaaatttctgcaggtttgattgatcctttcagatgctttttaaatatatattagtttcatcactttaccacattgagagtccatgtatctttgactcaaatgcctaggaacagaagatgtgaggaaagggagagagagagattctgtcatttaacaattattattcaagtacctaaaccaaatcgaaatgcctaaaggaatgcagtgggtgatgtaaaagaaggtgtagggcaggtgtaacaacacagaatggtagagaggtgggaggtggggggacgggagagtacgcagctcttctaaggtgggcagctgccttatagcttcagccagttgtcacacagcactggttttgtcagttttcagttctttgaaaaaattggaaatgtgaaattttatatggaactgtcaatttgtggaagttagaaaccactcgcaggccagcactgggaaggccatatccagcctgacttgctctgttttatacaccatgcactctcagtggttgcctcaagggctttagaaagaaggtcaaccctttgccttgtggcttttgtgcattgctttcttaagaggaacataaggaaactctactgttctcagctgctgttgtggttacttggccatttgtaagacttatatataataatgaagttgtcttggagggctgccatgtccgtgatgtagttgcttatctaattttgtaatcttttatcaattccctctacagcttgaaggccaggctgagggtatggtacagaatactaagtggtttcaaatcaagtccaatctctgttgcaatttttattgtgataacaagatatattattaataacaataaaagacaataataatgtattattatattgtaagcttaccatgaagtgtatgggcaacccaaaaagatattcagccatcattaaaatcttttctaatcacagccacacatttcatattatattaaggaaaaacataaaagcaatcttgatgttaagtagaattagtaaagacctaaaggagtataaccgaataaacacaaagtagaataagtaggccagaatatgattgtattctatcaacaatgttatatttgcttagaaatctcttatatttcttcctccaaatatgcgtgcatgcacccacacacacacacacacacatacatatatacatatatgtatatctgcaattgtctaaaggtagatggtatagcataaaggttaagagtgtaaatttggggttcatactactagagtttcacaactgcctatgtagccttccaaaaatatttagcatcctgagctgcagttttctcatctataaacaaggattaataatagtatttatctttgtactattagatatgattgaataagatatttcatgtaaatcatctagcgtactgccagatatattttatagtcattattaatgcaaatcattattgtatcattattattactggagttttaactctctggctgttggcaggaggcctcagttcttctacccatgggcctctccacagagctgcttgagtatcctcagacgtggtggctggctttacccagggtgagtggactggggggtttggggaacaaactaggtagaagaacacctctaccatgtctattctttagaagcgagtcacgatgtttggcccacaataaagaagaatggaaatatttgctaaagattttgcagatgtattttaaagccacaacaaggcaaagggttattattcttaatttgcagaagtaattgagactcaatgagattagataacatacccaagaaaacacagtaaattgcataacttatttactggagctcctccccaaacccctaaactatgtgacattcttgctttaaaaaaaaatggattatacagcacgtgtcaccactgcattctcttttttatgttgttcatgtgtgtctgtgaaatgtgccttctaataaaaatttgaggatcttatacttttccagaatcattttgttgaagtcatgttttggagtacatttgtatgcaatccgtctgataagggaagtatatttctcactggaattagtataggcggaaaacaccatcaatcatagtcatcacaaagcaattaagtacctaattgttcatggctctgagtttgctactgaaacagaaaacttcttaggcttgctaagaaaacttcttaggcttctaagccctcctggggcttggaatccaagaattcagtagaagacggaagcgtggtaaggagaacaagaactgaagacataaacaaatttatttgaaatatggttgcagtggagcagggagagtgaattcaggggaaagaaaaataaaatgaaataagatgctgaggttcaagaaaggataaaaggtaaagtggctgaatttaaatgacctgggtttcagtttttaacaaaacataaaaataactgaagaaaggctctatattttatttaacaataacaacaacaaaaatcaaagtgcttgtttatcattgggactcaacttttgcagagtttttgccttaatttttttctctctaaagcagaatttcccatcactttagattcctttccgtgtcaatgatggcttttaatcccaatttccatcattacccctcagtgaaatgattgcttccatgtttgagtatatatacatatgtctgagacttaggtcaattattttcatgcagaaatcggggagggtgctcctgtttttcatatgcatttgtaaatattttcaatcaatcatgcatttataatccaattgggaagatatgattcagacacaatagcccgtctgctgcaagagtctgttataaaattgatcagttggccaagttatgctatttttttaagttactttgctttctttcagggaagaagaaagacaaaaaagtccagaaaccagcagcagcaggtgctgccaaaatggtattcttcttatctgtgctgatttcaaggggtgtgcaaaagaatgtgtagttgcttttctctctggctgttgggatggcgtctgtctctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagcaaaagaaaaaaggaaaaactgctaaatgttaagtgatttgcttatttgaagagttgtattacaaagcaatggaatgggagagctctcccagcccaggaaagacaaatgggaagacgggtctattttcattttggcattggacagaaggcagccttctggcctgctgtcacttcctatctgttcagtcttcgttttgcttccccgctgaccatggatcggattctgactcatatcagagactccctcttctgatcctatttatttatctgaggattttttcttttctttttccatagactcctagaatccagaggaaactcagtggcatctctcatattatcctaagctttctcagaaatgtgacatcaatattttaaaattttcagtagttatcaatatttcttaaatctagcagtaaggatggtctttgaaatatcttttctaaattccttctgttataataaaagtcagtgctcttttatatggtttggctgtatccccacccaaatcttgccttgaattgtaatgactcccacgtcaagatggggccaggtggaggtaataggatcatgggggcagtttcccccatactgttctcatggtagtgaataagtctcatgagatctgatggttttataaatgggggttcccctgcacgagctatcttgcctgctgccatgactttgctcctcattcaccttccatcatgatagtgaggcctcccaagccttgtggaactgtgagtccattaaacctgtttttctttatcaattacccggtctcagatatgtctttattagcaccatgagaacagacaaatacactgtttatcatattcttgacagcaataaaacaattgcttactgtcagctcttaacaatctttagtataattaagatagtctatttggattctttttcagagccttctatttttcagtcttttgaatgtactcttattgctaaatttggaatatttttagttttgctgcatcattttttgaatttacctttctcccctcttttgcctattcattattcaaaaccagatcaaacactctttctgtgaagtcagtaacttactccttcagaaatgtaggtacattgaaattggtaaacattatcacactttgtacatacttttacagtgactatgtatatgtgtgtgtttgcaaaactttctgcctcattggacaataaactcctcaagtgcagagatcttgtgttatttatctatgtgtcttcagatactaaatgtggcacatagtagagctccatacatgtgtattgagtaataaattaatgaataaatatgatgctggtggcaggtaaattcttggtgtttactttgaggtccggatcaatacaggatcaggatagtgcttctcttacatctgtttgcacagcagaactgtactgcactgaccagatgtctcaaagtaatgtccatcttgcctggaagtgtctttccttacttggggtcttttaccttcagaaatccaggtgcattcacaatctgcactgttattataccaactctaggtgaaggatgcatgatccaaaggtccagagtttgaaagcttgcagtctgcaaaactgccctcacttctgatttgaattgcaagttcaggggtttctccaaatcactttcagatttgataatttgctcataggacttacaggactaactgaaagctgttggactcatcattgtgatttattgtaaggacaggatacagattaaactcatccaaggaaagggacacatggggcaaagtgagagagctccagatgtgtagcttccagttgccctctcccatggggtcaaataactcctccaggcaacagtgtgcgacaataggcacgatgttgctgacaacagagctctcctaagctttggtgtctgcggtttttggaggttgggtgggtgcttcagcacatacacatgattgcccatatatatatagctaatctcggtctccagcccctcaggagatagacctgagaccatgcgccccaagtcccacaacctaagccgcatcgttggtgtgactcacaacccccaccataagtcacattgtcagatattctggcatggcagcacccacactaaacaaagatgtggctcctactaggcatgctcctcctagggctaaaagatttcttcctagaagccaagagcaacagccagaccattccctgggcaagattaaattccttactgaaccacattttagttcttccacacaggtctcaccaaacctataatttccaagtgagagaacaggaagcctcatcttgctttcacagcttgagacaaggcaaaaggaaacgctgttttgaactttgtagtcagggtgggtgtgtttacaagggatacaatcccctcaagtcaatttaaatcaagaatctatatgtacagtggcatacccagggtatgtggctgtaagtaaatcgtgttttaactctctccctctactttcttcctctcaatgacaaaattattttcagtaataattatttaataatatagtaattctcaccatattttaaaattgctcttcagttttaaaacaatttacaagttagaagcatacatttcaattttacagctattattcaaattcagtagaaatatttcacatatgacctgaaatttgaacttaccaagcaaaagtattatataacacagacttctttttttctactttactgagtgagtggacacagatgaaaaattctaagttagaaattctaagtggtcctaaggaatgaccaaattgaataactcaagttttctttcttttgtcattacaatcagtgtgctatcactttttattttaaatgttggtttaagcaaatgtgtacgtatgtgtgagatatatatatatttcatatatatatatatatataatatatatataatttcagcattaaggagacattgtgcccacataaagtgataatgagactggaacattacaaacttactccttcaacgaatgcatgtagccaatctatgtgtgatgggactgataatataaccaggagctctccaaattatcattcatgtagaatacaatggtttttaaataatcggtaatagaagttattaatttgaggcttacatatgaatctgaaatgcaacaatgtctgtagaaattgtttagaattttgacaagatttgtttgtggatggagtttctttttaaaagattgatatataatattttacatatcagtggggtccatgtgatattttgttgcatgcataacgtgtaatgatgggtatttgggatatccatcaccttgagtatttatcacttctatgtgtaggtaacatttcaagttctctcttctagctactttgaaatatactttgttgctaactatagtcaccctactctgctatcaaacattagaacttaaaccttcttctaactgtatgtttgtaaccatttgccacatctctttatcccctcatcccacccacacacccattccagcctctggtatctatcattctactctctaccttcttcatgagataaacatttttagctctcatatgtgagtgagaacgtgtgaaatgtgtcatctgggtcttgcctatttcatttaacgtaatgacttctagtttcatccatgttgctgcaaacacatgattttatccttttttatggccaaatagtattcatatatatatcacatattttccttatccttgcatctattgatggacatttaggttggttctataactttgctgctgttgtgactagtgctgcagtaaacatgggagtccaaatgtccctttgatatattgatttcttttcctttggataaaaattcaatagtgggattgctggtggatggagtattttatcactgacattgtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcattcctgcagagcattcacgggtgctatttacagtcctaattaaatggaggattattagaaacgggaaggcagctataaatagcatggtccattttatctgtttctttggtgtgtaggaagagcattgctaagattctcccttgaagttcagttaactcagaatgtgttctgcttttgttattctgctttggcttaaaaaaaagtctcctgatgctgttcaaagtggggaaaagaaaacaaaaacaaacaggagtcactctcagtcattttagcatatggacagaaggaacacagaatgaaatagagttggggaggggtgtgcacggtataagaaaaaaaaatgtgggcctaatcctttccgataacttttttttctgaaaacaactattaataaatcttatttccaagtctgtagaatattggttctcttcatccaactgtaatgtgatcagtctgttcagggagcagaggagtgggtatgggagccttccctctccgtggtcctgttagggcaccttttccagggagtggggactctgctggcttctctttcagcacactggacggtgcagaaatcagctcaactctagaggcagtgctgggattggaatggaacttgacctggatcaaatcaccgagcctttgcaaattcctgattttccaagttaggacatatctttagacccagagcccttaatcttggctcttgggataagcttccttactgcttctctcaacactcatctccacctccagcctctgctctacaagctgccactcatctaccttacatctctgatccatccccagtattcaacagccttcagcatttcttggttacctgttttaaatttcccaagttcttaacctgtgtttataacaactcatgaacttccaaccaacacatcaactccagctccctccagtactccttctttcaaaagggttctagtcaaaggggtttgcaggcattgcttaagctcatggggtgttttcgtcaatgccccattggatttgttcatgtctttgtttctttgatatatcatccttcttctcctacttatcttaattgatctcaaagctcaagtcaaattatatttctcccagttggtaattattttccccttactttaaattctgaaaacgctaatgactgagcttttcatttagtactaactggatggttagttttctttgtgtatgtgatcgtttacgtggtcgttttgtttctcaccaacacattgtaaactcttttagaattgttatctaatagaaatataagtaacataaacctgtattatatttttggagcatctgaaagatttctctcaaatggtctcatctgatccccaaagcacccctctcaggaagtaatttttttatttttatttttggggaacagggttttactctgttactcaggctacaatgtggtggcacaatcacagctcaatcagccttggcctcccaggctcgtgattcacctgcctcagccttcccagtagctaggactataggcacctgccaccacgatgcccagctgtttttgtttgtttgtttgtttgttttttaagtagagacaaagtcttgctatgttgcacagactggtctcaaattcctgagttcaagcagtcctcccttgtcttggcctcccaaagtgctgggattacaggcatgagcaaccatgcccagctgaggaggtataatattatccatagtttcacatgtaaggtaataggagctcacaagggttaaataatttgcatcaaatcactcagctggtaacttttagatccagatttaaaaattctcaacttctgactatatcctatgttttttgtttggttttgtttatagcttgcagttgcttttataattattatttttttgagacggagtcttgctctgtcactaggctggaatgcagtggtgtgatctcagctcactgcaatctctgcctcctgggttgaagtgattctcctacctcagcctcccgagtagctgggactacaggcatgtgccaccacgcccagcaattttttttttttctagtagagatggggtttcaccatgttggccaggatggtcttgatctcttgatctcgtgatctgcccgcctcagcctcccaaagtgctgggattacatgcatgagtccccactggatttgatctttacaaattaatattagcacttgttaactaaaggaatgaagaaataagtgaaagaatgaaggaataaatacataacaacattatgtataacacagatgagtgtaatgattcagcaaaacttcattataatctcttcagggcacctcctggaaacctgagaaataaaactgttttattactggtacttgcctttctcgaaaactgatagtaaacgtcctgacaagttagtcttaggtatctttccttcagttcaatagcaaatgctgtttaaaagcaaatacacagcatttatagaatgtttttgcctcttcattatattttactacataaaaatctaaaacacacaaaaaagtaaaacacaaaaacagtctaaagtgtgacactgatttcagtacaatacatctagagggaataatttttctctaaattcccaggtggctaaaaagagggctctgtggatagatgtggaaagcgtgagacagatgcttctctgagcctcgggtttctcatcttaaaatagagataattacagtacctacctcacaaggttgtggggatttgttgggaggatctaagtaaagcccttaagacactgcctgggtataaagcagctatgtagcttctagtgtcttaacattgctaagaaaagaaacacacttgccccctttttgcagaagtaagctcctttagtgattttcatctcattttcttctatactttttttttatatttgttgtgagcacgatcttctcttttttaataaattcatatttttcaattatttttattattaaggtaagaagtgtgcttttgttggtggaggaagaaggaagcccctacatgcatagcaacgtccatgggaatgaatcactgttcccttcttttctatgaacttaagattatactcaagccactccagaaaatgaccatgcagtcactgtaagcaattcctctaaaattattaaaaactgtttatgtttggagaaaggcagcccctcttgcagtgataatgactgctatatgagaggattaagctgattacatctttggaatactgagattgtgcaaaatagagggaacgatgaactctccacataagctaaggaattcagcaaaaggatgaatcaacaggagagagagaatatgaagcctctatttggaaactgaacacgtagcctcccagataaaagtgagaaagattttgagtaatatctgaagtcatgtagctgagaagttccatctacacttgagaataaaaacaaacaaacatactctaggcgatgtctatgccagttccatgaagtcatcatagacttgcaatcaattgcttgggaaaatagattttaaagttgaatttctggctattactaggataattttttctcctggacattttatgtatttatgtatctactttggtcagggtgacaaatggtatgtggtatgcagagcttaactactactcctagcccccaggccccataatcttttagtggattcagccaagcagaaatgtatgttgaataaaaccatgtccagggggtgagcagaaagaaatgcatttgaggaaaggatattatgtcaatcccaaactcgatgaaatgttctaagagtatcccagagattggttctatgaatctagtgaaacacagaataccctactcttcacagatgggtgtttatttgcatgagtccataggcatgtgagcttttgttccttagctggaggattagagggaagaaatgacataggtgattagggatgggggagagctgggatgaatatggagaaaggttagagaatgcaggcggaagttgatggcagcaatttgacttagaaccttatgggacttgggacacacgcactgtaaccttgagacctagataacagtgttttatacagattcggagaatagattatttctcccacaacccagctactgctatgggtacagctttagtgctctgcgggctcagctgaccacctgaaggtgactggctggcttggagtgacaatagaagagcctatagcacttgtaagagcagggtcctcactgagattgtgcacagcagagggagccatgaactccctgcatgagctaaggaattcagcaaaagcatgaatcagcaggagagagagaatatgaagcctctattcgattaatgaacatgtggcctcccaaacaaaagtgggaaagattttgagtcatagctgaagtcatcatgtagctgggatattctataaacatttgagaataaaaacaagcacagcaaccaatgtcctttctgttctaattaggactaacttttgagtgctagagactagagggcaggcatagccctctatggagatgggccgttcaagttttaataaatgtgttgcatttgtcatcttagtatggcatgacaaatgatctattttatattaggagctgcccaaagatgttgggttaattttagtcaaagtgattttatgcccacaacatctggatgagtttggtcaaaggaaagaagtttagtagactcataaccagaaagatctttgtcttcacctggcctgccagacttctgagggagtaatcatgcccaatatagtaactggaaggacatgccacttgtttggaaggatagaggcatagcctgagaagataaaggtgaaatctctgaaaactttgataaagaggctgggcacggtggctcatacctgtaaacccagcactttgggaggccagggcaggcagatcactaggtcaagagattgagaccatcctggccaacatggtgaaaccccatctctactaaaaatacaaaaattagctgggtgtggtggtgtgtgcctgtagtcccagctactcaggacgctgaggcaggagaatcgcctgaacccgggaggcggaggttgcagtgagcggagattgtgccactgcactccagcctggcgacagagcgagactccatcttaaaaaaaaaacaaaaaaaaaaaaaaccaactttgataaataaaatataactctaactctagatagggaccgaatgggggtataatgtttgtttaagtttttgggagacacttgataacacaacctggatatggtggagagcattcacattccttttcagtagtagcctcttaacgatgaggtatggatgaacagcaaattgctgctgacttattaattaccatgcccacaccactgatttccctatgtcttacctgtgcacacacattggctttacagcatacgaacgccaagtttgtggcgtagcatatggtgctccctcaaataagcacaactgtctgcctctctgcttatctaatcatagcaacagaaaaattgacttttcagttttcttttccccaggccctgggagatgcatatgccaaatacttggcattctttgtaacagagtcaatcataattaggattccaaattaaagtacactgccagccagggcatgtggtattttatattatttgtttgaacaaatgtattataacttgaaaatggcaaagtaaaagaattaagtaaagctcacactttttatatgtaatcatcttgcggagttttattttatcagaatgttagatgaaatcagaaagcaaagaatgtaaaatagaaaaatgtatctgaaactttattcttttaagtaacaggtttggttttttgtttttgttttctttattttcattttgtttggtttttgaaatgctcattgtagaatgttgaatatggtcagatgttgggtgtgaagtttattagaaattaaccctgaaaaagtatggtatagtcattcagttgccttttccagtggagtctgatttggcctggcgggtgtagtgaaacattaactacacccgcctcagccacccaaagtgctgggatcacaggcgtgagccaccgcgccaggccctaaagcacatcttgattgtaggttgagggtgcagtgccaacaaattctactttcatggctcttgaaattctgtgaacatttaagagccactttgacacagccatttcttgttttttgagagagggtattattgaaattctttttaatccaagatttttgtgacaatttcattcattcctactttctttacaccagtagtagctattcatattcattcttctattttctttgcatgattaactggcatatactagttcttcacattattagcctaataatagtagttacaggctataataggctattaattcattatcatctcctgactcaagtgaatctgctggtaactgagagctcctactcttgtcaatggctttgatcccactgatgaccattttagtgctattcccttctcaccatggttgagccttttctacatattcctctcagaatggttgtgccagactttcacggggagccatttttaaagctatcctcactacagaatatggcagcatttcgttggcagtaaaatcagttaaactgcatatagaatgctttagtttcttctgaataaaatgtgttacacaaactgaagtcactgctctttttaaaaaccaaagcagaataaaccgttttgtaagataattttgccactataaatatagtttcctttggcttcttcttggaaagattttatttcagcttgcactgtgagatctttgtcgttttcaccacacatttccgtcaaggaagcccttggatgactgccatgatttgcctctgctggacgcttccttcaagggctgtcaacacctctcttaattgtctggcttaaacatcaggcgagcaatgtgttaaagttagatggcaaatatacttaagacaaatatgtaaatttttactctttcaaatatgcattcaactggtgtgtatagatttcagaacaaaagccagagagagagcaagaaagagggaggagagagaaatctatatgtataaatagaaaagccaaggtagaaatgctgtgtgtgtaaatacccaatttctggattaagacgtatcacaaatacatatgatcaatacttatgtacatgcaagtgtactgcctttccaaacaccagcaaatcttggtgagcagaaatcagtagactgtccatagtgggatctagaatttgaatggaaacggtcttcaattttaaatattcatctgttttcatttgtagatatgacactcactttaagaggtgatctgagttcaaattccctaaattatatttgcatttgacttattacacatattgttagttgtcccttgaattccagtttctctttgagtaagttcttagaagatatatgtagctaggtgacttatagtcacctcttagtcattctcaaatatgattataggctatttcagattcatttcaggaaaatgtcatgtgtcaaggtgtcaattctgagcaatttttacattttgccaattctattatagaagtggctctcacccataagtagcttgaaggagtcagtatgtaatgtgccagtctcattttcactttatgtgggcacaatgtctctctaatgctgaactgttatataacctgtggtctatctgactaccatagcttcgtagatcaaaatattgttatggtcatataaatgactataatgtgggtgttttagaattgcacttttgtttatgcataactggtcccaactcaaatctgcttcatcattttttagtcaaaggatagtttttcatgtcagtagtacctcaaactccgcttgtgaacttaacacccagctatatcctgttagtttttaatcaggagggaaaaaaaggctgctatttgaactaaactgacagcttttgttgatgagctgttaggcagattaaattctgtcttgctcttcaattgttcttgaggctctgtgggacttacagtaatagaattttatttgtgtcagtaaagttgacagccctgattcagaagaccacagggagctgagatgttgattaaggagcatcatattgaccatggcttaagtgggtaacaaatgaactgagagagaagactctggatctacttttgcctgtccatgaactcgtccaaagcaaatatgctttgagttttcatgtctgttttttaatttttgtggatacacagtaggtgtaaatatttgtggggtacatgagatgttttggtataggcaagcaatgcatactaatcacatcatggaagatagatagggtatccatcccctcaagcatttattctttgtgctaacaaacaatccaattatacccttttagttatttaaaaattctattgaggctggacacagtgacttatgcttgtaatctcagcactttgggagggcaaggcaggaggatcccttgagcccaggaattcgagactagcctgggcaacatggcgaaacccaatctctacaaaaaatataaaaattagccaggcatgctgacatgtgcctgcagtcctagctattcgggaggctgacgtaggaggattgcttgagcctgggaggttgaggctacagtgagctgtgatcatgcccctgcaccccagcctgggtgacagagcaaaactctgtctcgaaacaagcaaacaaaaaattgttaaatcattattgactagagccacccattgtgctatcagatactagcccttattcatttactctatttttttttgtactgagattttaatttctgtacttagtaatagctttcaaaattgtcatgttatcccaggaaattgttatttttatccaaggcttattccatttttttttccagttgtttggggcccacaatattgtttcttttagaaataaagttagaaatattcagaataatgaacacttaagagagaataaggagtagaatacctaaaaaaaaaaaaaaaaaaaggaatcaaataaggaagagatagatagtaaaagagaagtggatgtaagcaatttagaatatattttatcaaaaattgctttttaagtggcattttctcttgctgcagaagacattattgaacaaaaaaaaagcccaatgcaattcaatttaaatttatcactctattattttaatatatttactcagggttaacaactcattaaacaccaaattgctcactcttaatgagtctctgacgctaaaattgagctgacttaaattttactgtaaaatatcagcaccattgcataaaactgtaataaaaattaactaaaagctattgaatgactgtggagtggaaaacagatttgtgacacaaaacagaaaatgtagcacacgatatgtggctggcagaaacatgagtaatagcttttattcaccaaaacatgataagcccatttttcttttgctgtattggagtctgtgaaacatgaagtcatgttttctttttttcccccattactttgtacaacgagggccagtggtggaatgatacagtttggctgtgtccccactgaaatctcatcttgaattgtaactcccacaattcccacatgtcgtgggaggaacccagtgggaggtaattgaattatgtgggcaggtctttcccatgctgttctcataatattgaataagtctcagaaagtctgatggttttaaaaatgtgagtttccctgcacaagctctctctctttgcctgctgccatccatgtaaaatgtgctgctccaccttgccttccaccatgattgtgaggcctccccagcgatgtggaactgtaagtccattaaacctttctttcttttgttaaaaaaaaaaaaaaaaaaaaaagattatgatagtgctagtcaatactgagttgactgtcaaaaataagcacactttacattagccagttacttctgggacactgttgaagagtatgtcacatgtacccacaaattagtcaaacatctttaggcatcacatgatatctaaattagtctttttctccttctccatcccctggttgtccatgaaatattggcctcaaatcagcttgcctatggccaccatggaaaccatccatcatgaacagcacctatgcccctggtacaggagtgcatttctccccaagcctacagtcttctgtgtgtcacagcaatgctgagtttcccacagaggtggcgttgatggactctttctcaactctttgctatggagtatcacctgggctaagaagttctgcttttgcatcaaatttcaatttttttctttttattggatttgaattgttctggcacttttgccactatgctgtctctcaagccctaccatcccctccatctttctaaggtctctcagaaccttagctccaacaaaacccccttctttttctctcattataacacaaatttcctgtgaatatcaatgaagcaaacagatacagtgggagctcgtgaaagacaaaggacaccgagctagtattttcattaacaacatgggctcttgtactgtcaaccaacaagagctttgttataaatttattcacaatggcaatggctttgggcaacatttagatggaaagtatttatgaaaaatatactatttatgtttctggataggaaacatactattcatgtaacaaaatatgacatttaaaggaactcactttttcttttttgttgacagtcaccgtgtcatcaaggaaatcaacatttagaaattatgattgtcactagctcactctgagccatggctctacattttatccttgtcaataagcaatccagtgttaggattttaaaaattgtttaaaatatccgtacaaagagttattttctatcttggtccacaaatttgtcaatattttccacagcatcacaattgtcagaaaacacagtgaagcttaagttaaaacaaatctgcaaagaaaaagtcaaaaagaaaactcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggctagaagcctaagcagaatctcttctacttccctcaaaatctatttcttagcaccagcaagactgggtctgtccagtgggttgtgggtttggggagaagcagaggaaagattgacatcatgtggaatctggaagagacagaacacatctcttggtgcttttgaaggtacagtgactccatctagtagtaaaaggtgttcaaatgaatggcttcaaatttgaccagattatcaaatgctgcttccctgataaacagctcagacatgggttagaagaggtggccctgggatgggaagcagtgcagactctcatgtatgaatagctccaattctcaaaaaattcttttagttaactgctgtctgtcttcttctacattgcactcaagcttaactctgcacttttaaaatcaacatataaattataactttctctcctatgataacttttcaaatgttttttgacatctattcagtaccgagctcccttttgaaaactgggccatcatttcccaacctccaatttctgactgtatttccataatttatttaaagactcctaacaatggagccacaatcataactacaggtcccctttatatctcaggatgacattcatttggttctaatccttgaactcatttgaagattctaattgctcttgtattctctcctcttctatctggaacttatctccctgataagcatctgtgttgtgattcttctagagtggagattatttctcttgtaaggaaaaaaattaaaactaccttgttctactttctctgttgcatcacaccttctctcttaagtaatagtcctaaaccttctctgttcttctccagacagatcataaatgttacaccccaacctaaaacaaaacaaaacaaaaccttccttcatgaattattattggccttgtatgcaagactgagttgatcccagtctcaatttacctgataccatctatttcaacaataacaataataacaacaataatgaatatttatttagagctttctctgttccaagcactgttctgaccactttatgtatatttacttggttgactctaacaataattactgaggtgggccaggcacagtggctcatgcctgtaatcccagcactttgggaggctgaggcgggcagatcacctgaggtcaggagttcaagaccggcctggccaacatggcgaaaccctgtctctaccaaaaatacaaaaattagccgggtgtggtggtacacgcctgtaatcccagctgtccagaaggctgaggcaggggaatctcttgaacccaggaggcggaggttgcagtgagctgagattgcatcactgcactccagcctaggcaacagagtgagaatctgtctcaaaaaattaaataaataagtaaataaaaataaataattactgaggtggctattactaatttctctattttggtgatttggaaactgaacttagaagttaaagggcttgagcaaatacattggactaaaaggtggaggagctgaggtttgaagtttcaatgcaggcatctggctccagggttcatggtcttttaccatgatgccatgctgctatgtctacttataggagtatgcacgcttttatgttctttcctgtttttgtgagccttattctagcttttatatatttttaaactctgagctccttagagagtttccaatggccagtcaaatttatttaggtcctctgaatagtctctgaatggaagaaagtgtttttcatccctaaagcccacatgtatacttcagatgcacaaggttcaaggtcagggcctgaaggagaaagtatcacagcacaagtaacaatgttaaacttcaaaggaagataaaacctcaaaataagatattaaggtcaaatactagaatctgcagggacactgtcctggttaagaggcaatagaaaggaagtagcataaggtgattcagcaggggagagatgtgagaccaacagcgttagatcagtggggctgtaagagagactctccaaattcatttatggaggagaatgccagaagagtggggagagagtgagctagagattcccaagtcccctggcaacgcgaaataccaggggtactagcacccaggtctttgcttctaatgccattctctaatgaaagggacaaggcatccttggaaaaatggctaattctagcacagagcagggaatagacaagatgagcccggagaatctggtagtgacagaaaggaagaaaatgcagaaagaaaaaggaaggaagacaagggaagggaagggatggtatgaaaggaaggaagaaagggaaggaaggaaggaagtccaatgaatgggattggggtctatttctatctgtgttcttaacaatcttcttcatcagggattagattcttgtttttttctttgttgccttttttttttttttttttttttgagatggagtctcactctgtcaccacgctggagtgcagtggcgcaatcttggctcactgcaacctccgactccgtggttcaagcgattctcctgcctcagcctcctgaaagctgagatcacaggtacacgccaccacgcccaactaatttttgtatttttagtagagacggggtttcaccatgttggccagaatggtctccatctcctggcctcgtgatctgcctacctaggcttcccaaagtgctgggattacaggcaggagccaccgtgcccagcctgttgccttgtttctgatgggagtccaagaatctccaagctatctatatgagaaagacaaaactactctttctatcctgtactgtaatcctacctgacaaatatatccttcatgctccttgtcattttgagcaaatagcctgagcttacctcactttcatttgaacttcctccctctttattgccaaggtactacgttcctttatctctgtgcctgaacaagccccccttgctataatcttcatgctgacccctcattctctagagtatatgctgttttctgcagcagactacacggccagtgcccttgcttggagcagatctagacatcatatcgccacggtcttcattctgaagtaaccttagaagtcactttcagttcataacattaaagcacaggttacaactcatatgactacatgggccatataaaataaatgagtcaatgtgccgaagatcaggaaagtgatagctcaggcaagactgacactaattcttggcctctctgtctaagagacagaagagagtgctagagactatggcacccaggagaacccagaccgaagagggcagccactgctcagctgctgccagtcatcacagcacaggagcaatggaccaatattatgaatttatcttcttttgaaagacaatccagaagtcgagacttttataaaaagtctgaattcattacctgtattaaattttctttgatttaaaacactgatcaggctaaatacaacatacctgtaagatattacatacctactgcaagaaccctgcctctgcatataaaggagaaagataagcacagttgattctcttcacaagccctgtgtcatgcaaacaggattaatagcccagttctaggctaacaatttcatagcaaccatgtggttattatgtgttgtatatatgaaattatgccataatgagctgtctcctaacaagattgtgcaggctataaagctgttttatagctccaagagagttgctcctgagttcattgacagtgcttattgtttctttccatctcagttacttttgaattaaaaagtgctcaccctactctttcttctcggctacaagttttgccatagtgcacagtgtttcttcatcttactttctttaaagaacctttcccatctcttcagttatttctacctgttccaacctccctcctgatagcaccccagtagtgggatggaatgtgctggaggggtttggccagttcttgggggagtttcacagtcacctgtctacagtttcagtgagatgggaatttatcaagctgaaattagcaaaagacaaaactgacattgtttaaacacatacttaacaaaagatctaaccagttcctcctagaactagaagatatttgaaaattagagaggagcttttttttttttcctatcgctttctttaaaacacacttttccatagataatcttatctttttggcatcaacaattatttataattctggaatgatttccaaatctaacttgtaaccatatttccaactacctgccaagtgtctgtgctggaattacctaatggcatttgatcgtggctcaaatgtgctcactcaactttattccgtgggctgctcacctcccctgtgtggagcctgggagcctctgaaggcaaatcttgactcatctctcacctctcaactgatcaaccagtagccacacctgacttaaatgccatctggaatccagttctctttcagctcttccatttcttacaggaacttttacagtaacttctgaactgttactcttgcctctgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctacttcatcgcctcctgcaccccaagctggaattacatgtgtcttattgccctgtccctgcatatcttctggccttatagacctctgtgcctttatctatgtcgttccttctacctcaacaggtttctgtcctaccatggattgtctaatgccttctgcacatgttctttatcctaggaagcaaaatatttattccttttcctgcattctttaatacctagtttatgcatgtctcattgcacttattctaatcggagcttgttcttgtcattttttttcatatttttttccttttgtgggggagtttaggacccaagtctttgtcctcttttggtttaactagtaccttgcacagaaaaggtagtcaataaatgtttgaaaaaaaaaatcccagtttgataattagttgaaaatttcttcagttaatgaaaacttggtacaaccaaaggaaaatgaattatcagagtttactatgctccatgagattcttttcatacaagtatgctgcagaggaatggaagagtgggaatataaataaatatgaaaaattcttagaacaatcttcttattatttgagacagagtccagctctgtcacccaggctggaatgcagtggcatgctgttggctcactgcaaactccacctcccaggttcaagcgattctcctgcctcagcctcccgagtggctggaattacaggtccccaccaccacgcccagataaatttttttttgtatttttagtagagacggggtttcactgtgttggccaggctggtcttaaactcctgacttcatgatctgcccgcctcggcctcccaaggtgctgggattacaagtgtgagccaccgcgccctgccagaacaatcctattttctaattggggtttttctttgttttttgtttctttgtttgtttgtttgagatggagtttcactctgtcaccgaggctggagtgcagtggtgtgatctcagctcactacaaactctgcctcctgggttcaagcaattctcatgccttagcctcccgagtagctggggctacaggcgcctgccaccatgcccagctaatttttgtatttttagtagggacgaggtttcaccatgttggccaggctggtcttgaactcctgacctcaggtgatccacccgccttggcctccaaaagcggtaggattacaggcatgagccactgctcccggactttttttttttttaatccttctactttactcatactctccaaagttaattcacacacaacctccccaataaaatggaagtgaggtttaaaatcagaccataatttaaccagctgaccaaatgccattttgtataagaagataaaaagctaccattgttgttatatctcagagcagaagctctttcttcattttattctttaaaaacatcattcagggttgggtgtggcggctcatgcctataatcccagcactttgggaggctgaggcgggcggatcacttgaggtcaggagtttgagaccagcctggccaacatggtgaaaatctgtctccactaaaaatataaaaattagctgggcatggtggtgggtacatgtaatcccagctactcaagaggctgaggcaggagaatcgcttgaacccaggaggtggaggctgcagtgagccgagatcaagccactacactctagcctgggcgacagagtgagactccatctcaaaaaaattttaaaaataataagtaaaaaataaaaacaccattcaatttatagttagcatgaagctacaccatcaatctttcctcgtgttcatgatcatggctcagcatttttctgaagtgtcattaataagccatgttagcaggaatgacctacacatatgcatgtcaggagggcttcaggccactgctgtctgtgtgtcaccttgacgtcagccttgataattgtccagggcctccaacttcacagcagtacctgggcctatgtcaggttgagttctatgatcacacactattttcatcagaaattttaataaaattatttttttctcagatgacttcccgcatactactaagtgatctgggagaaggagtcttagggtgtggatgggattctgccttgggcatattttgctctactgggccctggagtctttgcagatgctgtcaagatactgcacttttttttcttttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccacgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctccacgagttccaaagtagaaggagcttgaactccaggctgtggctttgaagcagttgttttctctggaattagctaatgaggctctctttgtttgaggattggaaagcctccaaaaacccactcaggagggaaattaacaaatgtctgttttgttacctccggataaatcttcatgatgaaatgtgcagccggtccacctcttcaatcttctctcttcttcttcctcagtggaagctcaattaccatgaaggccaaaataaataaataaataaacaacaaaccaaccaaataaataaataaagcagataaaccgtggttctttgcttaaaaaaagttgcagcaaagaaaagctttagagtaatttctagttagaagtggctgtgagattcactgtcttctggtgatatttgaaatatactatattcatgcaaatgtttctgattatttaaacacattatctgtatctataattatcagtagctgctggcattatgtgagcatgcaaaagtgggaacagcagcagtaacctgactcatttcaaccaggatggaccatctcagagggtcacagttactaatctctgcatgaactagattttataaggtattatgattctttcatagcttgtaacttttcattgatcatcaactttactgatttttgttaatactggaaattttaataaatgggttgtgcacaggtacttattgagcatctattacgtgccatagaatattctgattattaaggatgtcaaggtatataatccagagtcacggttttcaaggaactcagtcaataattacaagctaatacatgggtaccactgttctaggcacagcgtggcagaaaagaatagcgtggacacacattcaggggatttaactaggagaaaacagtaaggaaggggatcttagcagaggtagtatattaacagatgtatatgacaacttacactgctgtaagtcatcctgtttggctggcaagttttgctttagaaactgggtaaatattgttcatgaaacttctgtgtaagtttcacgtgaatgttttcctatgtgtatgtgtgcatgcttatttgcatttgtgtgcacttgtgggtatgtgtatttgtcctgtgtcacaataaaaggtatctatttctggactttgcagtcaaaaacattggaaaactgtctatgtaggtaatggacacaatagaatttagaaagcaacttttacaaacattgcagatttgtaattttctaatatcattgatatataaagctgagtataccagacacttgtaaagaaatgatcttttccaatgaaaacacaggtgttaaacagaacctttcttctggcctacaaatcactcttctaacacttggaaaaaattaaagaaatattcagcaatgtgtagaatttcaatcccagagagacaggaagagactgtatagctgcagatgcaatatgcttgttattttggcaaaagcgtaacataagaagccaccaactctcacagaggaagcagagaaattcagtatttgcttgtaacttagatatttctttctttgttttccccctaagaagaacatatcttttctggtgggaaaagggaatttagataattaaagcagagggaataaacattttcaggaccaaagagaaaatagccgtttgagccacatatttaaatgttaatctacaatttttttttttttttttgagacaggatttcactgtgttgcccaggctggagtgcagtggtgcagtcttggctcactgtaacctcccttctcccctcttgggctcaagccaacctcccaccttagcctcctgagtagctggaactacaggcatgtgccaccatgcccggctaattttttgtcaagacggggtctcactatgttgcccaggctggtctagaactcctagactgaagtgatccaccagcctcagtctcccaaaagtgctgggattacagatgtgagccaccaccgtgcctggccatcaaatgtttttcatagtggactagggctttatgatcccataaaaattatttccctcatggaaccactccatttatgtattataaagctgtcaacatctggttttattgataaatatccctggggtttttgagctttttcttttcaacatagtgcctgtgttttatcttgacctttgctttaaaattactgctagatgtaatgaggattctggaaagagcatggttcaagattttgtacaattgatataatgattctgaagcaaataatgggaaaggggagagtttcagaatttggtggccttagggtaagcttatgatttgttttatctttcctcatatctacctaatgctgtgaaattttgggattagatttggattggggacaaatgaggagtggaaatagtggagggagaaagggttaggaaagttacagaacttggcaaggctcttggaggtggtggattgatttctctggtgttgtgaagtgtcatcttctttcttcagttaaactgaagtacaggcaagcttctcctgctgcccctcagtttcactgtgtcaccatttttagtagggataagcagagacttgttgttggtaaggacaggaaggaaggtgatgctgatgaatttttgctggtgctaggttagctgccagccggcctggcaatggctgtggtccagccagcctggggcgcttctagtattctctgtcatggggcaatatgttaacgaattaaaatgccaaatagaaatgagacagaattccaaagacatgtaaactgaaaaacacctgtccccatttgttgattttttttttcctgcatatacttaaaaaaccccaaacctttatgtaagagtctcaggagtgcagtgaaaaaaaagtgtttattgacgagccatttccaatttaggccttaaacttcaagacccatttctaagacccatatgcttcaaaacgttctatataattcagctcaaaaggatcttcctctcctctagatctataatgtttattgactacatccctcaaagagcagtaatgcatcatggtgaaataaaaattgaactgcaaatccgaagacttgaattctagttcctgatcgtttttcatagtgtatttaatcacacagtttaacccctaggtctccttcactgtgactcattatggtgagttcgcgtgagaaagtgtccaccataggacactaaattcaaaagagtgaccagtaatgattgttgtcccaaggatgtccaaatgggaaaaccattatcagtctacactctaaaccagaagggacttattccaccaaaagaggttaagggctccttaccacagtcacaaaaccagaatatatattctttcagagaaaacccggatacagggcatgagattagaaccctagaatggcatatcaaaaacttctggagtctgttgagtagaagtttggagaataaacaaattgatagattgatatttgaatccccggcagagtaagaggaataataagattttgaatcaagaagaggaattctgccacatgcaactaggaagaaaaaagcaaattaactgtgataacactcattagggattatcattatatctttaatgaggaggtaataaagactgattatttactaggcatcccttattgatccctatttatcactacgtagagtaaaatgtacaatttttcctttcacttgtggatttcattaatttatacagtcatcacatattgattgtacatatactgtataccagacactttattagctttaagaataccaaaacgaatatgccagatatagtatctaacttcatggagtttgtagagagattttttgaactgaatttctcagcaaactaacacaagaacagaaaaccaaacaccatgtggtctcactcataagtgggagttgaacaatgagaaaacatggacacagagaggggaacatcacacactggggcctgtctgggggtaggaggttgggggagggatagcattaggagaaattcctaatgtagattacgggttgatgggtgcagcaaaccaccatggtacttgtatacctaggtaacaaacctgcacgttctgtacatgtatcccagaacttaaagtataaaaatgagaaaaaaagatgcacaaatagtgtcacatatagtataataatgatatggatatggcctaattcatagagtcaacattctgatactaagaggaaggaaaaatcaaaacaaaataaagaaaaaacaaagcagacagtagcctttaaccgtttccttttaaagaaacattgttatctgggttcattacttgttagaaagtaatgtgaagcacttaataaacttcaggtggtggtattaggtaattaacatgtgaaattcctcatatggttatttaaatttcatggtagtatttaacagttttcatgtttatggccttttcctgcaactaagttgtaaaatccttaagggaaaggatgaggaaaggaagacaagagagaaactagcatttgttgactggctactacgtgccagccacagcactagctactaaacctgtgtcactttatttaaatatgaaggtcagaaagcatttctcatgttcctggtatctcctgcactgcctagtataatatttcatacttacaggtgcttcatcaatatttgtgttggttgacttagcaatttaaactgcttctaaatagagttacgtgagtttttccccaaagactcatgcccttttttaggaggcaaactagccctttccatgtcaccttccttaagaagcagggcaaagaggtgacagtttttatactgaaatcagttgtttaattgttcacccatttatcaaagcctctgtagagttaaagacaagtacagtgcccatgtaccctttatgctgcaagttctggacagatagctgtcaatgcctgaaaatagtgtaaattcactgggtgaagagagcaacttgccagggggatgtgatgtagccccttctagagtatggggttttctacttgggcatagtcagctgctagtttgttggattgctgctgctggggaaagaccaggccacttcatgatggaatgcgtcaacttttggaaagtcaaattcaggatgcagtttcaactagtagtaactatatttttctatcttttaaaaagtgaaggagcaacagaccagtctagacacatggacgggctttagggctcagttgctaaagagatagaagtaaaatattatagaaaatgcttatagtacatgttaagtgagaaaggtaaggtaaaaatggtttatgacctataactgtgtgaaaactaaccaaagagacacgtatcatttaaaaagatttaatgttgtgcctgtaatcccagcactttgggaggccaaggcgggcggatcacaaggtcaggagatcaagaccatcctggctaacacggtgaaaccccgtctccactaaaaatacaaaaaattagccgggcatggttggggggtgcctgtagtcccagctacctgggagactgaggcaggagaatggcatgaacctgggaggcggagcttgcagtgagctgagatcatgccactgcactccagcctgggcgacagagcgagactccgtgtcaaaaatgaaagatttaatgttggtcaaattatacacaacgattcaacagtactggaagttgaggaggacgagcaagccagatagcaccaatgatcatgaataaattccttatctttcagaaagcattattgttcagtggtttcaagttttggatgtgcactcacattgcctgtatggaatcctggctccacaagtagttgtgtgagattgggaaagttgcacttgtttaatctgtaaaatggaaaatatctgaggattaaattaaaatatagctggatcatgcatagcataatacttggaatatactaagtcatgaataaatagtactgttgtcatttctttgacattaattattaaggcaattaggaaattttccatctagttaacatatagcaaatcaaactaagctgtgaaaaatatataatatgctatggtaataagacactgaactgtgatgctattattggggtctgtctaaatccacagaagcatcagaaattcacataaatcaatgctaatgtcaatgcctagtaaattatagtctcagaaacatgaagattctagatgttttccccttctttgcacactttgtttatatttcaccctattactattatcacctatatttatggtttttcaatcatttgtgagtgcttggaggaaattcattggttcagcagttgaaccagggtattgaatagtacatgaggactctcagactctgaagagctggtcgggtgtctctggctaacacatttccagtggataaagagctgctccagggacatctccttcctctgcagtacagtgatctttttgctggtgactagaaagtccaggggaaaggacagccagccaaagggtggcaaactgatggaaagtgggggcaagctttctgtaaccatgtaaaagaaactgccaattcccatgaaaatccattgtctctttttcttattaacaaatccccaacaagccaccatggctcaagcctgtaatcacagcattttaggaggctgaagcaagagaattgcttggggccgggagtttgagaccatcctgggcaacacagtgaggcatgcatctctacataaaaattttacaattagtctagtgtggtggcacatgcctgtagtcccagctactcaggaggctgaggtggatcgcttgagccaggagttcaaggctgcagtgaactaggatcaagccactgcactgcagcctaactgacagagcaaaatcctgtctctaaaataataataattttaaaataaaaataaaatgctaaaatgaaccaaatctccaattttatttgaaataacactgccttagttttttaagaaagaaaataaaacatttctcaccttttctaacagtcaagctggtatgttgctttaagtttggtgagtgtcaggtatgcaaaagtgttgagtggcagatacagaaagactgcttaaaggcatctgactcagttgcaaaggacatcctttgtccttcttgctgcctgtactatgaatgtagtggttggatcttcagaagcctatttaatcataaggtaatcttaaagatggaagttatgattaagaatgccagaacacaaagataaaaaatatagaagtctcagatgaaatttctgaatcagccttaaactataatgcttaaactgtttaaatgtgaagggataaaatttggggcatttatgccactattttatgttatcgttgttacagtgagtacaatttttaattggtatgtgtgtaagatttgctcagatctcaatcaatggttctaagaggaaaaagcttaattccaagctgcctctctcctgtctatgatatcccaagcatcacaaagtacacttccagctcctcagaccctgtccttgttttgcattgtttagccaaaccacttcttaacttcaagtagcaaatagataactcacattagcattaggttctcttattacaagtaattgacaagaattgtaccagtgattaggtgttgcccaaagatcttttaaaattccatgtgacccaaatactaccaaatcctaaaagatttaactaactggctcactaaccaatgcacacacatacttacttatttcacccagtatgtgttgactaccttttgcccaccaggagctaggcaggttcacagtgcctagctcccaggcacaaagataaatcagaaaccattctgtctaagtcaacctttcattttagcttagcaggaaacacactaaaccacggctgaaatatgccaggaagttggtagctggtgatgcctctaccacaccgcagtgcggttaatccagcattcgacttagtcgaaatcacttttttcttccaatactggcatttttatggatggatggatggatagatgaatatcagtatcaaaaggtccatgctttattttctaataacaattcatgtccaattatctgactgccagcacagttatctgctatggttgttagaaactttagaaagaagtaaatcctccaaaattgtcactcttaaaatctgagagaaaacagaatgaatagataagagatgcttcaaggcagttcagctctgtgatggttccgttgagatagaacacacatatacaaagtgtttgaagtaagaatttccttcgaggagaagcacaaagggaatagaagacccagcatttgttactggccttagataagcttactgttcacttatttatcaatgtaaaaacgcccagttagtttttagctcaaggaagagaggacatggccaaagatggccttcatgaacttttttttttcctgtgtgaagtatggaaactcattttcagtattggattttgactggattgtcttctacccagaagctggctctgcagaagttatgatcagatctttggaagtaacatttgatctaccgccgaatatagatccccttccttccctcttctactccctccttgcttttccttcttattacactgatttcatgcaaaattaattatcagtcctgtcacatcttgcactgctaacagtggtcagtattgaattatggggaacgtgaacagaattttcagcagcctaattgcttctcctgtgcccagcaaaatgttacgttaaatactcacagcaagtagactagactgtattctatttccataacaaactggcgggatttcattaccagaatccctagcatctactcacatgactctttcctaactgccctatcagactggtcttggataaagtaaattcctttccaaagctgcagctgcctagttaggtattgaaatattgtatccacttgcaggtcaaaaaggaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggagagggaagtgcagagtgaaggggggaaaagccccgtatagaaccatcagctctcatgagaactcattcactatcaaaagaactgcttggggaaccgtccccatgatccagtcacatcccactggttccctcctacaatacgtggggattatgggaactatagttcaagatgagatttgggtggggacacagccaaatcatatcaatgtattaaaacagttaatctttatagtgatagtgattctttgaggtattattcccatcttaagaatgaggaaactgaggcactgagaggttaactcacagctagtaagtaagagagcaagaattcatacccagcagtatgaagaagtgaaggatgagttgggaatacagaacttgatcattgagagtcatactagtcacaccaaggaagttagagttaatcaattgacaacggggagctcttgaaaagaactgacaaggtcagatttgcattttagaaatattgttgtggaaacagaaggattgattagaaggaagccagaactggagcctggaaagttggctacatggctttcacagtaatccaggaaggggatgatggaagagaggctgcagcatgggagcaacagctggagtgaagaagagaggatatgtgtgggaaatctttaaggggtacatttggcacaactaggtgatagacagaagtgatgggtggggagtagaattggtgaatctactcttctaactgcctttccctatctccagtctcaccaagtatcttgaattaggaagcaaggaaaaggggtcaattaagaaaaagggagagcaaggttaatggagaacaggctcaagaaggaagaatttaaaaatggaataaggcaagagaggataaagaaactacctatggagtgctatgcttgttacctgggtagcaaaataatctgtacaccaaatccccatgacatgtgatttacctgtataccaaacctgcacatgtatccctgaacctgaaataaaagtttaaaaaaatagaatgagttaagagatttggtaatcttgagaaatgtctgtaaagtgtccatgtattccatgggttcaatggggatctgccattgaaattcatagacctgaatatcagagaagggtagaagattagagaatttgctgtttggatagtcgaactccttctttcatagatgaggaaagtaaagtctagagaaattggagagacttgtgttatatcacttagtttgttacagagctgaattcataccacccatttccatgtgccctcaaatagtagccgacctcttccttcctgggagagaatccttaaccaccaagtcctgatctcataggcctgatagtcaatccttggaagggatactgtggtgcattgcttagatccgtcccacttaaccctgggacccacatactcactcaccaacctgctgggagtgctggtcactgacctgtctcaactaggttgactccaggaattgctctctgctaaaggattttttctgtttcagggatataccaaaatgaaaaaataaaaattttatataaagagcgtttgttgcctgggttgtatgcctgtagaatacattcagaggtagaattactgtttcaatagtattaataaatttttacccaatggcttttcaaaagtgtgcatccccaatggcttttcaaaagtgggcatcaatacacacttagaaatatgcagtaggatcaatttcaccaattatctcaccatctttttagaagctaattcattttgcattcttaaattccactaaatttcaagagagcagttaaagaataatacaaaactttgaagcactaaatgtatatatttaagatattatgtcttctgtagtcaatggcaaatatcaagaatagagaagatgcacaaaactgaccagtagcagaaacagagatccacattctaatctcacgtctttctactttggttaaaggcaataattcctatttcactcactgatgagtctttccctaacgagaatgtgactaaaaccagttgagtttgcgaaagggatgtagaaagagacaattaggtaaaggtgaaaaatgagactgacgaagtgacgttggtcaatctcctgtttactgagtgcaggttaggaaataacatcaactaggttttctggaatttgagaactgagtattataaaaacactgactccgttattattattattgtcatttttaattttggattcagagataggagctgaatagcagcaaaaaaaaaaaaaaacatgcttatgaagagctgcctagtgaaaatgacactcctttggcttaggaagagaaagaaaatgaaagccttacttctttcttctactgattgaagtttttactttctgctgtttacttgggtttttaatattgaagacttctttgtagtctctgatgagttttgaagattaattttgcagaagtaagataatattcctgtttaccagaaatatttctgaccataagactcattatttatttattatggatggtcattttatatatttttaatgcttatttaagactccggagtacatgtgcaggcttgttacatggatagattgtgtgccactgaaatttggtgtaagaatgatcccctcatcattcttagcatagtagtcaatagtcaggttttcaagcctcaacccttccctccccctctagtaatccccagtgtctattgttgacatatttatgttcatgagtactcatagtttagcttgcaattacaagtgagaatatgtggtatttggttttctgttcctacatcaattcacttagggtaattgcctccaggtgcatccatgttactgaaaagaacatgatttcattcatttttcttttctgtggctgtgtagtattccatggtgtacatgtaccatattgtttttatccaatccaccattgataggcacctaggttgattctatgtctttgctattgtgaatagtgctgcagtgaacatacaagtgcatgtatcttttttggtaaaataatttgtattcctttgggtataaacctagtaatggaattgctgagttgaatggtaataccattttaagttcttttggaaatctccaaactgctttcaacagtgtctgaactaatgtacattctcaccaacagtgtagctttccctttcctctgcaacctttccaacatctgtttttttgtttgtttgtttttcactttttagtaatagccgttctgactggtgtgagatgatatctcattgcagttttggtttgcatttctctaactagtgatattgatcactttttcatgtaattgttggctgcatgtatgtcttcttttgagaagtgtccgttcatattctttgcctatttttaatggagttatttgatttttgtgttgaattgtttaagtttcttacggattctagatattaggtgtattttaaatgcatagtttacaaatattttctcccattctctaggttatctgcttactctattgatagtttcttttgctgtgcaaaaagtctttagtttaattaggtcccacttagcaatttttgtttttgtggtaattgcttttggagatttagttgtgcattctttgccaaggccaacgttctaaatggtatttcctaggtttccttctaggatttttatgatttttaggtctcacatttaagttttcaatctatcttaaataatatttgtatatggtgagaggtgtaggggtccagtttcaatcttctgcatatggctagctagttatcccagcaatatttgttgaatagtagcgagtcctttccccattgcttgtgaccatgagattttatgtgatgttgaaacccaaaactacccaaaggaattaactactgctggttaattgtacctatattaaacactttctttatagtattttccttatttgggggccatctcaaagtcctaacaatcagaatttgtgtcttctcatatgatttttactcagaattacacagaatacagtattcataaaaatgaaccaaccataaaatatttattcttctactgtgtcaggtagtcttgtaggttcctaagagataccaaatacaggttcataattcttgtcctcgaagatctcccaatctactgataaagcaagtaccatatgcatgaaaagataaatgtctttataaagtttcttaatcatgagtgcccatttgagtggtctgtgggtttttagaagttattcacagaaacgaggctccttagttctgacatggggaccatttgtttttattttcaaaaagctctatgaagtgatttggatgtaaacctctgaaaagaagttattgtcttaaatattcatgggaggctaggcctacttgcatctggagttggctccagaagtctttacaaagttagcttggcattggctgggtttcaaagaataaatagaaggggataaaccaagaagaaatgtggatatatatggggcacgattgaataatttccagaaagaaatcagatagtacaaggagtgtccagagaatgatgtatatggctgaaatggaagtgttatagaatggtagttagtaataaagctttaatatcacaagcatattgaaacaaattgcatgtaaaacactgatgtaataaaaagatttagattgttggagtattttgatgtcaagtacttgtcttcctggtgatgtgaaaccatgcatatgtgttttaagtagaaatgtgactccatgggaaaacatgtaagaacatgagcaaagatggatgagaatagggtgagtgtgaagggaaaacttattaggatgctagttctctgaggttataaagaccataaggtagtggcattggagtacaataaaaagatgacgacattttaaaggaagaacctccctggcagcatggctgaatagacctgggaagaaagagaatttatgcctgaatgaatggaaaactgatgattttgtatctcaaagtggataatttatttagaggcaactggctttggaggaaagagaaaatgaggggttttctaatgtttgagatgatagagaaacaggcaagcatagatactttggaggcagttggatatgtagcattggagtcaaaggccaagtaagaggtagagaaagagattttggagaacttctcatggaggaaatacttgaagtctggagaatggatgagacctgaagggaataagatatgtagatagagacaaaagttgaagggtaacactcagactttgggggagatctacatttaggaagtaggaggagaaaagtaaaggcacagtaagaaaaagaaagattcaactaaagaaaaggccaaaaaaagtgtaacccacagagaaaagagcatttctggggctaaggagtgatcaacactatcaaaatactacaggtaaactagtaaaacaagtaatgtcagcattagtttccttgtctgcataacaataatagttattatgaggtatttttgtgaataaactgaaatgatgactattaagcatttagcccaaggctaggtaaaagaaaaggctagccaaaagcatctgttattataaatataataattactaatcagcacccaactatgccgggcacttttgtagttacacatttgaataagatgcaaccctcaatttcaaagaggtaagtgtcaatacaaagataaagatgtgaagaatagatagataccattttgtggtattgtttctacaagaaagatgtaaatacaatggaaaaggtgccagtggagaaaagtgataactttatgagtcctttgccagacataagtgatagggttttctgtacatattacatgttattcttagacttgtgcaatttgctaagccagtttatagactcttgaatctgtgtaattgctatgttcttgactcaaacctgaagggacagactcttgggagggaatagccaggttcagccttttatctttcttctgtgcacagaactcttgcttactttctccaccatgggtaaatcagaatggctttgaacaatgagcattttctgcagcctgagcagcagttgctctttagacccaatttacaaattaggaaaaacaaataaattatttatagcatgacaaaaataggatttggcttaatccaacagctttctcagttacaatgcttgctgctcaagtaatggatcaattcacagttggctaaatccaggtgtttttgaacctttctatttaaagtatggttctctgaccagcagcatggagatcccttggatatttgtttcaaatgtagaatctcaagccccactccaaacttaactggataagaatctgcgttctgtcaacaactttagaggcactgtatgcagattgagaggcactgggctagaatactgaattagggctgaggaacatcatcacattctccacgctgtcccagtatactgttggatgatgtcagagcaacgtgaaaggattttgggttatggtttagctcatagtccatgcagaagaggccataattagcacagggtaccatggcacttctcatctgagacatgtgacatggatttgcacagatgagtacttctgacctattaatgttagtagtagaagtgatccttttgtcagtggaaaaagctgccagactcagaagcaagtaaaacctgaagaatcttttagaactgttagtcaagaacttcataggtggtttatataaaatttattgtcacttgctaactgcatggctttcggcatttcttaacctttctaaacttcaatcttttcattcatggaacgtagataattattgtacctgtatgacagggtcaatgaaaggttaaatgagtgaagatacataaagtagttagcacaggatctgggatttagtgagggcccagatactacttgtctgttattatttagtttatttagtttatttttatttatttatttatttgagacagagtctcactctgtcacccaggctggagtgtaatggcgcaatctcggctcactgcaacctccgcctcccaggttcaagggattctcctgcctcagcctcctgagtagctgggactacaggcatgtgacaccacgcccggctaactttttgtatttttagtagagatggggtttcaccgtgttagccaggatggtctcgatttcctgacctcgtgatccacctgcctcggcctcccaaagtgctgggattacaggcgtgagccaccgcacccggcctattacttagtttattattatttcattattattgagtatctattatttgatcttttatgtaataatagtgaaataatagacttctgaatatttgcagagaaatccaataattttaagtgatattggcaaatactatgatattagaaatctaggtggtacttaggaatctattttcttagtctctattctgtggccagggaaactctttattccttttgtccctgctatatttgagacaaagatcttgaatgcatccactcttccctaaggaaatgccatcaactcatcatccccataccatgcaaatgccttttacagctgcagagcaggtgtgggcagatgcatacagcagcatatgaacacatgtttaccctccttggccacactttgtcttactctatgttttctaggaacacattttggggtggaaatgcctttattccatttatatttagtcaattatctggtttagcttccattcttacaacctaattaaattcagcccatcaactcagtttaaggcatagcagctgtagacacttcgtttatctacttggagagaaaaaagataagttggtacaggggttccccatcttgtgaatgcaattcccattcaactacatgcaattgaatatgagcatgggatggtattctggacctaatgttaaattctgctactaagctatcatagttgaaataatatactcaactgcaactttacatattttccagggaaatgcaaatgattgcttttaaaggaatgacaactcatttgcctgcagatttcattcaggatatttaattctgaactactagcctatcacccattaactgccatttctaatatcttttgactccctcaaagagggaaactcataatttgtttcacttagaatttacatttttttaatattctagaaaccatgaaagaaatcactgagtccttagctcctgttttttttttttttttttttggttgttgttaaattgtagaatattagaatgtttcagttttactgattgtatttgttaatcattcttcttccactaccgttgtcttttcccatcctcttggaagggtgttagagaagactctatatctcacctacagatgatttcacctagaagcttagcctcccttcatgactactgttaaagataaagactgcctttggttgacaccataacccacaagaaatgattgcattcctcctggatggggagcaggtgacattgcagatgttacacttcccacatggctaagccactgatcgagattaaaaattcaaaagacaccaaagagccacgttattgtcccctcacagggagctctagaaatacatgacctaaattgtttcttctaagcatattatcagttccattttcaaggtatcaacatgatatctttccattggttcacaggaagaccaaagagtgacaagagaaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaaatctactctcttagcaaatttccatgatacaatacagtagtagtaactatagttatcatgctgtaccttaagtctctagatattcgttctacataattgtaactttgtaccctttaacctatatctccccatctcctcttccactgcatctggtaaccaactttctactctgtgttactatgtatttgactgtttattagtgtcgacttaggagtgagatcaaactctttcactctctctttctttcccgtttttttttttgtttgtttttgtttttttttaaacaagatctcacactgttgcccaggctggagtacagtcacatgattccagctcactgcagcctcaacttcccaggctccagggattctgtcacatcagtgtccttagtagctgagactacaggcatccaccaccacacctggctaattgtttgttgtagagatgaggtctcactatgtttcccaggttggtctccaactcctgagctcaagtgattctcccacctcagcctcccaaagtgctggaattatggtgcgagccactgctcctggcctctacagtatttttcttgctgtgtctggcttatttcacttagcataatttcttctgggtccaatcatgttgttgcaaatggcaagatctccttctttttaagactaaataatatgccatttaatatgtacatctaccacaatgtctttattcctttagcatgaggagaatattgaacattactttgagaactagaaaaaaatgaacatgtgggttattttagtggttaaaaaaaataggaaaataactataaagacatgaaccaactatcaggggatgtttgggttgtttccatatcttagctattgtaaaaaatacaagaaagaacagacatctctatggggtgcttatttcatttcctctgggtatacccagaagaacaattgctagataatatggtagttctagttctaattgtttgaggagcagccattctgatgttataatggctgcacctatttatattcccactaacagtgtacaggcattccctgaacttcactctatattttatttcccaaatgagatggaagtacatggaataaagtagtattcaagccagtttagtcttcacattctaaatcacccctctatgaaacctctccagattaccttttctccccatgtggatctgaatatgctcctttattcccagttgtcctgtatgtatccagttttacagacatagcatctgtaaaggacactgttgtcttacaccgaagtgtagcagttaagaactcagggtttgcacctttccagctctgtagacttgggccggcaactgagcctctttcacccatagtttctttatctagaaaacaggagtgatgcatgtctcataggaccggtgtaaggattaaatgaattgtaactagaaaattgttgggaaataccaaatataattatataatgactagcctctgtaggtataaacagtttaattacttataagtttacatgtctgcttatattaaagagggaaagacttagactgtagttcattttcatgtctctgtaacacagcactctgtttagtagttacataaatagtgattgaatgaatgtacaagtgagtgaataatcatctcaagtctatcctttgtcaaggaaaatttccagatagagttctttctcctttagggggtctttaagatggtcccagtgccagcccaagaagagccagagctagatcttcaaggcagtctgggacctggatcctcccctccagatgcctagaggtatctcctgggaccatgatgggtctcagtcataccccttcattcattggttcatgtcttcatagtcattttctttttttttttttaaaccactgaaataaccctcattgtttgtcattatttctaatactcaatgtagttttaaattttctccccatgctcaagaagagaaatggaaatatggcaaacatctccatgaacccacattttctcacatctttagatcaaaaactcttattcttcagataaacaggttgtaaaattttcagtgttgaagagaatgaaatatgacatttgattttattgattcattgcttatttttggcagaagttatcctttattcagtttcatctctttatgtcttaccacctctttgtgaactagccacttgccttgagggtttacaaattcaagatttctcagcacgattagccctaatagtatgctttccttccaaggtttccagattatccaatacagtattatttctatcccaatcatgtttaaggattattattttacatagaaataaataaagaaaggggaaccaatacaaagtgttagaaagacagctacgattaatatattggactggcccattatcagaccctctagattttacaggtagctttctgatcagaaatctcgggtgagaaatagtaagaatgatggccttagttaaatcctctatcaatatgacaggttaaaaaaaagacatatgagttagttaaaagcacctctcccttggtaactctaagtgttttagtttttcagatggcaatttgtgactttctatagctttttcttgagatgaatttgtggaccagttgaatagtgatagaaatacaggacttgctaaaaattacaaagtgtttatggcagttctggcaaatatcctctagatcaccagataatgccaagtcagcaatattatcaataatgagttgcctactaagaaccaggggaatgggggcatggactgaaactttaccatagacatctttgctattctggactgttggtttgcttcctagtgtacttctgcttatcctttcttccctttggcttcattgagatcctcagccactgagttctatcttggtgcattccagccacaccccaaaagaataacaagaatgaataagccatccatctctgaatgtagagcaggttggaaaatgataaccttattcattattattgcttgatacatttccgaatttgtgttatctgtcattaaatagctaccacagccttctttcattcttctcggtatcagtttaataatttgttcaatgaatatgagaaagaacaggatcacatccagattttaccacttactggctgtgtgacactgggtatggttattaaccccatggaacctcatctttaaagttcagatgatggtaactaactcatgaggttgctagggattaaatgaagtaccatgtttaaggcttctggcgtgggtgctgagatatagcagataagagatggtagtcaaaaagaatgtgtcttactttttttatagtatatagagtgacaattttcaatacaaatagtgtctgtatatatgcagtcttaacacggcattttaaaatttcattgtagactttaaaaaacctaacaaattggatttcagcctctttcttactatattagaaaataaaagaagattaaaataaaaaaaggtttccttttaatcaatctattaataaaaagataagtactgagattccgttgacataaaagtaattgaaagtttataggcaaattcttgaaatagaaaggcactttttttcctcataagaggacagtttagaggatttaaaaagcaatcaaaggtctcatgttttatatgatcaattcaaattgactgaattttcatcatcatcctcctccctccttctttctgatagtctacatttgtggaatagagagatttttgtctttcaaattctaaccctgaggatttttgctaggcacaagttaagacctgtattgttttctcctaacagttcctatgacatttttaaagtatttactttattctagtatgtccattctgttgatcttcgaaggacctgtgtctctaggtgacatctgtattcaaccaattttgaagactcttctgattggatttagcaggagatttgtagagtgtggggctttgactaggcccaggtcctttgccagccaggcatagtttgtccttgtgagggcagatattggaaaggtggaggagaattatgttctatggcactttcagaagctcgagaataccttggcagagccaagccttctgcttagggaatggctagcagtaacaaagcatggtacctgagatcaggtacatagtcaagagttaggttgaaagtcgaatattaacctgaaaaaggaagatttggcagcacagtgtatcttacagtcccaggaaaagagccagttgacatgttctgtgagacttcagaaaactgtacgacgtgaaagtagaagcatttctaatcatagttatattttgagtaatctcttcacagtagaatgagtcccccaacactggatgtactaaagccaaaggaagggccaccacttttcagagttattgaaggaattcacccatcagatatgttttgattttattcagtgattgttcaaactagatccgtttctctaccttattttcaatgggcagtggttctctagttcatcaaaaagtttttcctctggaatttttgagaagcaatagaaatccagagcatttaaaggtgatgattaattagtatattaatcttagataaatgtccccagataatttttaaatgatcaaatttgtatcaaagacattatttattttagcatcattttgatttcttctactttgttgctggggttggggtaaaagagggagaaatggagaccatatataattccgaaatgaaaaaaaataagcaacaatacactgaattttcttagagtaaacataatgctatgctgggttgttatagcatttacaatgctcatcttcccttacacttgaatgacttcctcctggatctgaaacaccttcctcaagagcatcatcacaggactgttaaaaatcctaacatgttacaattttactacctttcttcttccagtattccagcttggagactttgcgtagccctggttaattaatgttgaacttttcagggtatctgtgaatcatggtggggggtagggttggggactagaatttaattaaaggcacaagcttcatggggattgtgaaatcacagattccaaaagggagacagccattctagggagactgctaatagggagtaagcagggtgacaaagtgtgcaggaactgaaggaagatgacattcaaaggtctaaacaggggagaagaaaaacaaagagatcagcatgttacagctgagccttttcaaatgcacggtgataaagaacagatatgttttgtgtgtgtgtatgtgcgtgtgtgtgtgcgtgtgtgtgtgtgtgtgcgtgtgtgtgtgttatgcacagtggcttgaaggtagcagccctttcccctgatagaaatttgatgatggcagcaacaaaacctaaacagagaataattaaagagtaagggggtagttaatgaaatgaaaataactttaaaaggatgaaaagaaattgttgttaacacaccatgtggtttacctatgaacctagctgctgtggaaacataataacacagagtcagctcctgcaatgcaagtaagccacttcctgggtagaaatggggctcttcggaaaaagattaacttttctgtccacaggggtattatttagctcactggaatagcaatttgacaaatggtgcctttatggcccaagtgaatactgctggtttctgctaaaagggcaggtgctacaaacccaagaagaaaaacattcttgcatacttgcccccctcagcataaggacaactttgagcctgttcatttttgagagttccagcagtggaaagaaagctctaaggtttggtaacctgtgactcacagagagcagaatttcaagcctagttgagaaaacattccttcaagagggtgctgcttatctgctttggccacgttggattttggaatcttaactgttcttgtcactttggtcctggttcaagtcaaaagagtttcttctacttgggacttgaattaggtgaagactgacggacatttatttacgtaccaaaatacacaacatatgtgttgcagttagttcctccttacagaggaactggtaagcactttagccaggtagggctaaggcaattttcacagttctgactgtatgaggattcctgtttctttgttgtcctattttatgcatcatccactgattctcatctaaaccccaggccattttgcgtgaaaatagtccttctataaataaaaaatttagaccagaggcaaaggagcctccatctctctgcttacaattattgctcaatgttcaaagttctcaagacttatctcttcctattgcaatccctaatatacccgtatatagatacatttaggtctgagaatgcttgagcttaaagagagtaagttcttgtttggtacaagctctgcataatacgtctgagctgtctccctgctttagaatgcagtggtagaagttttttttacagcactctgattttagccaaggaactaacaaccgttgtgtaatgcactagctaaaatagtctcctttatcgtgtaaaagtcatccattgactcatttatttatttaccaagtgcctactatgtttcagaaagggttgtaaagggaacagctaagacaaggtccttgtcctcatgcatgtcatactctaatgagaggagacagatcatactttaattggtaaattatagtcaattgccaacagcagtaagtgctagagaggaaaggaccagaataagggtaggaggtacttttgagaggtgacaacgtgctagcagccctcgctcgctcttggcgcctcctcggcctcagcgtctgctctggctgcgctggaagagcccttcagtccgccgcggcgctgtgggggcccctctctggggctggccaaggcctgccctctgctggcggggaggtgtggagagacaggcagaggtgggagtcggggctgcactgggcgctcgctggcaggcaagggttcgggctccgtggccccgcactgggcgcagccggctgatgcctgctgggcttgaaaagggacgagctccctctgggctgccggagtgcccgtgctaggttccaaagtcgccagtgagtgccactgagaggtgaagccggctgggcttttgggtggagtggggacctggacaacttttctgtctagctaaaggtttgtaaacacccaatcagcactctgtgtctagctaaaggtttgtaaacgcaccaatcagcactctgtgtctagctaaaggtttgtaaacgtaccaatcagtgctctgcatctagctaatcaggtaggggacttggagaccttttctgtctagctaaaggattgtaaatgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaaggggattcctaatcaggaaggaatcatatgtggttgttcactgagagcaatcattgacagtctcacccatgttctacaaaatttcacttcatgattaaaacaaattatatctctgtctttgcctaagacgtgtattaaataacagcaatacaaataataaacatattaagtccattctgtgttctagtcacaatattaagtattttatatatattatttaatcttcacattactgctaagaagcagtgataaaaccaagattttaaaatattaaccaatttctcaagactaaacacagctagtaagttgcacgacctggatcaattctccattggcttgtttccaaagccacaggtttactttaacatatacagcttttatagcactaacattgtgttctatgtgtccgtcattaagttgggtattttacacacattatcttaatatataaaacaattatatgcagcagatgttattaccatgatactgcaaataagaaaactgagaaatagaacattcaagggatttgctcacagccaaataatagtaattggcagtgttaggatttagactgatttctgtgtgatctgtagtccattctgttcaacactacatgtacctgccttcccgtggtatcattgccccagttctgaaacctaggtctaggtcgcaggagaactagcttgataaggatgggctttagagccaaaatttaagccatgctttgtcttatctgcataattttatgttcccagtcaggtaaaaccttacccatttatctttatttcctatcaaatgcagacttccctatgagctgttgcttggtaagttccaacccaatatgatgtcaccactgggtggacctctatggcacctgtctcactctgccttggttccagttatttttgtatatgcttcattgattatttctactcacttcccggaaatgttccctttccctgagaaatggagttgtatctccctcattgatgcatcctctgtaacatctagctgtttaatgtgtcactcagaataagtgctcaataaatatttatcaaagtagctgatgtttcaggaagtctaggaagcaaaccacctcttctgttctgctcttggattcaagaacttaagaggattttgttggaaatccacaaagaatattttaaacgagacacataataagactctcttttgagatgagagaaaccaacaacagcaaaagatgggtggtaacagaacggtgctgtttgctgccagctgatgttcttcttgcctcctggaaagatagagccagaagtcttccatcacttcttgggatgagccaactggcctgttttaacctatattacttgagttttggctaccaaaactctaagcattcacatgggcccccacgaagctctgccatctgacactttcagcaccttcaactctatccagtctcactcctgctgtactaacaaacattccataaacacaaaaccaaaaccacttaaaaaaaaaaatcttaggctgtccctacaacttttgctatcctcacgaaagagtgttactccagtgagacaaaagtccatcacaagaaatgatttttctacggaaacagctgtgattggagcaagatacaaggtaaaacatgttgtggtcaagttcaaggagaaaacagggtggctagccctagcaatcctactggtggacttacttctgcacacttcatgctactatctatcctgtgttgtctaaggctatataatgtcgagagacgggctagtccaggaatcatgacagcaaatgagggagagagagagagagagaggagacagagagatggctcttgcaacctttccaatagcttttgataggttacgtatggaaaaagcctcatattgacatcaggtttacttaggttcaagtgaaaataatgtctttaaaataaattatctcttttgatgaaggaagtcctttttgttttttgataccatgttgcttttgggaaaacatgcctgaaagtaggcaagtttctctaaagcaagaactgtaaaactcacagaaacataaagttgacttgatcatgcccattttataaataaaggaatggagactcaaagcggttaagggacatgtctgcagtattttacccgtgagctatatgccctctgggtttctcctcatccatctgcccccaacaactatgctctttcctctttcctttactgtttctgggcatatcaaagccaaacttaacagcaccaatttcacattaaacaaaagaagaggaacctactgaccaacctttccccatcgccaccacgtctagcctcgccagactctggtaatcattacactactctgtaattctaagatcgacctttttagattccatatatgagtgagatcttgaggtatttgtccgtctgtgtttggtttatttcatttaacataatgctctctaggtttacctttgctgcaaatgatgttctggtgttctgttgcacagtagggtaactagagttaacaataatatattgtgtcattcaaaatagctagaagagagaattttgaatattctcaccacaaagaaatgacaagtgttagaggtgatagatatgctaattgcccagatttgatcattatacaatatacacaggtatggaaacatcacattgtaccccataagtatgcacaatgattatgtgtcaattaaaaacaaaataaaacataaacaggagagaaacatgagctaaaaagaaaaccagtaagcaaatgcactagctgaatcagatcattttatgcctcttgatcggactttgatggtgggaacatcaggctacaactcttgcctgaatccacagacatggaaggcaagagaaattatttaagcctatgcaatcatccaggaatggaaagtgggaatggggttcaccaaacgtactagttttctagggctgttgtaacaaagtgtcacaaactgggtggcttcaaacaagacttatttttttcctattctaaatgctagaagtctataataaagccagggccacattcctgctgaagactgtagaatccttccttgcctcttcatagcttctggtatgtgccatccacctttggtgttccttggcttgcaactgcatcactctaatctctgcctgtgtcatcaaatggcgttttccctgtgtgtctgtatttgtctgttctcatgctgctttgaagaaatactggagactggataattcataaaggaaagaggtttcattgactcgcaattccacatggctgggaaggcctcaggaaactcaaaatcatggtggaaggggaagcaaacacatccttcttcacatggaagcaggagatagaagtgcagaccaaaggggggaaatggcccttatggaaccatgagatctcatgagaactcactatcatgagaacagcatgggggaaactgccaccaagacccagtgactccttactgggtccctcccatgacatgtagggattatgggaactactattcaagatgagatttgggtagggacaaccacatcactgtctgtcttcacatggtgtttctttcttcttataggaacaccaatcattttgagttaggatgcattctaatgacattatattcgtttgattacatctataaagatcctatttccaactaaggccacatttgcaagtactagggattaggacttcaacatatctttttggagacacaatttaacccataactccatgttataactgtactttttcagaatatcagtacgatggtgcccctaatcaacaaatatattgtcaccaatatgctgcagtctgggagaacattcagggatttaatttttctgacacacagactgtgagttcttttgttttttgtttttgtttttctttttttgttttcagcacatcacactctggctgtcattatcagttccccataaactgtgataatttttgtgtcacatagagtgtttaggttggcctctgatgaaatgaagcccaagtacttgctcttccaggcacctaacccagggcaaaaacacagagacctaaatgccttctctcagattatttttttattatatttccagtgagcagaaacattacagatgtgagacttgttctagaaatcagagtatttccccagggaagcattatcactgttcagatattactaagaagtgtaaaatgctggagggcaattgcatccacaccgtcctctgcccatcactgcaaagggagaaaggagaaggccatggggggatgcagcaagaccccaaggtctaggctcctctgccaaaggagcatggatgaccaatttggaaagaacacttgagaacctctgctctgtcctcttcacttcactagtgagaaagctaaagctcagaaaggataaatgacttgactaagctacttattggaaggtgggtgattaggatgtagcataggggtaagactgtgtaaccagctgacactgctttaaatgataaagcattgagttgttctgttttaatggtacacaagtcaaaattgttcaaggattgagagtggagccagaaagcctgggtgtaaatcctggctccttcacttacaagctgcgtgatttggggcaaatcaggtaaccccttcctacttctgtttcattgtctgtaaaatggatattataataatgtttacttcatagattgatgtaaaggtcaaattcataatatgctaaaagttcttggaacattgccttacacagatcaagtgttaaagaagaattgatattattattattgttattgttattattcttattatccttgagttcataatcagggtgtcctgaatatactacacccaggaatggaagccccaccacattgtaaagacacattcacttcccttaaacctcggcatatttgaggtggttgtagcaatagtggagggagagcagcaaggatggacacaaagcttacagtcacccagcagtgtaggaaaggggggaatcctgcacacactcccagacatggtggaggtcctcaatcactgcagagaagactgttgtgggaatgacagcaaacatgtagctcatcaagaaaatcagctgacttattagttcttctggatctggttggagtccctgaccccagagctaaattataaaggttattttgttgtaattttgatgctctaagaaactgatgtaagatatagaaaagttcttttttttttttttttttgagatggagtcttgctctagcacacaggctggaatgcagtggtgccatctcagctcactgcaacctccacctcctgggttcaagcgattctcctgcctcagcctcttgagtatctgggattacaggtgtgcgccaccatgcctggctaatatttttatttttagtagagatgggttttcaacatgttagccaggctggtcttgaactcctgacctcaagtgatccacctgcctcggcctcccaaagtgctgagattacaggcatgagccaccgtgcctggccttataaagttcctcctatattatacgtgcccatacctctatactagtttttctctcttaaagctacattgccatctcttgtattatccgtgcatttgtcacctgccacttgtcccccatgcccctcctttctagcctgtggtttataacatgctgtaagtctggaaaccaaataatcatgtttattagacttgtatgtaaatcgaacctaatgctcctttcctttgttgttgttttccttgataatgtggtcttttaaaagagtaaaatttgaactaggatttatgaaatctaggtttaagtttgagttctttttctacttatgtgatcttattcgagtctcctgacttctttggataaagcccaaaacaccattttacaggtgagaaaactgacagagtgacgtatgagtagaacagaggagaaaaggaattgaaaattcaggtctgtcaaactgtaatacccaggttctttctgtttgataacaccgttttcaaatgttgagaatgactaaagaaagatatagaaatttgtaatgattaggtatttatacattctcaataatgaattttggtataaaaacatatttttttatctaactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagtaaagtttgctggtcctttcatctatgtctatttctcaattggcttggatttcacaatgaagagggctatgatttattggcccacttaaacctcaacatggtagagtggcaattttgtttttctggctcttatattgcaatgaatattttttatttgacagtctgttataaacgaaaataatttttttcactatcagtttctactcaaaattaaatggtagctctagaatagtggcctgcattaaatttttctttatggttatagccatgcagatagatgcatgaactcagaggactaaaaatgtgtttccatgtaatttaaatgtacctttctatacggaacggtctgctgtcatgcaactttcaaataatgcattttattatcattatcttttccggcattgattaatcctactgtttattggctaagtgtacatttcctattggtatgtttctgagtcaaggtgaaagcagttaatacttaagagttgagaagcaagtttatttaaatctagtctttcttatgagtctgcctaacagtgatagattttgttgttgagccacagtttatgaaaagtgcattaaaacctcgagccgacccatctctctgaagcagcagttgggccattacattttggcaggcacttcagatgtgtgtatgattttatgatcaggtctgcttaattcatcccaactcttcaaagaggaagggaactaaaattccttgagcatcttctagtatgtgctagatgcctgcatatgttgttttatcctcatgacaatctctcatggtagatagtattttttcagcattgaaggtgagaaaattgaggttcagagagtttaaataatattgtcaaaaacatataggaagtgatgaagttaagctttaaggccaggcctgtctactcaaaagcctgtgattgttatattaagggttaaaaaaacaaaaaagtttgcaagagacagacaagttatttgaacggaatgaagtataagaaaacctgtgctttccttaatttttcttgaatcctgtggccttctcagtctatcctttattgaggttcagagaggttgctacttatatggtagcaaaagtatttcccttccctacttaccctactatacaaaacaaacaaacaaacaaacaaacaaaaaacagaaaacttgatgataaatgtcaatcaacactcagcctctgcatctgatgagcaacagaaattagcggggactgtggtgaattggaaaacctgtgcctttctctcccaatcagctctggctgattgtcctacagaaaatgttggctctgtgttactaaatcttaccattttttaaaagaacagtctagctgttcacgagagatctgatcttaaaatgttgaaaactaattcacatagaaaaatactatgtagtacccacccctcaaaaataaaacttatgtgagcactcgatccagcataaagtctctgaatttgtaagttctgtattacacaaggcagctaataagtaactactgggaaaaataattaacaaacaaaaatcaaatcaaaataattttcattactcttccaataattgtgccttccagatttagtactgtttgtgtattgtgcctctctgtggtagaggcatgacttctggtcctctatctgcccttcacagagtggagatgaggccagtatgcaatgactactcaagttttagatgttctgagcacttgtttctgtgctttctctggatagatctggtagtttggtgagcagagttggcgtggctcatcagcagtcaccctttggcaatggaaccagaaaagcatcatgctgtctgttaaagaatgtgtctatgcttgtagctagtttcctaagatgtttgcctctaggtatttgcctgcagaaagttttttgaagtcaatacaaagtagagtggcaagcgatgcatccatgtttgaggatttgggaagcatttttctgtattctttcaagtaaggcctggtcgataagtttagccacactcaatctaattccttgtctgtatccttattatctcccctcctcttctttaagttttcacttccttctgaccttaatcactccctcaatgaacccataagtatcactgaacatgggtgtcaccagttagcaacagtaagataaccgctaacttctgaaacatggaagctctagcattgcttggatgatgtcttccctgactgcctgtgagcctctggccaggatccggggtaagtgcctcacaaatcactgttcatctaaacagctaaagctcttctcctgatggaagagggatacctacagcagaaagcaagggagtccaccaggcacgtttggaaaataaaagattttatttatatttattttgactctatagtttctaaattccataaatgaaattttgccattatcaaggaaatatttgctagggagtataaggaaggccctttgggtaagagagaagatattctctaagctgtagcatgtttatgaaccttaaaaattacttgtctgtgtttgtatatgttcagctctgagagtcttccttaacattcaaatgtctctgtcttggcaaaaattagtgaggttttagaaagtagaaaagctggttgatagtgtaaggaatttttaggccaattttctattttttccttctatagactgaattttatttttataccaatagtttcaatcttctaaacttctcccattcctctttactttctcaactgcatccacttaaatacatcttattgtttcagtcagccttggctgctataacagaatggcatagattgggtgacttaaaaacaacaaatatttattgctccccattctggagactaggaagtccaaggtcaaggtgccagtcaatttggtttctgctgagggtccatttcccgactgacagatggccaccttcttgctgtatctttacatggaggagagagaaatcatgcctaatgtcttttctatctccgggcaggtagtgcaggaattgaacttggttggaggacatccagctggtgtctgctgcagattgcttgcttgcttgcttgcttgcttgatgtgtggggaaaaacctccacacatctagcgtcagaagcgtgttgtgagagtataggagaaactgagtttgttttttctacacagaagaatttcctatcctgaaggccaggtaatgaatcctctttctctggttacttgggcaatttatcaatgactgtctgtggatatttatttggaaatattatatgggaacgttccttcattttttatatctcaatttaggaaaccatgtgcttctttctcatttctcttttgtccccatcagcgatctatatttttttaaattgttattagaaacatctcttatttaatctccatcatcacccaacaagctcagcaatgtgactttgtcttacggatgaggaaactgggtgcagagtatttgtggctttccccaaaacctgcagtaagtgaacaactagaattatatccaagccttctgattcaaatgcagttgccctatgcaccacaccaaagtatcgtttacactcttgagggctaaagaatgccagatgtatttatctaacttctgatgtgcctcccaaaatgccctatacagaggataggatcaatacacacttgatttcaaaatttctatgacttgattctacttacacatcttattgatttggagaaataaaggtacttcttgggggaaaacatgactacatgttaaaattctgaatttggcaagtctagtgcaaactgaaatggatggtggttgaagtacagccaactcatggtggtccaaaagactgtggtgaggggatggcctcccaagaggcagggattgagccctacactgaccagaaatcactgcattacagaataatggagaaggcaagacaatgaaactgagtttctctgaaagcttggcatcttggatatttcaaagattaaagttgtatttaatgggaatcacgtggttcaattaactggtaataggatggatcagtgtccacctctaggacttcaatttgagtctaatccaaacacagaagcagagtaggttgaagcccttggtaatgaacactaagcctttcacctcccggtccacagagaaagttcctctcaggccacagaggcctgctggcaattttcctgaagacagtttggtagactatgtgaaacaagtgaacagctatggtcacctgagaggtagtggtactctacattttcaaaagttctctcccaaagcaaaaccatagcaaaaattgaaaagcagtaaatgaaccatggatggagatattgcactatgcacttgtcttgctagcagaagaatgcaaaggtgctttcaccattgtgtcagatgcttggctgaacatttattaaacttttgatatggaggaagacatagaacataaagatgcattttcttccctcacaatgctcatggtgtgacaggaaaaaaaaagaattgttccattaaaaaaacattgaaatgaatcaacacaaactgatgttattattgaatagataatggagagattgtgggataattagagaataaatctggttatcaaagatgtctctggaaggcacgtgtgtaaagttgttttcagctctgtacacctgtgcacactggccaggaaagctggaccttctgcagagaaaactgtcttctccagataggaaagtgtgcctcattgagctttgggctaggccagagctagaagatctttcctgtgtttgggtcattcctagatcagtgatccctaatgaccagttccattccctaaagctaatgttgactctagatctttctgacatttgattcatgctggaatccatagtttgttttgagtcaggtctataatagattcatattcctgagaggcttcctattgaaagtgaagactcaggattccactgactgttctgccactgtttaaggacgatattacagttggattatagatgacctccagtggacacagaggtgcttagattctactgagccaccattactttgcctaaaagaaaataagagggtcaaagggactaacttttgtgtaagttttaaggttttattcaaacacaaacacacacaatcacacacacatttacatggcaacatatctacaaataactatttctctagcattatgttcctcagcctcttgaatgacatcatttaccttcgtcatgttaatgaacaaaattgtagctcactcataaagaagagagagaagaatgtttgtgccctttaaatgtcaaaaaataaatgcttcttcatattgtgtatgagttcactataaactcatggataatttgtgtatctgaagctctgaccggcttccagagggcttacagtgcctgccatatcttaggggaacaatgacctcatgctgttccagggacatttctatttctccatttggctgaaacttactcactttatactttggtagggatactgaattcaagtaaattaaaattaggagatgtgttctctaattattctatcgaaagagcacatagctttgaaataattctcaatgctagtatggtggactcttttcaaaaggtatgagtcagctccctgtgacatgttttccagtgtctgcttggggtcacctttactaatttcatcaggactgagggaaagcactttccttttcatatttctgcttgggtgtccagatcattctcccctacagaggctttgatgctgtcatggaggtcatagggccggccttttttcgaagtactggagctttttaaatttcactttttaaaaaatttttgttgcttttattatggtggttgggggtaagtaaggacccaccttttgaattagaattactgatcttatccaagagagaatgttgtagtgggtgatagttgacgaagaagagaaccataaaatatcacctggatgaaagacctaactgcagcactatctccaggacacacacacacacaccagagtccccacgtgcagacaggcactgctgatatattacagtctgttggccattttgtttatgataactaggaaaggaaaaatgagcccttatttcagtgtgttcatcccaagatgatgacacagtagattccccttgcaggtaaaccgagagagctcagttaatcaccatttatcactcaagtgactcaagtattttgcagatgcattggagccctggagactgagatattcattgggctgcaatgctattctcttttctcattccatctaatataataaaataaactcaaatcctaacatcagagtgatgtgtgctatcttttagagtcccaagcctttaaaatgtatttgattcactcccatagaactagatacattttccaaacgaaatgtgatatcattacaattttaatgacttataactttgctccatctcctccattaccagactattcctagctactaccatcttttgccagaagcctctaatttatttctctgcatctgcagctgacctccttcaaacagtgttattttgagttgattttagtatataaaccactctcagtgggatctaagatagattagtttatgcctaattgagtgagcttttgtagatcctcttattttatataacttattagaaaatatctaagatatattgttctatttgccaaataataattgtgaatcaggttcattgtacactggttaccaatatgcctgagcctagtgagagagaacacccccacacacaagtcacatataggcagtaaaggacagcagaagctggggaatcattttgagctcattctccaaggctcaggaaagctgcctatggcaaatggaatccacctgtgcacgtactgcacctaagggaccttggaaagtaccccactctgggttttataccccaggggcaatatgactcaataagctgaagtgttgaaggacatcctgttctggtaggaagtggaacagagacttggctattccagccagttcctccttatctgagaatgttacatttctggtatattctttagttatttttgagaactacaagtgagaaaagaacacaaaccaggttggtccgaggctacctagagaactttcttccaataggtgaatgagcaggtatgttacaggttcctcatttgatcctctcaccctatttgagttattctgaccacttgtacatcaactattgattaaaatctgaaaaaagaaaatcataggtgaccttaaattaaacttaaattaaacttaaaaaaaaaaacttaaaaaaaattaaacttaaaaaaagttccacaacgaacaggggtcagcaactttttctgtaaagggccagaaagtaaatattttaggcttgtaggccacatgatctctgttgcagctactcatgtctgctgttgtagcatggaagcagccaaagataataatacatcaatgaatgagtccagccgtgtcccaataaaactttatttataaaaacagggaacaattatatttggcacacagtttgctgatctctgctctaggccaatctatctcctccaacttttgcatattcatacctcaaacatatcataaaaaactgccacaatctaaaccgtattatctgatgaccctaagtactaaatctctccattctgaaatgtgtatattaattttttttcaggtagagaatggtatagaatttagacagggaatttatctgagggattgactgaaaatgccttacttatgaaaaaagagttcttggttggtgtttattattcatgtaggtccatttaccttgaagccataatgctaatatagcctgtcatttggaagttagataaatagtaaagcactttaaagaatcactaaaagtttcctcacaaccacagaataggtcttggagggttactcacgctttgctgatctctcatttatagaggagcagctgctcatttttggcctagaatatccacctctaagagaagaaatttctcctttgcatcctgttcagagctgatcatgcatattcttggaaactgactaaaatgacctagtctgtagtaaagtaactaatttagagttgggactatcaactaatgttattttgccagaggagatgaatgaaaagacttccttagggactagcagcaatcagtcagtagggaacagggttaccaagaccagatggagaaaatggcataggacatgtgtattagacctgccactttctggctctgtgagcatgcatttcaaagtttatacctgcaaagtgggcatttgacagagtaggggacagtcggagagcttatcgatacatacttattgctctccttgtgttctgtttgctggaacacaattttagatcaaatatttaaaaattcacacgtgcgtgctcatggctgtgcactcatgtgcatgtgtgcctgttgtgtgcgtgcatatataccatacagaaaagtactgtctggagaatacattagactatgcatgtaaatgtgtgtagaatgtttttcttttttttcatgcaatacatgctctatggatatttgttaagtgactgaagttttgcactccctggtgcagtttctcaatagtggcactattgatattagagccagctatttctttgttgtgtatcattgtatatttagcagcatgcgtggcctcgacccactagattctagaagcactccacttcagttgtgacagccaaaaatgtctccagacattgccaaatgtccctggagataagcatccctgttgaaatcactgccttagtgaaccaagacattaatgtaagaaagtggttcctaaactttagcatctgaatcaatcaccttaagttcttgtgaaaatacatgttactgggcctcacactagagtttctgattcagagggtcttgcactagcactagacccaacaatttacatgtctaatgagtccgctggtgatactgctgctgggggtcttagaacctcactttgtaagcacataagtaaggtgtaagatgttctggaaaaattccagatgagttaaaatgtgtttcctcatttcaaggactgtaatgtttgttgttagtgtgagcacagggcttaaggtttctttatgaagaccgctgggtggttcctcacagctgtggttgagatttagcggggaaaccggacgtttatgggagacgttcagtctgtactggattttagtcagcactgccctgccagctgtcacctgagtcctgccaggagactgctccaggtcttggcacagggctggggcacctatggaaatgaacttgaagtttgccttgcagtcaaacttaactaccaaataaaccagcatgacattggggtctgtgaatgagaagtggatgttccgagtagatttgaaggacgtgatgactcaggatgccagttgtgactggtgacttagagccgtggtagctttgacttgcatcttatttacttgcatcggctgtcttgtccttccttgcttctcgccttttcaggtcatggttcctgatgtcctaagctgtcatccctactctctctctctcttttttttttttttttgcttggagtcagagatggagctgtctcgagctatttatcagtcttatctctctgcgccctctgttagcatttcagactgtggatctaatccactttaattgattgacctcgtgcaaccagacatcagtaaaacaccaggtgaagcacaactgcagccaggggagaggtggatgtaactttcctggttgggtgcaaagttcgctgaggcctataaagatttagaaaaggagaaatagttttcaagccatttaatatgaattttctagggacaatgtatacagatcccagagtcgatgaccttgactgggagacagtcgttgtaaatagagcagtatcctatagggagtgtgcaaatgcctctgactcacctgtcatccatattagtactatttctcagctagcatcactattatcaccatctccaaacccatcattaacatatttttacatcattgtttgtagataccttcagaatttgccaagattttatttatttctcttaataagtactatttaacacaagtattactgttgctcttgtcttcgttatcgtttttctagacaaagcttgagccatggatagttgagggacctgctcaagatcacatggaaaaaataatgtggagcctcaatcagtcccaattcttttgattctaaatctcaaattcttctagaacacaaagtagacattttcctctcccctgcttttcctgccacagccacacttcagcttctcaaggggaggggactgggtcattgtcatgaggtgatcatggactttgaaagatcttcaagctctacagccgtggtcttgtcagtttgggtgatttctgaaaggcatcttctctgatttagatttttcaacggagagacctggtctcttacctctcttgaaataccttaataatgaagtgcttactctgtgcttataaaccaacaactgtccagagtgtagaacaagaagaccataatgttgaaagagtagagactaatgatcttcactgaaagacacttaatagccacaaaaagagcgcaaattatgttctactgagttcaatgttttattctaaagaactgcagtaaaagcctctgttagtcaaagtcaaaattgatcaatcaggtaagctgtaactcatctttttgtattttacagatgcatttataaagcatagtgagatgttttgcctaagatttattgcacgaaatttgaatatggtagcaataatttattttatcctataatactgaaatcatatttggtctcttatggtacaaaaaagattcttctaatttttttaaaatcacaaccacacattctaattcatcatttattcatttccatatccattaatttaacaaacatttactgagctcatgttaggatacttacatttaaaatactcacaattaggctaagtggacagataagttaggcctacataaaatatgtaatatgtaacacatgtatttctgttatagaaataactcaattataacatgtaaaagctgtgattgtcgaaaatgcatggattttagagtcagacctggattctatttttccataagtctcttattgtgtgaattctcttgtaattaattgtaagaatttgaatatacttctattataaaaatatttactgagcacctattctgtccatttaggtagcctggtttatgttgcagtgacaaaagcctcaaacacttggtgctataaagcaaccaagctttgtttctcagccatctgcatgtccgtagcaagttggcttattgccatcctcactcaatgacccggaatgacaaagaagccgctaccaggagtttgctgggtgcagtggttgacaacaaatgagagaactctcgtgggtctcacaccagcaactaaatgcatggctcaggaatgatactcaatttatcagttaacactgttctcttggcccaacccatcacaacgagacccaaaagtcctctcttactacaaccctataatggaggagaactaggaaagtgtggtaaacagtgccgctcattattttctttactaggaaccagactttgaaatgggtatggaagaccttgctgtgcctggcccacaagaggcattatttacatattgccttccttgtgttcttgcctagcactgaactaacaaattctgtgggaagcctagcagttaagacactgagacctgcttccattgcccatatccctggcatacatttgaaaatcccagttctgtttctctcagctgcaattttctaaaatagcggatgatgcattccgtcttccccaggggcagtctggaatgaacgaagagatagccttcagtgacatctttattcctgagaattcttcttgcccctgagcatttctgctcctggagtctgaccctggtgtcggtagcatctcttaggtcagcaccaataactgcagtgtgactgattgaggatagggcagctgaagctggactaatttggggagccaggtgggcttataaacagtcattattgatgaagagtgacttactggctatttaaagacagctggtttctgtgctgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 2413 - DNA, 585108 bp, Homo sapiens
tgatttgctctcgggagtgcgctatttgcatatgacttgcccatttgtgaatttggctccccaactcctcgcttcacttcacctgtgcctccctggtccgcgcacttcgcaggcgcccgcccgcctctcggccacctctgcagcctgccaggcacctcctcttgcgctctcgctgatttcgcccacccacctccctccaccccgtgccacgttggtttgggtggctgctccgcaccgggttcctcctcctctcctctttccctccagtccttcttattctcttcctctggctgcggtggctgctgctgctgctggttttcatccagttgggaaacccaggaagccggcggctgctccgtggcgctagtccagcacgcccagggttaaaagcctcgcgcccttccgcggagactcccaggaacacccgaagaactcttccacctgcagcccccttttgcctggcagttctgcattgcatctcatggaagtggaaacaggaaaataaaaatgttcaaactccttggatgttgggataaactcacctgaacccacttgggttcgggctgcctccttctcttccttcattgccacctttcctctgtgtggctcccgggagtgtgcggttaagtcatcagactcgaagtgcctagagatccggaggaagccgcgccggtcttcccctgacatgcgtggcatgccggggctccgtaggaggtttgctatacctgggaggaccctggcattctaaatttcagctccgggaaagagaaggggctttttgccttttatcttttttttttctttctttaagtagtaattttttaactgattcattgtttggaaagcgcatattgcttccctcttccccgaattctggcaactcttcctcctgctatgatgggcccttgggcatcatgaacttcattactcctcactggctggaattcaaactgcccatctgtagtggtcccgtgcgttgaccatgcacctgagaatccacgcgagacggagccctcctcgccggccggcctggacgcttgggatctggttcctgttctggggatgtatcgtcagctctgtatggagttcttctaatgtagcttcctcctcctccacctcttcctcgccggggtctcactctcagcacgagcaccatttccatggcagcaagcatcactcagtgcctatttctatctatcgttcccctgtttcccttcgaggaggacacggtaggtctctctgctctttatccttttaatggggcatagcaattcgctaacccactagccttgcaggtagtgtcaaaggtgggaagggaatttaaaaaaaatgaatttaaaatgatgaaaagcatcgtatgtccatgagggaagcaaatttctactttctcataaaggttagtgttttctgcccctagcctccgacaaccatctccacttttctctaaagggttcttttccccttagctccctcattcatagctgcacagacaccacactctctcttttgcaaccttctactctctccacccccacggagacaggcaacttatcaggtgagtcccagtgctgtacttggagaaatattcattcaccttgctttcacccttctttgctgtggtcttgcttgggagctagtgggggtggggtgggaatagctgacaacaggaatcaggttttcagcctgaagttgattgaactgttataaagtagcctgtgtggtaatggtcagggaaaagtagccgaacataagaaggcagaaaatataattaacaacctgtggccatttgtgttgaatttggcagctttatgtttgtccacatatctagtggaaaaagcagctatctctaaaactacacatctactattgctatcagaaaggaagcaatatgtaagataaggctaagttcatttataatttacccaagtgtaaatgacagtaacttggattccccgtgtatgcaaatgttatttcatctttaggtagcagagatgggcttgttcacacaatacaggtacgatgggttttactccaaacaaccctccttacatggctattgagggaagagatctatggctctgaaaatgatactcagctgttagccggctgcctctaaaagggcgatgtctgcagctaaggtaggagcttgctgtggtaaactgttctaaagaaaggagcttcttaatttgtttactatgcactccactctgatggtaaggagagtaggacacacagaaatggagactggtcttgcttgggagctagtgggggtggggtgggaatagctgacaacaggaatcaggttttcagcctgaagttgattgaactgttataaagtagcctgtgtggtaatggtcagggaaaagtagccaaatataagaaggcagaaaatataattaacaacccgtggccatttgtgttggttttggcagctttatgtttgcaggaacagccctccagggaacatgagcgtgaaccatactagggggttcctgcccttgtattttgaagactgataacatccagaccctatttggaaagttgattcttcctgctgcctcctagccctgagctttggctttatgctgtctgtagtgtaagtggaagcacattgagaaaatgccagcacatactctggctctttttgactctgtctttaaattttatttgatggagttgtcaagcagctcacagcttgtaaggttggtggagggggatggtgaaaagaagggattgcttgatcttgatctggtggctcttttctctgtgactcctgctgggtctggtgttggctcccttaaaaaagaaagaagcaaacaaacctaggagaaaaaagagccacaaccaccaaaaaagcaatttcattgacatggaaacttagctcctaagggggagagggactggggggagcgggtaagacaggaaaaaaagagggagtgggagataggggaagccagagagactgttactaatagccataattaaacacggaaatgctcagagattagctaaattttgctaattactgtaaatgatcagcagggagaggaagattatgcattacaggttatgggtggcagggtcttgatatcttttgttcgggttgtaaacagttacagcagatactagtaagtgatggaatttgcagagcagtacttccctagggtccctaagtcagagtcagtctctctctctctctctctctcataaaggggttgagccttgcacaggttaaacatgaccctttatttagtttatttcttcaacgattggttgctcagtctcctttaaatctttttgactggtccccagtctagtttctcattaacctacatctgataaggttcagtgtgatggaaaataagaagaaagtaagtaaatggctagagaccccagaaaaggccctcagactcaccagagctgtagagtacagtgaactccatccagggtctggcatggctgagataagaaaactcatgaattcagctcttcagaatcctctttcaatcctgaagtcccaactcattgatttggggcttggagagtgaatgcatctgtattaagtagactccttgcatatttaattggtgtttttgagcataaaatcaagagaagcagcaatcaacaaaatatccctacctctggcttccatcctgcacccaagctgtgaccctttgcgtctctaactaaaaggaccagaagaccccacagagctttgctaatgcacttctcattcttacttggtgtacacttgctttttcctagtccaagacaaagacctagctaacagcaattgttttaaaaaatatttttggatggaggtggtaggaggcatggcaccaagagactgatggttgttattgatgatttactgccaatcttattccagagttaaaggcagcactctctgttgtctgtgaaaaagtaaatgcccttgattttggtatgaaagaaaactagagccttgagtccaagaatcttctttggacttaagagattgttgtttttttaactacacttgctcttcccttgcccatttcctgagaagccaaagtcctcaaagctgctgttcatcagttggtgctcccaccccctttctctactatccagacctatagagagattcatgctaagacagatggaagaaacagaaatcctccaaatagctgatattttacctacacttttgcctgtgcttggttccaagctttagaaaattggttatattatagatttgcttaaagcctttatcccaggacagcctagaggatgctgggattctttgtaaattagggagactaaggccacacttacctggggtgcccccaaaaaatctcacattaggattgtgtttcaggataggattaaccttcttcttaatgggaatctagtaggctcttccccattctgttagagtcctcaccccactttcatgctctcttctgttcaccagtcagtcaatactctttgagcacatactctgtgccaggctgtgggctactgctgaagatacagaaccgaataagacattgtggtgttcagctaggaataattgcaaaagtatatatatatatgcttccatattttaaaaagtgcaaggagtgggtggagatccaaataccaagcgaaattaatacaaaatcaaaatatcctttataaaatgaaggtttacattatcctgttatttaaaatatccctccaggttccttttcatccttggctttatttccatatgtaaatatcattttttatcaaagtgcaaggtagtttagtgattacagatatataaatagtaaaatatatttgtttaccaagctttaattacataagcaacttttgtatattttttccttctttttttccctctctctcttaaaggtcattggacctttaagaaatccaatgtgtctgggcatggtggctcacacctgtaatcctagcactttgggaggccgaggtggggggatcacctgaggtcaagagtttgagacctgcctggccaacatggggaaaccccgtctctactaaaaatacatatatatatatatatatatatatatatatatatatatatatgtatctccaatgtacatctgcctaaaaaatgcttcagtatttatagtttaaatgcaggtttctctaaggattcaaggttttatatgtaccttaaatgctattctctataaaacagcagactttcctgcctctgtagacgatttgtggggactagttgaggacatggaactcttggaaagctcagttttaaaagggaacacaccacgctatatttgcaggaagaactcttgctcagaaaccagggtgtgtgaaaagggggagtataaaagtcctattcaaaccatcttagcagaagtggtggtgatgggcccccttgtgacacatgatcctggagtctttcttggactcattccttgtcccagggatccacccccaaagttttttcagccttgggggcttgttttgctttgatctattgagtgccttcttctgctcagccagctgctttctaaccactttctttatgcctgccttcttgagattcagggagttgaataattcatagtgttggttgacagatcaaatgataagatttatatatctttggccttggtgatgaattaattagattggtttctccatctttggctcctctagatgcgttgtttttcttctttaaaattcactggtgagtggtgggtctggagattaacttgttcttgagagaccaccataggatgattataatatcctagtgtcaatttcttcaggactttcaacatggatcactgggtggtgtggagtaggggcagctatatcatagagaggagagataagatcatcagaacaaaaaacaagacgcacacacacacacaaaaacttgccgatactggctgcgggatgaaattttacagtaagaacttgattgctttcacctcagattttgaatctaaaagagaaatgtatttcattttacattttagtaaatgaacttatcagcccaaagaagtttgctttactagaactctgggtgaccagggagggaagcaaatctctgaagataaatcttgaacttactcatactttcctccttgtattagtttgctagggctgccataaagtagtaaagtactatagactgggtggtttaaacaagagaaatttgtttgctcaaggctctgtagagtaaatgtctgagaccaaggtgtcagcaggtttagttctttctgacatctctctccttggcttgcagatggctgttttctcactgtgtcctcatagggtctcaccttgatctacatgcatgcatccctggtgtctttgtgtgtccaaattctcccttcttataagaacatccatcagattggattagggtcctccctaaaagcctcattttaacttaatcatctctttaaaggccctgtcctcacatacactcacattttgaggtaccaggaataaagctttgacatatgaattttgaagagacacagttcagcccctaatgctctttctcctcaccgtgcgctgccccccaccgccccccaccatcccccgcccagttattgggaaagaagtaaaactgtactgttcagtgaatacccattggactcaaactttcacagcagaaaaataaaacttcagtgacaatggttgcaatttacaaaattcataagatagtgccctaagaggtaatgttgtgtttacagatatggggaaaaaaacagctattggttcagtgaagacttgtgttttctttcttctcagtttatcttctgtgactgagtccagatctttatttgcacatagactaattctgtctgactgcagacacatgctctaatgtccacacattaaagctttctttacctagacctgctacccttctgacccagaccctccactcctgccactgactcctttatgaactacagttgtttgctctttgcctttcctgaaacacaaattaccaactactttcacatctcagcctttggtgaaaacaagagaaaaaataggttaactaagtataaatttctcgtttttcaattttcatatttctcaattgaaaaatatgttaaataggcatcagtttaattatttttctcttcaattttattttttgaaagttcatctgaaaatataaatatgaggtaaattgtctacttcatgacatggttatgaagcttggtgagatgattgagagaataatatatatatatatatatatatatagtgtatatataagttctggttgttctaaatcctaagcaaagcattccatctttggggaaagggtatacctttctttgtctgtttgtttctgtgctcaaaatgcgtgctgatgttgataatagataaataataatggcattctggtggacagtgtggtgttaggtgaggtgggaacaactatggttggaggaaatagccttcaacctcaacctttggttctaagaaactttgtctctaagaaactaagttactaagaaacattgtgaacttaagtcacaatgaataagtcacttggtttcactgagactcaatttcttcacctttaaagtgagcaataataatagttaaccatacttatatcacagaaattgtatgagagattaaacaagttgtattttgtacattctaaaccaatgtgtacaggttaaatattttatgagacatattttcatgataaggctgccctctttgaattccttgcacaaagaggagcttcaatgttgatcatttgctggttggtagatagtggttaaagaacatgcatctgctggttctcctcattttcctatctatacatacacttttttgcctcctagagattatttcatttacatagtactctgagtaaatgtagatgagaaacactttactgtattttcatgtttatggcactagaacacagcatgggacaaaagtcagcttgtgatttttggtaatggtctgcttaggtagaaagtcatgccaggcaaattttagcatggaccaacacattatagcaaatcatttagaagctcagggattcagtaaagtgaaaagagaggactccaagaaatactctgagatcattttggaaattcagaattggatcccatttgcagtaaacctgtgcagaattcaaacattcctacatggttctcagtgtccattgtaaactaagatttttaatctggtttgtgctgggaagaagcaggtgtttttagggacaactaccttcagatgtggaagtgaagtacttcttttaatgcaatttcttaggcttactagggctcaaagtttgtagagcagataggagcacaatattatgccagaactcttagaattgactttgtgaagcctgaatttgaaacagaattcttactgagagacatggtcctgatacatagattttgccccagttttctccctgaccagctctgtaactttgaattataacattatatttttaaattatattcatcttttaacttttagacattctgtgtgataccttgatttcctaacctatattcttggctttacctgtagttttctgcatggcatgtagtatgaaagctccttaataccatagctggggaaaactttccttttcatatcttcatcatttgtacaatgagagatttgagtgagatgatctctccaaatgttttccagcactggaactgcatgagtctctgatttgtatgtctttaaagacaccactgtgcatcttaaacctatctgagttccacaagtctgccagtattttataggtctattttcttgactatcataataacttatgccaaagccataagccaggttttctcttttcccctcagacagaagcagcataatgtaccagagtggcacactgtgatgttataaagcccacaatccaacttcagtgcagtcacgctgagatgggaagaatgcagctttcatttaaacacaccttaataatgctagaaaggagctctatgttatgtttaaaatattctgctgtgtttagccatatcagagcagggggcagactagcaactgggtttataaagaggaaatggtttatttctatttacagttaggattttgagagagacttgcttgagttatacaccaacacataatgtacacccactgtgtgacaggtactcttccaaatgctttacatatgtgacttcatttaatcctcactagcctttgaacctaataaagtgactattttacgattaaaaacattgagactcagagaggttaagtggcttgattaacatggtgttaaagccaggattcaaacctggttgtgaccagaaaactcttggtctttctgctgtaccacacagtctgtcaactcaggaaacagactacacaaacacatcaagctcttttgtcaggaatcaagtacacagattgatgaagcactttgattaatgcagctaacacacctttccaaagcatctacaagactttccaattcctaataagtatttgaatgttttccaatctgcctgaacccgtttcaacccaaggagatagtaaataaaaggagcagactgatgaaacactcacacttgatatgtctttttttttgaatgaatgaatcaatgaataaatgattgagtgaggttccacatgatcaaatctcttgcactaggaaaggagggatgctagtttataaaagaagcaaaggcacaggaagttatgcacccttcaaaagcacaccaatgggctcgtagaacttagagatataagagagctcaatgttccaggtaggcagggtgaggactcaactaagagcatccagttagtgtcaggactggtcaggagcacagacatcatgactctgagtccattgccttttctttcctctacttctcagtccttcaagacactttcttaaattacaaacttgttccccatctctctttcttcagagaaatctccccttatccagattatgtcctgcaggcacatattctgccagtgttggacttgccaggccttccattaaaattaattattggctgggcgcagtggctcatgcctgtaatcccaacacttgggaggccaaggtggctggatcccctgaggtcaggagtttgagaccagcctggccaacgtggtgaaaccccatctctactaaaaataaaaaaattagctgggcgtggtggcatacgcctgtaatctcagctactcaggaggctgaggcaagagaatcacttgaacctgggaggcagaggttgcagtgagccaagatcacgccattgcactccagcctgggtgatgagagagaaactctatctaaaaaaaaaaaattaatcatgagaatccttctaataggttcctggctttgtgtgccaaggtagggtttcttggtgtgttctgaaggcttcctttgtataggaaacctcagtgtgaaaaagtgctcagattcggggttctgtgaaagatgcttcctgtcctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaactatgaatttcaactatttccgaggcagtcgttcagaatttgaatataattacactctttgggtgaaaattgtggtttttgctacataaaaaactaatggaaatgatctgcctgttcctgtagtttacagattatatgcttcagaactgacgatatatatttaggctgcttttctgtgtggcacatttaaatgaaaatgaactcggggtgagccaccatggttgctaggcaatagagcgggttgatagagcacggtattaaactgaacccacattggtgttttacttaacatctatttgcttagcacctttgtcatctgtggtgtcatagaagggaaaggaggaggagacaggcagagtctggttatctgcagagactcaaacaagtaggagaaataatcatcccaaacaccaaagtgacatgagcattttcaaaaatttgaggttgcagcacagtcaactcatttaatgaagaacatgcaagacctgaagaaatgcataagcatagcagacatattcatggatgtggtagcaagaggaactaaagagattccccaggctgggttttgctctggtggttccagaaaaaaaaaaaaaaaaaaaatagccaccacgctggttgaaaattttaaaaatgcgtctatgggtcatttaatttcctggcctaaaatcccagatttatcatgagcaagcggtgataggcagcaaaagcattgcggcttctttacaattgataactaatagaggaactccaattgctttgaaaccctggttttaataaaagctgaaagtctcttataagaaaacaactggatcacaataaagcaaaacctcgtcagactctttgggtccattctagccactttctgatacatttaaaagtttgaaaagatgattaaagggttaaaactcagctgtggggagaatttggtctcatgaataatttgggcagagagaggatcctgtgatttggatagccaaagttttattgtttattttttccaggagccaattattatatatcttttttcattgaatcaatatctctgcataatggaatggtcacctttgaatgttctcttttcttaaaacaaacttcttagataagttaaacacaagatgataggaaacctctattttcataagaatgacaataacatctactttggtttttattatagcaattgatcactttttattatgcctaacatttttgcctttcaatatgcctgacatttctataaacgttatagttcatttaattctcccatgaagtaggtggagttgttttcccattttttaagttttagttatttattttagcagagatggggtcttgcggtattgtccagaccagtctcaaactcttgggctcaagtgatcctcccaacttggtctctcaaagtgctgggattactggcatagccaccatgcccagcccattttcccactttaaagaggcagactcggaggcatggaaagtttgagtcagttgcctaaggtcttataggtaatataaggcacaatcaggttgggtatttaagcagtttgaacctgtcctgttcaaactgcttaaatacccaacctgattgtgccttatattacctataagtatatactgaaattatactgaaaacagtatactgaaaacagtacaatatttcataaatactcttaaaatttcagtatttatgaaatattacctgaatggtgggaaaaaatttcaaagtggtattcttaaatggaatactgggccatttttaaaaggacctcttagggtctacctagatacaggataaattatgaagacagaatattttctaaacaggtaaacacctacctcatatgaggtattctaacaaatactttagcttactgcatttaatctttactgaccatccttcaaggtaggcactattgttatcatgaatttacgggaacagaaactgagccccagagggttaagcaactcactctagttcttccacttactaagcagttagcctatagcatctgttgaactcttaggtcaggtaatctgtgcaaatgtagaacagttcccggatactgaaagcaactaatcagaatgcttccctagattcacaaattctattacattataggagaggcttttcaaaacagcctttggaaactcacaccagttccagaatctgctggcaatgaatagttacatctttacatcttcaatcaaggacccaagagtgagggaccccctctcctttgacagggaagcccattggtgcctcattctcctcatgtttaattcactctaagaatccgtttttttcaggaagtttcttttccagtaattacgataggctttctccccaacttatgattttaggcaagcaaccaaactttcctgattttaattctctcacctgaaagacagggaactgtgaggtggcctgccagctttgctttcaaaagtgtggcattcatctttcattaatgccaaaaggcaaaattccaatgatttctaaaatacttcctcacccttatcagatcttattagatcaccttgaatctacttttaatcttggcccttcatacatatggtagtagttctttaaatatgagggtgaaactaatgaatacgttaagaggggcagtgggtttccaacttgagtgaatatgtgtgtgtttgctttcacatgtaggtaaatgtgtgaaccaaaataaacgatgtaacagaaaaccttcatagcagcccaattagttcctagcttagaatgtaaagatcagacatgagaactaagtctgccgtgcattacagacgtagggaggtttcagtacctgcttcttactgctctggtatcatttatcagtgcagtgttgtcacaggctcatgtcaacatgtcaataataatctcaggagaggatagcttttatgtgaaataggaaggtaaacctagagtcttggccttatacagacaacccccttctttgggatgactagtgttttcatgtttcttgttttttccatgccagggagccattttatgtgtgtgtattggtaacctcatcaactgttagctattaaagactggttaaactaattattattaagaactctctttcagaaaatcctgagatagttccttttacttcccttcacaaagtaacttgatattggtccctgagaaatagatccacaacctcatcaccaagttctccaggccctgaggaatgatcatgcccctaaaataatgttctgatgaaggactttctttggactcaaaatctgctttgcatttgtggaatcatcaaatgcgaaacctgcaagaggtctttagaagcccttttcaatcaagttatttttcatgtgaaaaagctaatagaccagaagtttgtgaatagttttcccaaatcacacttttcaaattagaggcaaggcgagggcaacgtgcaagctttcagcttcgctgtttagtctctttctagtctctttctactgcatcacaatgttagcactcaggctttccaggtgtcatctgttttgctgtggactgggaaactgggattgtctccagcaccacttggataacaaatgagcacagaaggagcagagagcagcatgacaaccaagatactccaaacactcgcactgtttcctgtaattaccatccagagagcagctcccactccgtgtcaggcatgtcaccccctcacggggtctcctgctttctctctgccccagcagcctagaggggaaattcagcatgctgcatttcaatcaaactgtttgatgagagcttttgagcctaattacatggaaggttttatccagtgaaaagaaagaggaaagagaaagagagaaattaaattgaagtataaatcagtcaagagcttagatcccgcgcttgctttctttttaatcaagagtgaaatgagaggagagttttaaggatcatcacaagacaccattaactacccaaggagctcttggctgaagatggtttgtcataaaaagaaaagtgtacaatctgtccataaagaggaagtatctgagggtcgtgctgcagtttaggagcatgacactaaaaggaaggacgcttggtttttccgtgattattttatctttatttcccctagatacctagcatattttctcgcacacattaggtgttcttgttctgtattttaaatcaatgacttggtaaataacgtagtgtgttaactcaggtaattattacataggaaagggtatgttatcaactcattcaatattagatacaacacatgaaatcagtattcaaagttttggccagtttccctttgtggttgatgtagtttgggcatatccctctaatattactgttatttatagaatgctttacagtgttacagagaaaattcacggtaattatttgatccacagcacagccttgtgtggtaggaggacaggtagtatgattgttatttattccatttttttaagctgatgtaatcaaaaccaaagaagcataaatgacttgatcagagtcatccaagtattaagtgacagagcaataactgctacccagcttctattacatcaccctgtatgacctagaatcttgtacagaatttctgggttcttcagtataagaaggataggtaaacagcagagaggagtgtttgcaaaagaaatgcattggaattcatactttattattgagtacttatgatgagcaatgcaaggcactggtccatgctctgaactggaatgtgaaacatgagctttgtccccaaaggcttacagtgtggttacaattcattaaaatgatacttagatctatcctttccatctctattgcattttcaaccatatcacctaaacagttgtgacaacctcccttaacagaccttccttagcttctgtttttccctcctgtccatgtttccctcaccattggagccatccatctgaaacaccagtctgatcatgccgctcttccatgggctcttcgtgtcatttcctctgtactcagaacaaaggctggccccttatctttatgatctggcccctgtgtatccccaacttcacctcctaacatatttgactaccttggccttcatctttttctttttccttttttccccccttgaatatatcaatcttgctactaccatagtgcctttatttgatcagttccttttctctgggatgttttcatccagattgccgtatggccactccttcttcttatacgtcaggcttcaacttcaatgttatcccctcaagagcccttccttaatgacccagtctaaaaagcactcttttttagaaggatcaagattatatgaaaaaatttaaaaaaataaaaaataaaaagcactctttcaaatgtctctccagcataccaccttgttttgttttcactgtagcttgaatatctctgttacagttccttatgtgtgtattgcttccattaacccactagaatgaaagttctgagagcagagaccttgctgatcttgttcatggctggactcccagtacctaaggcagtgactggcaaagactgagttttcataaatcttgctgagtaaagggatggatgaataaatggcatagatgcttcacaaatatgggctcccacctagcattttaacctcaatactcagtaggccctttaaaaacatcagttttagtttgtacttttcccttgattgagaatctctcctatttggtagactgctactaatttttcacgttgcagctgactccataatatctggtctgcaaagttttccctatctcccactgcacagtgagtttcccagccttctgtgtttacttttttcgctatagaagttttctcattgaataacaaaaattattaaacatatattcagtcttctactgttttccaggcactgtccagggtgtcagactcttaaacatacatcagatttgggccttgcctacaagaggttcacgccttggtggaagagctcactctcattttattaaacatgtaacattgcattgctgttatttattgatggtgattgttttcctcattaggctctgcctttcttaagggtaaggaatgagtcattcatttctatattttgattggctgacatagttcttcttttacaaaaggtgcttaatggcactcattaatgaaaaaatagagtgagtgggctgaaaaggtaagaacatacagtattttaatgcacgttgtagtgtgacaaacatcatgagataagtagaaactaccgtggggatttagaggggaagatgtcacaaccaattaggtcattaaaaagtgcttcatagcagaaataaactttatatcatgttttgaagaattatttccacaggcatgcaggagatgggctgaaatatacttgggaaaaaaaaaaaaaccagatgttccagaatcagtgactccatttgctgagttatgggcttgtagagctcagttgtgagaagggctggtgaaggagtttggggctctttgatggaggacgttgagtaataactataattataatggacatctttggcatttacagtttgcagatcagtaatgtaaatactatatgacttgtccctttcaattgccctgtaattcttttatcatgatcactatttacaagagaaaaaaagggtcaaggctgagaagttgatgcttaaatcttataggatggtgctgtatcttttcaaaatgtaaaactggttttgtaaatccctggcttaaaaagataaaacaaaagcaaataaataaataaattaagcctctttcttcactgtttccagtgccctctaaatcaagataaaaatgtttaatgtggcctagcagttcctgcgtgatctggcatcactagcatagcacgtttagcctcatcactcaaaggtccttctgccttcttgattccagcgccctggccttctcccaaccattcatattcaccactacagacttgcctttgcttatcctatttaagcagaatcctcacttcttcctttgatggtcacctactcagaactaagaactcttctttagtgtagcacctcctcaaggaaatccccctgccatttctttgagaaattcaaattcccaggccataggttctcataaccttctagaactctctcctgttgctcatttcacaattcctttttatacatttggttgtgagattatttgattaatatccatttcctaagtagattccactggggttagacagggttgttagaaaataaaaatgcaagacagccaattaaatttgtattcagataaataactgactttttaaaagtacaggtatgtcccatgcaatatttggaatatacttataatttaaaaattttgttgtttatttgaaattcaaagttaactgggcatcctatattttatctggcaacctatattttatctcatcagagactatatctgtttttttcttctagcataatcactggggttgtaacaaacaggtaatcatctaatgttggatggataaataaaatgagtttaaaaaatattctggcagcgcatgtaggctgaattggaatgacaagagactgaatttggaaggactcattagcaaactttgaaaatcatcaaagggaaagttaaggacagggtggtggcattgaggctagatagatggagatgtatagaaggaacatttccaagtggggctcagaatttgcacaggtgttattgggtagcaacccagcactgcgaggaagaggccaaagggccatttcaaattattagtgatcaggattaaaaccagtaacggagagaaaaataaatataatgcctctcatttatatagtgcttcacaacttttaaagtgctgttttatgttccccattatgccccttggtaggagagtattgtttctaaaaagacagccatttaattatcacttttctttataaattcaattacatttcccagtccatgtagttcatcagttcagagatgtttgtcttcatttctgtctattttttaacaggtttcttttatttaagttcctcatttctcagtcctgaatcctttatttctgaagcaccaggtaattttgtattacgcataacaaatctgaaatttatttgtatgagcagattgattttatatccatcagattttctaaaaatgggctataactggcttataatgacatgaccagccagaggctaatttctgtggtatttcttcctgatgccagaataggtagacaagtcagaagcacccacttcagataataaagatataattccagttattcaaatttgtgttgaaagcaaatcctttcactgcttatttttcaattagtgccaagtgtggctccatggcttctagctacagaaggccaggtgatcgagcattcttaaccagatacatgaatagggagaccacggttctgcagttgacatttcttcagctgctctttcagaggtcttaacattttttctcaccagatacttgcctgtgagctgctatttgaaagataaggtgtgctgagtaaatgattaagcaagtgagacaataagaagcaacgtaatctcatcagagactacatctgtttttttcttctagcgtaatcactggggttgtaacaagcaggtaatcatctaatgttggatgaataaataaaatgagtttaaaaaatattctagaacaggggagaattctagaaggttatgagaacctatgttctgggaatttgaatttctcaaagaaatggcagggggatttccttgaggaggtgctacactaaagaagagttcttagttctgagtaggtgaccatcagaggaagaagtgaggatgctgcttaaataggatgagcaaaggcaagtctgtagtagtgaatatgagtggctgggagaaggccagggggctggaatcaagaaggcagaaggacctttgagtgatgaggctaaacgtgctatgctagtgatgccagatcacacaggaactgctaggccacattaaacatttttatcttgatttagagggcactggaaacagtgaagaaagaggcttatttatttatttatttatttgcttttgttttatctttttaagccagggatttacaaaaccagttttacattttgaaaagatacagcaccatcctataagatttaagcatcaacttctcagccttgaccctttttttctcttgtaaatagtgatcatgataaaagaatcacagccatgtagaggacgaaatgtgagcttttaactccacatacctgagtgtcactgatcactctctcagtaggtcacccagaggttagcaaacttttcctgtaaaggaagagagtaaacatttccagctttgcaagcaatatagtctctgcctcaacaactactcaacactaccactgtaatgtcaatgcaactacagacaatatgcaaacaaatgagtgtgagtatatcacagtgaaactttatttacaaaaacaagaccacctagtctgcagacccctgcccccagatttcagcttcctgttatgaaaatggccattataaaacctatatggcacagttgttgtgattaaacatttttacatacccaaaaaacttagtaaagaatcaggcatattaatgagagttcagtaaatgctaacctgtatcatgattataagttttagggctgcaaggaatcttgggtgtgacagacaattttctcctttcaaaagatacctagatggaggattcaagaagtatagggacttaaccagggttacaggatctattttcccgcaatcctatttgtataccacttccagaaaccccaagaaatatgatggcatgaagccaagctatatattgcgggatatttgagcatccattcagcatgtatgcattgaatgtcagccatgtataagacattgtgcagtatattgcaagtgacacaaagatcaataaagttcctgcgttggaaaatctaacagtttaagtcaccctagtaactataatgaggtggaaagcgacaagtatcaaaggaatgagtgacccctacgtgccaagcactatgttgaagtgcttacatgtgttgtctcatatgatcccccagcaggtggatttttagcatttcatcctcaatgacattcaaatgttaagtaatctgctctaggtcaaaagttactaagtgatagaacaaagatttaaactcgtttctctaattgcacagtgtgctttctaccagacgctggggaaatcctcatacatgaagtatggtttagttagctattgctacaaaacaaacaacactaaaaagttgtgtttaaaatgggcatgttatttgcttgtgattctgtgggtcagcagtttagacttgactcagctgggtagcttggatgatctcacatgaggtccctcatatagctccagttatctggcagatagacgggggatgatgatggtctaatatggtctcacacacatatctgccagttggttctggttattaggctgaggagcctcacgtgatatctctgtgctttgtgacctctcatttggctaatgttgactgcttcacttggtggtctcagggctgcctcccagagaggtatataacaggagcagcaactcttgagagcttggaaatcatacaagaacactttcgctgtattctgttggtcaaagcaagtctcagaatcaggctagattcaatgggcagggaaataggtgacgtgtcttagtgggaggaacagcaacatcatactacaaaagggtgagcgtgcaaggatgggagggtttcttgctgtgtttgccaacaatttaccataaagtgataactgagttggaccttcacagaaaataaagatttgggaaataaagactttgccagagcagggattataaagaagagcattacttcagattagctgagaatgaggccacacgcctatattgcattattgaggaaatttcctcttgcctttgctccacaagcacattgcttctactagttgcagggacataattaccaatttcatatatataatacttctaacttttcagaggatttttatttctcctatataacgtttaatatgctatatagttttgttgcattgttttactctgctcattcctttcctctctgtaagttggtgtcgtcattgcaacaaagcccaggttcccagctcacttcccaaaagacaatcatgtggactatctgctgtgattgactgtggctgagtgtttgccctggcagcttttttgttgctgaagatgaaagtttgatggactttaagatggaaaggaaggaagaggagaaatttgatttcatcggcagctgtcttactcatcttcattaagatgggttgtggacacttcaaggccattctgaaccagtggtcataaaactaataggtgccactcaacctgcgctgctcgtattattgcctgagacctgtcatctcggtagttattgcaaaaggagaaggaatctactgtagggaacacaatggtccttgtgtgacagaagtgaaactgaaagaaatagatttttctattagctgcaaatcaaacccttgcacatcatcccttggaggtgacagtgcctgattctctaaggcagggttcaaacaaatcatttgggcttgcagaaaataatatgagattaatatccaagtgtgtgtgtgtatgtatttgtggggtgtgtgtgtgtgtgtgcgcgcgcgtgcatatatgacaactacgtggctcctcacttgaagttttggaattagctactaatatatgtgtatgtttaagggatgcatttgtggacttgaagttgaaatagggaaactgagatgtattctgaagagggaaggagaagagggaatccagtcctgattaggggaatattgaaataagtaggtgaataatattcagtctcccaggtttgtggctatgagctcttttcttccagaagtatttgctgaagggagggaagaaaacactccttttcttctgacaatcaaacttttcaaatgtcagcatgcatgggtgtttctctctattcttgaggctcctttttgtttcagtctaacacctcacatcctgtgggttgtaataataatggtagcagttaccatttattaagcccttgtcatatgccaggtgctttacatatattacagtgtttgtaatccatacaagaattattacaagatagatatcactatgcccaggtgtgttagtccatttgtgttgctataaaggaataccggaggctgggtaatttattagaaaaagaggtttattgggctcatggttttgcagactgtacaagcatggcatcagcatctgcttggcttctggtgaggccccaggaagcttttactcatggtggaaggtaaagaaagggcaggtacgtcacatggcaagagaggaagcaagagagataggggaggagttgtcaggctctttttaacaatcagatctcatggtaactacagagtgagagctcaatatttcaaggagggcatgatatggttcgactctgtgtccccacccaaatctcatcttgaattgcaatccccatgtgcagagggagggacctagtgggaggtgattggatcatgagggcagtttcccccatcctgttctcatgatggtgagttctcaggaggtttgattgtttaaaagtgtgacccttcccctctgtctcactctcctgctgccatgtaagatatgccttggttttccctcaccttctgccatgattgtaagtttcctgaggcttcccaagacatatggaactgtgagtcaattatacctcatttctttataaattacccagtctcaggtagttctttatagcagtgtggaaacagaccacacagaccaccaagccattcatgagggatctgccctcaggatccaaacacttccctccaagccccacctccaatgttggggatcacatttcaccatgaaatttggaggggacaaacatccaaaccgtatcaacagggaactatagctcagggaggttaagtaacttacccaacaacacacagcttatatgttgcaatgtaggaatccaaacccccaaagcttgtgccctcctactgcgctaccctgcctcttccaggcttggggctttagggaatgccctttacaagcagtataaagacgcatttaggaatttttcaatcagctcttgtctagatcttctttggaaagtcttcttagttactggcaggtcaaaataccagctacttgatctaatagtgttatcagcaagaaactaaaaatcatgaagcaatgcagactttttgaatcagataggacttactaggccatcttgtgattctaatctaacatcttatctggccactttttctgccttgtgcaggaagtgaggtctggataggtcaaagggcatgactagagcattggagttaatgggaatggggaatgccttctttgcttcttgacatttctcctccacaacactgcacatcccttgtgaaataatttactattttttagacatcatgtcaaagactgaagtgaaagccaccctcttgtgatcaactgaggtcagaagttggcaaatttttttgttgggggtggggggctaaagggccagataataaatatttttggcttttcacaccagaaagatctccattgccactagtcaattctgcatttataactgagaagcaaccacagacaataagtaaagaagtgggcagcactgtatccagtataatattatttacaaaaggcaaagagggctggatttggcttcccaatctctgccttaggcctttaaagatatagcttccctggggaaatctctacactttgagatttatactccagtactaataacatagtaagagaatagtaatggtggtggtaataatagcagtagtggcatcagcagcaacaacaatggcaccttttaacatttgcttaatacgttaaggtttacaaagtctttttacaattatcatctcacataaaccttttaaattcctactcaagaactacacaagcaagggaaacgtgctagctgagcagtgtggtacaatgaaaagagaatgggatatactgcatttagtcatagagattggtggtgtgggatgaaaatgcctagagagtaggtgtgtgtctcctggccccattaggggacagttcattcagcagcagggtgagtgtcggagttcccaaatacatggctgctaatcagttccctcactctgtaggcattttgcatttaaagctgtccagaaaagagaggcttggtctaagaggttgtggtgtaagaaaatctctacatttccacccattgccttttgggatccctgtatgttagtgagcaacagtaaaaagtgacctgtgttaaaaaggtaatggaagcatggtacaattttagagttcatttgagcaaacagagattcatgaattgggcagctccaaaccagaagtggtatggggattccaatgaagaagtatgagaactaagctattataaagagaatgcagacctaatacaaataaaatatttgattgattacagttataaagctgtctttgctgggaaattcctagttatgtaattataagtgtgattggttgagcttaagttctgtttgtcattattataggcatttacaagaaatagctcaagttaagttctgctgatgtttgcaattcaagcaagtctaaggccacttatgaggcctaactggctctgtctgctcaggaattcttgcaccattgaagcattcttcaaggtctccattttaatttagtttaacacctcttaacaccacgccttcaataacatttatttaacacaggtctttgcttcgtgctaaaggcaaacatgtatatgagactctgtccctaaagcatctgtaactctccaaagacatacccctaggaacatcctgaagattctgaatcttgcagcctgccagaagcacagcagtgctgttggcatctctagaccactgtctgtgattgacttctggctctgctacttgtcagctatgtaaccttgggcaagtttctttttctagtctctttgtcatgttcttcatctgtaaaatgggtattttttaaactacccatttatgtagtctgtgatgatttaagagctaatatggtatgtgtagtggttatttatgagctaatatgtgtatattagcttaatgcctagcattcgtaaatactcagataaatgccagtcattattattatcataattgctggtgaaattaacatacaaagtcctgtgcaaaccttaattttctcactatggacttcatacattttcagaatcctagctacttggttctcagaacattcttctaacacctagagattccacagccaatgtatctttgggaacttattgactaacacagagctaaatgaagtaagcagcatttgtaccctgacattttacagatggaaggaatcatagaggtcatctcagccagaaacacattttcaagatagggaactgaggttcatagaaagtaaatgactttgccaaagtaatacactcaggacagaatgagggctagaaccccggggattagtttttttcctctggcctcaaaactcttccttctgccatttttaacttaccaatttcacctaataccttccacatatttttgtgactgtttcaaagattccactagctaccatagaagaagtaatgaactaaccttataattccatcccagtggcttcacctcacctgccctcagtttcctcacctgtccagtgaggcaaacttacattggaagatccctaaggtggttcccagttcagataagatacaatcctaacaaataaagtggggtcggagtggaatgttcttgaaatcctggtatcaatgggactgggatattactctaaatctatggaaacttcaagaacaatatatttgttttaacctgaaaagacagttgcgttccagtgtgaaatagccaccaggctggatgaaaatgtgtgatgtgattccatcattgaaatgagcatgtgttgaccgtaagttcttctctttctctctggggacatttgcagtgctgcagagcttctctgtgagctgggatgctctgtcagcttaaatcctttccagagtgataaatatacattgattttatttgatttggcccataggtgggggataaaaaacaagacatcacagccacactatactgtatattcattccccctgaagacaacgcacacatccttgttgaagtctcctcatttagacaactcttcctttttatgcttcattataatgccactttcatgtcccttcccctcaacatcgtgcaccttgttccacatccagcactctgtgtttttaaattaagggaaatgccatttaaatatggtttttctctttgtaatatactcacctataaaaagtctttaaaggtaatgctaactgctttggcagaaattcaggcatatatatagttattttaatacaaggctatttgtttgcttgactgtttttaatgactactcattaacaccatgatcttatcctcatttcctctgcacagagcttgagaggtgctgttcacagcccctgctgcctgctttctgaggtctccaagatgctagctttctacttttccactcagccctgacacctagttcatcatttgagataagccccagttgtcggcaaattgcaatctcatcaggtctgcaagatagcatcttgtttgactcttttcaacaccttccattaacactttgggactaggtctttgggaagagccaggcctcaccacatgggcgattgtggttgatgaacagattctagttttccccattattgacttcattaaacttgacagcctttttagtctccagatagggtgaaccttttttcactgacccttattaagagctgtctccttaagaagggtcattcgagaagggatagtgggggccactccttctacttccaggaaatagctgattttggtaaacaactttgatttagtttttagagttctttcacctccctaattaggacagccacaatttatcaaatgttagcaatgcaccaaagcctaagaatgatcttatttcttcctccttattcatgggttttattactactatcctaatttcctcatatggaaatgagcctcaaaaacattaaataagttactctaggtcccatatcaataaattgacagagctggaattggaatcaacttaagtctgacttcagagcttaaggttttaaccatcatattctaccaccttcataatacctttagttactttattatattttaggtttaccccttgttattggtcttcaaaatccatgagttcattctgattttatgaggtgtattggtaatctattgtttcatgaaaacttaccccaaaacttagcagattaaagcaataaacacctattatctcattcaggctttgtgggtcaaaaattcaggagcagcctagctgggctcagggtctcttatgaaattgtagtcaagatattggcccaggctgcagtcagtcacctgaagccttgactgggctggaagatgtacttccaagtttcactcacatgcctggcaagttactactcattattggtagaaggctttcgttctccagcaatgtctgatcctaattttattttaccatagattagtgcagtcttcacatgaggtttcatttcacctctctttctctctctctctctttctctctttctttattttttttctctctctctctcttttcccctggcagtcttcttttggtcaagccatttgtattagtttgctaggtttgccatatgaaagtaccagtggcttaaacaacagaaatttattacagttgtggaaactaaaagtccgagatcaaggtgtcatggagcattgttttctctgaggcctctgtctttggtttataaatggtgatcttgtctctctgtcttcacatggactttcttctgtctctgtgtcctaatcacctcttcatataaggatactagtcatgattgaggctcatgcatctgagctcattttcacttactcacctctttaaaggccctgtcttctaatacagtcacattctgaggggtgttaggacttagggggttaggacttcaacatatgaatgttgaaatgaagtaatttggctcataataccatctttgtcctttgtatgtcttgagaatttccttttacactgtcttacctattacttatgtcatttctccattcttaacctctctttgcctcaagttcccaaagctattgtgcagccaactttaagagttaactgcctgcctttctgattgctcgttacacttgaaggacttaggatgctatacctgaaggtcttagagagttagactggtcctccaagcttatgaattttctagaaactttttaacttgcatatggtattctcctgaagaagctgtggctaaagtcagatatatttttataaactattctttgatcatgtatgagtgccaaaaaaaggagtctttaattactttgagggaggggtctgtgcatctttcttaacccttttcctggctgccctgtagatattccagaaagatttgatgtcttgtggaatggtctgagaaccagatggaagctagatgaagaacaaaatcaaaagtgtctctcttgtcttgcatgatagaaactaatatcactaagaacgcaattgagagcaaattattaagaatatgcactgaatgtgtacaacagccagtgtttgttcctcatcagcacagggaagcattcttttttttttttttttttgtgagtaattttattttattttattttatttttttttattttatttatttatttatttatttattttttaattttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtggctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccattgatgatgagcatttcttcatgtgttttttggctgcataaatgtcttcttttgagaagtgtctgttcatgtccttcacccactttttgatggggttgtttgattttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctaaggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagttgtagatatgtggcattatttctgagggctctgttctgttccattgatctatatctctgttttggtatcagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagctgaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgacagagggcatccctgtcttgtaccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgatattggtctcttcagaaattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaactatgtggtcaattttggaataggtgtggtgtggtgctgaaaaaaatgtatattctgttgatttggggtggtgagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgttggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttttcctggataatatcctgcagagtgttttccaacttggttccattctccacatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctggagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgcgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgaggacgggcagactgcctcctcaagtgggtccctgacccctgacccccaagcagcctaactgggaggcaccccccagcaggggtacactgacacctcacacggcagggtattccaacagacctgcagctgagggtcctgtctgttagaaggaaaactaacaaccagaaaggacatctacactgaaaacccatctgtacatcaccatcatcaaagaccaaaagtagcacagggaagcattctaagcttttgccaggacgcctgcttattatatgctatggtctgtccaaatcttctgtggctgccactacagcctgatttcccttggaaacttggcagcccgtgagttacgatggaattcccaggtgataatgtatctaatttccctcattgtacttcttttatcctgtaatgtgctgttgattcccacggctgagctgtgatggagaatagccattattattgtaatggcattattcagtccattaagacttaaaacatacctggtaaaaatagtgaaagcttacaagtcttcatagcaatctcaaagactaataacttagttgttagtcttttcctcaagtaaactttgacaggtgtttgggaataattctttcctgggctgatagtatttgatttgtactatatattgttctaagtaaatgcaggaccaatgctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcctttaatataaaaaagggatataagaaagcaagcctgagtatattcttggttgctctgtttcttgtgttagcctagccagaacgagctacaatagaaagaagttatactttagaaaacaatctatttaatataattcaatgctacacaaagctttatttcttaatatggacaattatttgctactggaaagaaagcagagcgagatatggccctttggggagatggttaaataagaaatacatttccagatgatgtcacatgtaaatagcactccgaaatcactaggcatcaaaattaatcaggctgaatccattgctttgtaaggtgtaaatcgctagccttacttaaccttacttcagtgctgggactcccgaatcgcgaggaaggtatgattcttatttcttcacacacacacagactgagtgttctcaagacaggaacatgattgagaatgctggaaaaaacattacattaatctacattgtaagagtaccatgcaaacatttgcttgtttccaacaccttgtaaatgtatctcgttgttgactcaaaatgaacatttggtgcagatactgagaaaaaagaatgtacttagaacagggatttcattacttctcttataggtctcagctgtggagattgtttagccaacaagaaacccaatctctgttaggtatcttgtctgagatgatattaaaaatattcaacaaccagtaggaaatggaaccaatgaaaatgactcaggtcccctgctgagactggcattgacctgttagttgttgaattgtggaaagaggggaaagggaccggatgatcggtggtaagggtatgtttgaagcagtgacattcatcatctatttatgcaagtattttaacattttaataattgatacagttatctgggtgcatgccagttgacaacttgccctgcatattgataattttaccatgcagactccactcctcaggtaactcttgttctattacactggactttatcatcatgtaatctgtcctgtccctctctctctctctctctctctctctctctctctattgaattctgggggtgtagtagtccattgtttagagggaatttagaagttttcctatattaggaagtgtattcatttcctaggaatgccataacaaagaattacaaactgagaggcttacaacaatacaaagttatcatatcatggctctggaggtgaaaagtctgaaataaaagtgttggtggggctggacacggtggctcacacctgtaatcccagcactttgggaggctgaggcaggcagatcacttgaggtcaggagttcgagaccagcctggctgacgtggtgaaaccctgtctttactaaaagtacaaaaaattagctgggcgtggtggtgggtgcctgtaatcccagctactgaggaggctgaggcaggataattgcttgaacccgggaggtggaggttgcagtgagctgagatcgtgccactgcactccagcctgggtgacaagagcgaggctacttctcaaaaaagaaaaaaaaagtgttggcggggccaagatctctctggaggctctcagggaggatccttccttgcctctttctaacctcttttgatttgctgacaatctttggcattctttggtttgcagctgcagcactttgatcacggccttgttgtcacatggcattctcacctttagtgcctgtgtgtcttcccctcttcacataaggatgcaagtcatattggatgacttatcctactatcctactatgtctatcctactccaatatgaccttatcttagctgattacatctgtagtgaccctatttccaaataaggtcacactccgaggtactggggggttaggatttcatcatatcttttgggagagacacaattcaactcaggacaggaaggaaaagccccggcaaccgaattgtattgttctgctagatgatgacaagtcataatgtagagaagttgctccaaagtgggatacatacattggagggcagcatagaatgaaagttttagaacatctatttatatttattttaatcgtattcctttatatttttgttatagtctgtttcatagcacatttagtgtataaatataataatacatgtctacgtgttaaaaatgaatgaaaatacctacattgggagtgggctgaatccacagaaagttttactgatggtggttcagggaatgtaagcaaaaggatttcaaaccaatgtaagagcatgaaatattaatgacatgtttcagataaaaatctctgtgtaggtttttcatagccccaattcaagttagactgggcaagaaatgagattatttaggcaaaaaaagggaggagcactaaattcatccacaattttaaaagtatcttctttcaggaggcttttggacagtaacatttccaaaaaaatatagtgttttatgccacagagaatcaagttgcattgtgtatactaaatggtcaagcattttcaagaacatgacaaaataaaaacatacaaatttatatctcaaaaggaaagtatcttctttcatgtcagatcatcagcacagaagccctcgatgcatgcaaaggcaagcacaggctctgcagatgagatgtgaagaagcaattagggaaggaaggaagggacagtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttcttgtgattattcaccagggaacattttataatactcatattaaatttttatttcttaatttcttgcctcattactcccatttgcattggctgcagactctctaagtattactttcccttccttgtggttcataccctaatcattgaatattgatgttctatttatttctatgcactcactttgtttttgaccaagttatatagttatttggttttcaggtaatgctttcttacagttactcaagaatgtatgctagaaaatgttgcccataactgcttaaacataaaagaggatatgttttcttgttttccatctatgttacagtctgtttctgaaatatcctttattatgagtagaataaaatctactggacttggaatccacattcccttttaaattaaaagtattcccagactttcaaattttacattccttagcatgatctcttctctataaagacagaagaggggacagaaaattctgactgatcatttcttgagctagaagcagctataatattcctgttctccatcctttataattactttctcataaatactaaactacacccccctgagcatctagaagatttaaacactgatcaaaggcaggtttagctgtatcctcaggacaagctgattcaatgaagaaaagctcaggctcttggagagcttttagaaagagaaataaattaacaattagcatttaacagcagtaaaaactgcttagcggaagcagacttgatgttttaggggatttgagatattcggagtgatgagatgaataggaaaaactgtgttccaattaggaagacagagtgaaaaggtgtgagatgtggtcttctagttcattccactggtgatatagagcctttcctggacagatttttatcttttttgagtaattattatccacgttataatttcatgcctgttgcttttaggtaagctcagaattatagtcatggcttgagtaaagatctcattgcagttgagtactagcagtaccactactcttgcatgagttgcattctctcttgaccagctctgttaatgggtgtccttatgtatgaaactgattttcttactaatggcaggattctgtctggttaggatattccctgaaatgcccaagggtgtattttgcttaaaagcaaggctggccagagaggtttggtttatgtatttatttttaaatttcttttgtacctaggataataaatatattcctctagtcttggataataatataaaattacagccatactgacaaaattaaagaagacattaacaaaaaattcagattaaaatataaagttcatgtctttggcaagtacacacaggattgtggttttgcccaaggtgtctaattaattactataatttttcaattccctgtgttcaataaaaacacgtctatgaaatgctattcataaaagcagaactcactggtcattaaacatgcaaatatccacgaataaatacacaattctctcttgcaggaaatgctatcagtagactaaataagtggtggacatttttctacagtaagtatttacttttcctacagtttgatcttaaaataccacagttggccagggcctcatgtgttgctggtgcaatctccgcattgttaatgggtatatgaagctcatgatgatgtccacaagatgataccgctattggaaaacttcctcattcttcctgtctaaccagtagcataatggatatgtgaatagtgcctgttttgtacattttccctcaggtaaactgtgataggcctttgggaataattcttttcaaggcctgaagcatttaaagtgcactgtatattgttctaaatgcaagaccaatgccccattctatcagagaaaagaaaaagggtatctgtgggaaactatttaaaagattaaaggagctttgactgaaatgtggtttggtggcaaagaaagggaaaccaccatcccttggtacagtattaaggctatatctgggaaaaccaacaaaacgtgtcatatgtggatagatcatgacactgacaccattagcaaggactttttttttttttttaacagcatttcttgtgctagtttcccagtgccaagaatggcttctttatttattcttgaactccaatacctatcacagtacttggtccttacttggtactcaataaatgtttgttgaatgaatctattttttatacttttgtatcaaactatcacatctgagcgattttgtaattttattcagctgatgatattctttataccagtgcaattttccatatgctcatgtgtgttttatttctcatgatatcagtttttctttctttgaactttgtagttccctgaattgcttagtattgtttatatatgactaaaggcccaggtggataagatggtatctttctttgtttattgtttatatatgactaaaggtccagtgaaaggtaaaaaatgagtttgttagatttcaaaatcagtcaaaaggtaaaatcagtgtgaagataagataccatcttatctaactggacctttagtccagtgaaaggtgaaaaatgagtttgttagatttcaaaatcagtcctaactaaaaaccatttcccctactggatgttgtaactcacatcattacaatttatggcttaatgaaacatttatttttctgaacaacttggatttcagtgagcagatttcttaaaataaggacattctatttttcattatagtactaagaatgctggaacaaatattttttctacttacatacttgagttcagttgaattattttatcaggtatttgcaagatgacctggaatatcttggaagttattatatgtaaattatacatacacatatatgtgtatagttcctggcattgggcaactagtataaggaatgctgcaaaaaaaatccttgctaatggtttcagcatcatgatatatatatacatatatatgcatatgtgtaattacacatatctatatgtataaataactatattaatatacttatataagctactacatattaataaatgatcaacatacctatattatttatatataaactatatataaatataactatatatatacacacacacacatatatatatgtagttgtagaaagggtcttttttagtgaattaagacttcatgaaaggccagttatagtggctcatcatgcctgtaatcccagcattctgggaggctagaggatcacttgagcctagtagttcaagatcagcctgggcaacacagcaagatcccatcttaaaataaaaaagatctcatggtaactaatatttgatatgtatgatatatgactttaagcaatattacgtgacatcacctttctcacattctaggttgctgtttacattttttgttcagtaatgaaacaaactcacgaggaagtaaaccaatcaacattttatgcatggagttttctaaatccttcatgtggctttggtagcattttgattagaagcccttgaattctgtcctgagtgcttacccattatctagtgatttacagagtttacaggaggacaccgaaatcacaggcttgaccgcatttacggatggcacagataccagatccaaaaagtttttaatgatctggaaccatgaagtgaaataaacaaggagcccagatttcttgaagacctcctctatgccaggcattttatgtctctcaattctttgagagaacctatggcatgaagttattaatttttttctagatggcaaaactgaaaataaagtatattcaattaatttctcaaggtcatgggattgaaaatactgtgactgaaaaaaatattttaagtcttcctgatcctagagtctatcttcttacattaaaataaacatattaaataaataagcacaatcagtttaggaaagatttgttttgatagaaatccatgcaaagcaggtcagggaatttcagttgaccacagattcaatggggaacatcagctaatgagagaaatgtacagtgcaaattatttcattgtacttagtgctagtcaggcttaataaagggtatgatactttggcacctcattgctttcacaaacaagaaggcattctgagtaagaaaacatgaagacaaagatcctaaacctttatcttgtggatgacagctaagaatgctcaggtaagaaatgactgtagtgacggcaggggatggatgagggctataacatctgttgcaatacatacactgaatggtgactttttcttttttaaattgacacggggtctagctctgttgccctgccagagggcagtggcgcaatcatagctcactgcagccttgaactcctgggctcaggtgaccctcctgcctcagcctcccaagtagcttggactgcaggtgcatgcaaccatgccccactaatttttttatatatttatttttagtagcaacaagctctcactatgttgcccaggatggtcttgaacttctgggctcaagtaatcctcttgtcttagtcttccaaagtgctggcattacaggcatgagccaccatgcctgccctaatggtgtttttaaaggaggaattagctgtggtcagtacagatttatttggaagaaatggaatctgtgcttagaagccaaaaggcccattattattcaataaaaggaagctctttagaacactttgaacctgaaagagttaatgaagcatgagacattagggttcccatatttagtttagatctatgtggcactatttttagaaggttacattgtttttaatattttatatagtaggccgggcgtggtggctcacgcctgtaatcccagcactttgggaggccgaggcaggcagatcacaaggccaagagatcgagaccatcctggccaatgtggtgaaaccccatctctactaaaaaatacaaaacgtagccgggcgtggcggtgtgcgcctgtaatcccagctacttgggaggctgaggcaggagaatcacttgaaccaggaggcagaggttgcagtgagcctagattgcgccactgcactacagcctgggcaacagagtgagacttcatctcaaaaaaaaaaaattatatagtataattctaataatgggatgctccacttcacttgcaagtacttgcatatggaggtgtttttttccccagtatgaggagagatcaacagtaaatacctatattatttctattgctggtcaatgcagaaaatatttgttaagcacgaagagtgtggatgtgtttgatgactacagaactaaggatttctcaaagaaacaaagagagaagtctaagttcaggtgtggaagcccttgcctaatttgcttcttcacttttgcccagaaataatttggccagggattgtgttactattgttgaattaaaccagacagaatcaggcctataagaagagccgtttagtaaaggaaatgattctgtgaaaattttagatttgataactgacatgggaggtgtttaccttcttttgaaaagcagatttaaaaaattgaattaaatatacacacagacttttacactcattttcagggaagcaagaactctatcataataatcaccaaatatcaattaatcagaaggaaaaataggcttgcaggaagagaaaatcagttcctttagacaaatggtattgacatagagattccaggtatgtttagttatataccatgcattctggatcaaatagagaggcttgtgacttgtatcagtattacctggcttcacagcagcaggagcagagaaaatatgcactatgtttagagatgaattaggagagtatgtctgaaagaaccagggatgcgtgggcaggtagatttggtcaggcatatttataataatgagccattggatttgggattgggtggagggaataaagtcagaaaaccattgggtcatcttccctaataaaagagaacgtctgtggagttataaatagaattgcctaatatttcatctaatagctttattcaatcattagaacctaagctttcttgtatcaatgtaaagtatgtgtgtgtatatatgtatatatattcatatgtgtgtgtattatatgcatatgtgcatatacatgtgtgtaatgaaaaaagaaaacagccctgaagaatcctcaagaaactgtcagacgtccttgtcctttaaaagctccagttgcccttcttgtctaaacacatcagtgcagtgtgaatcctgcattattcatgaacacataaggtctgtatttgtatacatttatctcttggctatttatttctataatctctgccccaaaccctcgccatgctttgtctttctcttttcctacttttcttttttttctggtagtttgaaaaataaacattagaaatagctattttattgcttacttctttcctttaacatatggcatttgcttaacctcttggagagttgtggttttctgaccctggagttctgatgggaaagataatgagaagtgtttacttagcatctaggccagcaagctaagaaaaacattgtgccatgctagtattgacaaggtgacagagagcccacacttgcctcacatgttggccactcccgatgctacatcccactttactcttgctggaggactgacattaatgcttactgttttgaggtctggacataatcctggtagattctaaaactcctagcaaacagtggtagacaagtcaagggtctataattgcgtataaacagaaaagtaaagacttacatatttaagcaacctgctaatccccatggtcatttagttccctagtggctatttttaatttgtcttgtttttagaggcactctgaaagcatgaggcaggtgaaagcgtgtctgtgtgttgcttgcatgcacatgctttttcaagaaggtcttcttcttttcttgtcaagactgcagctgtcaactgttccccaaaggtgttgcctagaatcagcatgcagcgctgtaggcaacctgtcacttagatgagacaccttgtatatatgctgtagttcactctctgacttgcctgtgtgcacaatgccatcttgtctgttagaagacagggccatcgtgagatgcagtttctctttgagatatatagtagctcttctttcttcaaaaggaaaaaataaaaaataaaaaaaagctactcttgctggaaaggtagagagaagggtctgcgggtgccctctaccattgtggtttcaatgtctaaatcttctggagaggattgctgcagtgatgagataaaagcagctgcctttccaagtactgtctatttgcattgatatttacattctttgccaaagtgacatcattaacatttgcttagtatttgtgccacagggatatgttttacataatttaagacttggaagtgatgataatgtatttcagatgggcagtagaggccacagagtgctgaatttcatcccctttcttcttaaggaccttagtgcataaataagtccctagtccgtatccctaaatcatattaacaatactgcttactgggtgccaacaatatgtctggtactggactagatatatgtgtatatattgtttagcccccatgacaacagtatgagggtaggtaccattatctccattatatagtaaagaagcaaggctagaaaaattggtgacttgcacaggtctgaattcagagacatctcaccgcaaggacttttctccttatgctgtgtcattctatctcccatcttgtagcctacttgtttcttcagatttaagaaacagaaaccctatattttctcaggacatgacacttgaaataacaagaaagaatattgtgggactctgaccttggtccgtttctgtctctttcattctcatctttactctaggtgcccagaaactcttctttgaaataaatataaaagatctgtgtttgctttgagagaaagccacataacattgtcacaagccagattattgaactctgccagatggcccttatttaccaaatatatgttttagttttatatacgaacagaggttttaaaaagataaagacgaacaaaattgtgtttaatgtcctgtatgataccttttgccttatttacaaactggtcctctctctgactgtacctgctcctgatgccccatcctcaatgtcctccatcagcataaaaaatgtgaaacctctttttcaaaaacaaatttaaaaaaaagtgctcagtctctcatcttgagatggagaattagaagcaaatttgcccttgcttttcttcttaatcttccttcttcccaccttctttccctcgctcccttctttcttctttctttcacaccatgtgccccagaatgacagctcagggaaagtaggcattataagctgagtagccttttccttgatgtcccttgaagggctccttatgttcagagaatatatcactgcatttgcagctcccccagaaatgccgtagcttggaggagcctattactcacttgaatctctttggtgtagacctataaatagattctcgtcttttccttgtaaccccctatagattcttgattcaagggtcaaaaatggagagatgagagttcaatcttcttggaacttactgacaccctagctcccttttaagaacttgtcctccttactaacaccatctacatggccatctgggtcttctcagctcagaaacaccctgcaacaatggctggcggaaataaggggagggcccatttgaattagcacattcccccacaagcacacacatccatactgccaggcctctgtttgtccagtttcctcctcttgtgctgttcttcccacccttctcctcagtgcagttcagatatcatctgtgtcccatgaagtctactctctcccaggggaaaccctttgaatttccattgcatattattctgtgcttctttttatgattaatcccatttaccttgtattatataaatatattttggtccttattagattatatatacttggaggaggacagtatctttctttggtccattggtgtggctaccacaggctcacagcatggcatttggttgcctaaaatgatatgtcttatccgttctttgatgtacagataagaaaagcctttatttagtttggctttcattttgttcaagaacagtggcacagtttggtttttcttgatatctttcccttattcatggttgcttttctcaaacagcacatgtggggcttaatacctagatgatgggttgataggtgcagcaaaccaggtggtacagggtcctgtgtgactctaccatggtgcacatttacctgtgtaacaaacctgcacatcctgcacatgtatcctgaaacttaaaatttaacagaaaaggaaaaagaaaaagaaattattataaatgtaaagtaattaaaagtatattatttaggagggacagtagatatcacaaaggtaagcatgtttcattctcaaatgaaatacacaaatttataaaagtgaattcagcaccagtggtgaatataaaaggctgttaaggaggaggagctaaagttttgattggaacttgaagaaaaggtatgttgttataggcagaaaacttgccatgcaggtgatcatgttagaatcagtgtcagacattaacaaaacattttcagtcaagggcagagagtaaatattttaggctttttggaggctgattacataatttgcacaatgaaatagtgggtccctttttcaaaaagcaataacgaagtgccatgagaagtacttaaaacataaagctctttttcctttttccatggtttctctctctaaacttgtcatgttgttttatatttgctcttcagtgtcattctaaggaaagaaaatgttaaattattagcatgaattttgccattcatctttatattatgccatgccagtcttaaataagttctgaataagaacttctaattcatttgcagaattactgacataggaaacatttcttatttcatagctcatgcagtgcatatatgttttgttcttaccagaaaactggacacactgcacagattaactcacctgtttttatttatttcacttcttgatatacacatattcaacaaacactctcttcctttggcttcctaatgagtaagaaaagactgaaaagaaaagaaactgagttgctttttcttttcttttccttctttgacataattttcagctgaggtggttggtcaattcatggaagtaacatgagtaagaaaggctataattaggttccttagtcatttatgtttcttagaatgccatcgttttctttctgtgttcaaagcaagttttggttccaatggaaaacatgttctttaaggactgtcagcatcccagcttactcagagtagatgtgagagactttgcaatcgctttgagtctcattgagtgtgcatcctaagtctaccagaatcttctactcccggggtattgtgagagctatagggggtgaagtggcaagaaacaatgggcatgtgtatagtatatccatatgtttatgcatctctcttttgctactgcacatgcctaattgtttcattagacttcattcaaaaacacaaattcaaagataaaattattaagtgtttcaagacggagagacaggagaatattaaaccaagagcaggtggtacagggtcctgtgtgactctactggctgcatacccatgaagcttcacctgggttttgcaagccatatggtctctgtctcaagtatttagctgttgtaccatgaagtgcggctataaatgatatgtaaacaaatggacgtgactgtgttccagtaaaactttatttacaaaaaacaggtagcagccagaatctggtctgtgggccattgtttgttgatccctagttaggcaaaaacatggagatgagaatatgtgagccttgtttgagaattgcttagctagtgtgaggtaagtcagggaatttcagaagaaagccaattatgaaagcatggattggactgtttgaatattttcctctagttgataaagtgactgatggctttagctactgaattaacgtgatcaaaagagtttttttttttttttggagatggagtcttgctctgtcaccaagctggagtgcagtggcatgatcttggctcactgcaacctctgcatcctgggttcaagcaattctcctgcctcagctttccgagtagtgggaacacaccactacttccagctaatttttgtatttttagtagagatggggtttcatcatgttggccaggatgatcttgatctcttgacctcatgatctgcccgcctcggcctcccaaagtgctgggattacaggtgtgagccaccgtgcctcgcccatcaaaagagatttttagtgaattaatatggaagtgtcctatcacagagataggaaggggtggatctgttaatagacagatgaacaagggagctattgtgagagtccaggtatgagatgataacaacttggagtattaagaagggatttgcaatgatggaaatatttgattccagaggaattttaagtgaagtgtcaccaggatgtggagagtgatttgatgttggggctgagagaagaaaagatgggaaatttcaaggtcttgtgcccggaaggctgcaaaatggatagccattcattccctgaacctgtattgtgtgtatcttctgtttgctaaaataaccatgaacagaaatggctggtgggctgctgattttaggtggctgcagaattttggtctatttgagttgatgttgggttgcctaatacacatgatgcttacaaggcattcaagatgtgtcactggcatagaggagtggagtgagggatagaagtaaaggtaggtagcccatcttcacagaaaggtgaattagaccagcgacagcagataccatctcccaatggagaaagcatagagaagagaaagaaaaagaaagaggctctaataccctaatcacttacataccctagtgtagtcctctatgcttttcaaattaagtagatatttcactttcctgtttaaccttgcctggaaagattgagaggtccatgtctagtcacaatgttagaatgaaataaatgtgtgaaataaatcatgtttatagtgtagatccccttcatcttcatctttgagtcaaatgccaaagccatttgttggctcagtaacgtttcacttagaaaatgaaacttttattttggctaaacgagtatggtgtcctggtcctttcccaaaaacataccttcaattttaccctagctggctgattgactgtttcctttacagatgcagtctagggatgctaagggcaacatcctttgtgataatgaaagccttataatgtattttttccagtaacttaggatgctgtatattaagctgtatattggtaaatattttgtctatgtggagaaatgtaaatgagatttttttttcttttcatcattcttctctacaaatgtgcattgaaaagacactgaactttggtcccatgcttatgcacaaggtataaaagttgcttatattcctaacctctccacagagttgtctagattcacaggactatttggtcaaatgttctgcaattcagttccactgcttgactgtaattcacctataaacccagaaaaatactgctggagttcagaggccctgactgttattagacagagaaaacctatagcacactggaacaatcacatttaaaagatttgcctcaagctttctatggtcactattactctttaatttatgcttttaggtttcaactttgaaatgatattgaaattttcattatgggcaaccctgaatctggaaaaatccaaggcagcttttaggacagtcacctttaattacccaccaccgttaagattaggaagtaaatgctgaaattcccatgtaagtgtattttgcaagaaattttcacactatgaaataattggtctttatctctcatcctgtctgattctctatcaagacatatcaaacatgcacccctctgctcaaagtgtaaaaaaaaagtttgctttttaaagttttaattaaggcttttgctgtgtgtgtgtgtgtgtgtgtgtgtgtgtgtgaaagtactacacactttagttgtttaggtgtcattgttgagacatttagactgtatttcattcaggcagatacttttactttattacattcccaaatgaggaaatgtgctgattagatggaaaagcatgtgtgtatcttatagtgttagcaatttggcacggtttttgttttgttagctctcagcatggttgccttcaactatatttacaccacatgggtgggcatgtgttaaagatacaaaaatcctcagacctctgaattgcattcctgaaggagaccttaattctattaggttggtgcaaattaaaatgccgttacttgtaatggcaaaaaccgcaatgattttcgcaccaaccttatactgcttattgcttttgcctcttctgtaatgaaaggcttctaactggtttgcctgcctttgattttagctttttgtgtagccttggtcatatcaagtttctgctgaaaaatttggcatggcctttgatttcccagtctcatctcctacaactcaccagtatgcaccggtagttccagtccgcaatacgtcctgcgctgtcgagcttacgcacctttctgtgtgctgtttcctctgctaagaatgtctagtgaacttctactcaccgtttaagaccagatttaaatggcatcttccttacaaataagttgattgatctatcattttattgattctgtcattcagaaacattccttcaatgcatgctatgttctgggaaactttctctaaacggactcaaacatttcttcttctgggttttcccagcgctggatactctgagtcattactaatccacactgggttcttgttttctaggctgcatccctcaatagactgtgaggtctttgtgagaatacaattgcttttgtgtttagttccatattcacagcgttcattctagtgtctggaacatagggttccactacatgcactacacatttgttgactagaaaaatgattcgttttatcaagggactgtcttaggaaatactaagtggggtgcctttctgatacattgtaatgaccacccttttctctgttctctaacgttgtatcccaaagtagataaactagagttttatccttaccaaccatctttctctcatctccatcctactttcccagcactcccctgcacccccctgctgtgtgcaaagctccaatcccgggaaaataccatgcagcgctttcattctaaaggggagcaattgaaagcatttctttggtaatttaagcacacagcagctacctttgcaaaagcctggttgctaaattatcccctcaactactcattttgcaaaagggaaaagaaaaaaaaaacacactggggggatagagactctaataagaaaagagtctgtgttttctttaggttcagcctgattcctctccacctcctctcccttcagtgactgcaaggctcctggtgtggctcgttctgctacttttccttttaatgttttaaatgccacaaatgcttgtcataaaccaccttcttaattatgcagaagtggagctgaatggttagttagcagttctattgcaattactgcactttttcaggtctgctgctgttttatgtggcactgttttctaagttgctgattaagatgatgtagtgggtggagttcttcttcccaccattggagaagggccgctgaagcctgggataatgagtccttaggcaatagtttatggcctaataagagttaaggatgggagcaaggaggagatggagagttatgctcattcatttccttcttaaaaagaaaaagccctctggttttgttcaacttttgcttctcctttgtccagtgtagatgctgaaattgctagagaaatatccatgatggctcttagcagtcctaatcttatttggacctgatattctgaggcttttaggcatcttcagatatccttgtgcagtgaaagagccttgcattggagttgaaatgatgacgagaaaatttaagaactgttgagaatttgaatcaatctcttcatgttgccatctctctctctctctttttaaagccaaatatgaatactgctgtgtgccgatcttgagccctgagaagctgcacttccagtgtagttctaggtccccactgaaaataaaataatgtgaaattgaaagcagcatgctattgtaaagtagtgcaatcattcgttcattcacaggtacttactgaatgcctactatgtcctaggcactgtgtgaggcccaggggatggggctaaaaacaatataaacttcttgcctttatggaatggcattctagtcaggtatactgatattaaaccaatctggaaataaatatatactcttcaatggtgctatgaaaaaaataaagtagaatgaggtgctataaaaaaataaagtagaatgagggaatggagagtgtgctagggcatgctattttgggtggagaaggtttctttgtggcagtgacattgaaataagtgcctgaatgaggcaaagcaacaagatgtaaggatatccaagaagagcattccatgctgaggaaatagcaggtataatcaccctgaaacaggaatgcacttggcttattggagaaacagtgggaggctgatggctagaagacagtgagcccgcagggcaggacagggggtaaagtgaggtcaaagagataaccaggagcatattgtgtatggccttgtaggtgaacaaatgggctttgaatttaatataatttaatttatattttaaaatcatcttggcggctgggtgccaattataccataaagaggcaaagtagaagactggagccaccgaggaggctgctgcaggaatctaggcaaaagatatattagtgtggtagtggcaagcgtgctacattattatgatgtcctcggccttcttaagtgtttgcttcataaatcagtagagttgtgagctgtgacttggacctgataatgaatcattacttattttaaaattgatacatacaataacattcttaattttttataagctcatataaaatattgaaggaggattggtcttattttgcatctgtttattaaacattagactggagataaggttgtgaggccctagagccaaataaatattcccagccttgcctggcagacaattattgggtgtggaggttacccagcctccatgttgcctcagtgactccctttcctgtccttcactaggtaggaggcaaaaagctcagcagtgacacacaggctctgctctcctaattgctgtaaagaactgtgctgtttcttcttcaaaatgttgattgcaggcagctacagggatgtgctcttatgttacagtataaagattttttattgtaaagaaaggagatttgttggcatggtgggatgtgtgtatttgtgtgtgtgtgtgcaagtagctgtgcttgcactgggagactattttactttgcttttttcctctcccattataggaagtaatttttggaggaaaatagtatgacagtcctgatactattttatttattttcttcttcagagtaggtacaacagaaaatcctgaatttatgcttgttgtattttttctccctattatatttctgcgtgttcacacccctctattaacagagaaagtttatgctatattctgtactccttttactctttttattaagagaaagtgagaaagctgtcctagaattatacaaaatatacatatatttttccacatctgaagggtaaaggaattgtaattcatgggaatagagtgttaagggcttatacaatgatatatactatatatatatcattgtttgtatgtatgtacatatattgcacatatatacatatcactttttggctctacttttattattttcaagtttcttttatataaccccagctgctcttctgcatttagttaagtgcagtcctaccatgtctagaacccccttctattctgcctacattcacgactttcatccctcaactctggtcccatttatctgtcacttagcattaactacgttataatgccatttatcccttttgtgcatgcattatttctactcaagtgggccatttgcttttttagggcaaatatcataatatgcacctacttatatgctccacatctgcatcaattcagacagtttggttgcaagcaacagatactataggcttagactacctcaagttggtcaggaatgtattaaaagtctttggggtagcttacagaatcaaagcaaagactaaaggaagaggtttccaaaaacaatcagagaatcttgggaggtctaagtaacagggactaattaatagctattttaggctgcagctgctagaatgcataaactccaattatttccccccattcttacaacagcctgctgaagcctccaaggtattgggtcatgtgcttacccctaagagaagcagaaaaaaaaatcaccttttgacaatcctacacctctgtgaacaatgggaaggagatgtaatttcccaaaagaaaaccgggcactgagtggcccaaaacaattgtcctctataatatcaagcatactttggtgtccacagttggagctctttacagatctggtgtcagtgatggtgacgacaaggagaaggaagagttgtaaatgactttgctcttttgagtaagtgatcatcaaatgtccttgcagtcagaatggcaaacaaatggcatggcctgtcagtatctgaagttaatttgggctggctgtcctttctttttggatatttaggtttcagtaatgatttcccgaaggccacaataataaacatgtgttatgttataaaaagcgggtgctgcatacattggaagcaaggccccctaattgaatcacctgtgctatgactctttcaactcctaaggcataattgaagcactatctcagttggcatctttgtggtttccatccacacattcttactttctggtagctggattatgaacaaccccaaggtcaggcttgtgtagaacccaacatcttacatattttactattgataaaatacaccctgagtataaatgttcacataacactttctctcatctctatagttatgtttctttcttatgaccttggccacatactttaaactccttgggaaaatatgctgccgttaaaaacgcttcacctatttcttgaaaaatgaccgacaagatgtttttcgtccaattctgtcgtatatttctattccctagatttaaatttcctggacttaactgttccctatagttagcagaaacattattttaagaacaatttaagttgaacttcatgtgaaactggctactgaatctgagtcgggaccttcttctggagggaggtaattaaatattccttattgatgctattttaaatgtgttgaatgaaaggagttaattatacagcagggaacatggcagagttctgactaataatgagctcaatgtttaatgtcttcatctttgttagaatcattaaagttgtttgaaccaatcagatgtttcaagtgaatgtagactcacagctaaccagctccaaatggcaatccctcacagatgcaggagctggtatatctaatgatgacttcaggaaaaggatggcgatatattgctttcttccatgcagtataatctgtttcagttggtcttccatcgtgatggtaaagagaaaagaataagtcttatttccaaaatttcatgtgttataatggaatgatgtttgtgcctggacatataaaagaggaaatgattttgttttttccttaaagttttacgtagccaatctctttggaatctggtgcaatattgacatttctggctgccaattcctcacatgataaatgcattaacactaaatcttaggatgcccaggaatcactagaggaccaagcactgtcctaaagaatggatctcctgtaatactgttgtagagaaatgtaggctcttgaggtcaggtttttcataccgtattactggtttgttatgtgtctttaaataaattttgcaaactccccgacactcaaactacttcctcttaaatttctcctcccttctgattgcttcaccaaacagcctgtggctttgtttttatttacaggactcctaagactctgtcctgtcctgtctatgctggggaatgtaaagtacagaagattacttccttggttctccatggaagtccttttacccagctgtgaggattgtaacaatgattggcggtgacatcactctattactgaacttcacatatgggagttgggagactttgaggaatcagtagggtgaatttaccaagttctcccatgagcccaggcagccggggtgtgtgtgtgtgtgtatgtgagtgtgtgtgtgtgtgtgtgtgtgtgtgtgtgtgaaggaagagtaagtgttaggacagaacagcagccatcatgggaaagggaaatcctagttccacctaggatggttacttcgtggagagggttactttgggtagttacggcagccttcagggttttcaagaataatataacatatatgatttatatttttgaacttcgattttaccactgcgttccctccagtgtacttagtagagataggatcatgtgtatcgagagctcaggctttagaatcccacaggtctggaatgaaatctcagctctgacttttactacccatgtgactttggacaatttatgtatccactgtcagcccattagataacctttaaaatgggaataaagtagtgcttgctttgcagaattgctgtatggattaaatgagataattcaggtaaagcacatagttgagtgcaaaattaatttatcacatattattagaaatgtggttgaagattgttttgttatttagatgaatcatatttaaatctttcattttcaagtatctaagacttccaaggactaaaacttccctctgaattttaccactcatcccagctggagatctaagataactatttttgtgtttgtttgttaattatttgacatgtttcttctcaaattaagggaaaattcttatttcggagtcactgttcagaatgaaaatgtgagactaagtatttgttttgcaaagcgcaacagaatagagaagaaaagttgggcattctgtagggcgacccatttggaaaaataaatcctaccccttttgaaggggagaaattaatgagatgagtgtcagtccctccctccccacccactgacctctctctgggatcacacaccaacagcctatgatgaagtgttgctgcagtgcaatggagcaaggttaccttcacagtaacagcttttctctggccagattactttatagccaaagatgtggttattttcacctaaacgtttcatttaaatacattgtaaagtgtgacctaggaaaacgagacaaaatcattctaagctgtatagagttggattgtttgtagaaatgctggacattaaccaatgactctcaacttgaatgtacatcagaatccccaggagggcttgttaagaaacagattcctaaaaccttactccaaagtaggtgtcaggtggagcctgagaattttcatttctaacaaccttccaggtgttgctgatgctgctagccaaggaaccacacttagagaaacaccttcaaagtgcatattttcgtgtcttactattcaaagtatgctccctggaccacctgcattagcatcacctgagaccttgttggaaatgcaaattatcaggtcccacttcagatgtaatgaattagaattgtattttcatcaactccctgaagtgacttgtttgcatattaaagtttgaggaacactgatctagtgattatagccaaggtctttggagagttgagaatctgagacagtcagccctggattcaagtctcacctactgccattttctagccctgtgattttgggggtgttgtcatttttcttctttttaattcccaatttcatctgagaaattgggatgatcatacttgaaaagttgtgaagattaaatgtgataatgtaggtaaaatgcatacaattagtagtgttgttaaattatgtcttcatttctttttatgtgaaacctgtcctgtgaaaccattagaaacagctgtttgaagaaggtatttgaaattctctctgaagtgttttcctatgtcctgttttgagagaagctattttcacagtatggcattagattgtcctcactatattattttgtgtatgagtgacagctgtagagatatataatggtttgagtttgccaagtcacagccccctcgtttgacctctgaatttaagggtgtgtgtgtgtgtgtgtgtgtgtgtgtgtatgtgtgtgagagagagagagaaagagatacagatagacatttcgttggaggaggagtgtgagggaaaacctagggttttctttcttctctaataataaaatatgacataggctttcaaagataaaattcgatttgtaatatttgacaacactggttagtcagccctaacctcactgatatattatgaagatgaaggttatgccagttaataaagtgttttgagaacattgaaaggtgctaataaaattggatatttgactttttatttacgtatgtatgtatgtatgttttgagacagagttttcctcttattgcccaggctggagtgcaatggtgcgatatcagctcaccacaacctccaccttccaggttcaagggattctcctgcctcagcctcctgagtagctgggattacaggcatgcaccaccacgcccggctaattttgtatttttagcagagacaggtttctccatgtttgtcaggctggtctcgaattctcgacctcaggtgatccgcccacctcggcctcccaaagtgctgggattacaggcgtaagccaccgcgcctggcctgacattgtttaattttttaaagtacagcccttagtgataatttttccttttctgtagccagagaggattctagtattttggcagttggacgatatcttatctctctcaatgccctcatcagttgagaaataagcctctttcttttagtattttatattctcaaagctcagaacatttcagagtcatgttatgtaaaaatgaggtataatggctgcagagaaaataaattaaaatgagaattgcgctaatgcaaattaaaagggttaatgggagcattttcttctgggtctcaatgtaggtctctgtacagatgattgaggggtttttggatcctgagtgttattcagcttggaggggctcttttctgaaattgctggctcccatacaaataggcctcttaggaccagtcattatgatgcacaccttgcactataactacatttttaacatttacaggtagggcggtggagctcttcactgcttagttactacccagggtaatctccttcaactgtaacagcaagtcaccaagttcttaatgagtatctcctgttggtccatggtaatgagggtaggtgtgtgggagaggcaaactgtaagacctttcgctgcaaatcctataagcacttgccactcaaagtgcgatccacaaaaccagcagcagtagcagcacctaccagcttgttagaaatgcagagtctcaggccccacttcagacccactgaaagagaatcagcagtttaacaagatctccggaggctgtgggggagactcacaggcagcttaaagtttcaggagctctgctttaagaaacattcctttcagagagggaacttaaactgagccaagatctaaaaccatgtgaactccaaattcagagaatcaggtcagtggtcaccagaacagagggtataataattggttataaaccattctaatagttgtaggtttaaaggaacatgtaagtgtgaggtcagttattcactgtattatgaaagatatgctttatagtttgcctcaaaaaaaaggaagtctgattaaatgtcctcaatctatgtggcagatccaagtaagaccccaaaggttaaaaacaaaacaaagcaaaaagggcaatgccgtgatcaattgcaagtcagagttaagatcaaaattaaaatatgaggtttgtaaatacaatggtaatagaaatttgacgttagcatacgaggctccccattgtttggaaccctggtttaaaagctagaatcaaaagaattttgtctagacctaatgcatactctcacttaagctaagtggaaatctttgcctctgttccagtaaccaaatctgtggcagagctgggagtggaggtattggtgagggttgtgggtggggagcagtgtcatcccccaacacactttgtgacagtttttaaggaattagttgatgagactcttgtttattctatggtgcagagagattagaggaagcagtttgagagcaaaggtcagactgttgatgctgggttgaaatagtctctaagatgcagacaggtatagatgtcctgccaacaaccagcaacacagggttgtccccagacttgctctcctgatattagagtctggctattcttctgaaccaaatacattattttactttatgacaagtgctattacatttaaggactttagagacactgtgattctctctgacatcatagcaaaatttttatgtgtgtgcccaagtactactactttttttttttttcctttggcttcccaagaagaggacctacttattgtttgtatcagatttttcaaggcaccttgggatataaaattttaagtctgctgaattggagaatttctatttattttcccaggggaaccctttggagttctgtcctactcagctgcgttatcccctagatttctgtaactgtattagttaggatgctttggagtgctagaaacagcaaatctggctcaaattgctccaaccaataaaaccaagtcactgacatgtaactgtaaccgcccaatgggttcaccttgtctgctgcctagatagaaccgatttatcaagacaggggaattgcaatggggaaagggaaattcatgcagagccggctatgcaggagaccggagttttactattactcaaatcagtttccctgagcatttggggatcagagtttttcaagataatttggcgggtaggggcttgggaagtggggattggtcaggttggcaatggaatcatagggggtcgaggtgaggttttcttaatgtctgctgttcctgggtgtggtggcagaactggttggaccagattaccagtttgggtggtgtcagccgatccatcctgtgcaaggtctgcaaaatatctcaagtactgatcttaggagcagtttagggagcatcacagtcttgtagcctccagctgcatgactcctaaaccataattgctcatcttgtggctaatgtttgtcctacagaggcgatctagtctccaggcaagaaggaggtctgctttgggaaagggcttttatcgtctttgttttaaactgtaagctataaagtataaactaagtttctcccaaagttagttcagtctacccccaggaatgaacaaggacagcttggaggttagaagcaagatggagtcagttaagttaatctctttcactgtctcagtcataattttggaaaggcggttttataactgaaaagaacagcctggctcgctcttcatgagacttgatacagggtacaaaggtgtcacctagagcatttttttctttctctttatttcctgtgcctttcctgcatctgccagaagatgacctaccaaggctagatccttgtgtacctctcaaatgttggccaacaactctggggccaactgctttccctttcaatttgagttggagagaaataatttttgtcccatcaatctcaggaaaatactttcaatctcaggaaaatatttcaaatatttccttcaaattcactgaagttgggttgatatagtttacctgcacagtctggaggaaagaatcctttttcccttttttgaggagatgttgtcttgctctcttacccaggctgatctcgaactcctaggctcaagcaatcctcctgcctcggcctcccaaagtgctgggattacaggtgtgagccaccatgccctgcctgaaaaaatcacttttgccagagggatagctgatttagttagtgcatgtgctctatccctggagccagggcagtttctaaatggaagtcagtggaataaaattctgggaagagaggtaaaaaaatgtttaccagttttctcagaatgccagctctgtttgacacttctctctcaggactttgaagactccaagaggaatgtattattatctatattctactgaggcaagccctgaagtcaaaagttttaagtgaaataggtggggttgtgctactggtctgccaactccagatccttccagggctcatctgaccatgtaggagtctagtttatggtatccacccagctggtgctaggaggtgagtgagaggaagaagaggcagactctttctctctccaattagcctctgcctctctgtttggttaataagatccatatatttaatatgctcaatgtgctttaatgtgttaccaaaccatttgagtctgttgtcacataggaaatgtagaacttttcaaacactattaaattcccttaatcgattaaagatactgccaaaatggtttacatgaaagaactaacataatagattaaaatatctttttcttttacatttattcattacattaaattttatgccatggttatagatctgaaactaattaaaacaattatacattgacttttttattcctaaatgtatcatgtttttagatgtgtaaaaataagaaacagattcagatttaaaaaataagctatgactcaaaaaaaattaatgtgaaatgcatctggaaaatttctcttttgaaactgaaatattcctcttactaaaaagttgacaatataactctttgtaacacaaagtatatcaggagaatctttggcaaaatggtgaaagaaactcttacagaatatgtaagtcacctaagttccagaattcaatctgtgctaagatttttatggctcagagggaaatatcatggactctttatgttataaaaggagtgaactatgtgattatatcttattctgaatatcaactgtaagaagcagattctcacgggcttcatccaatatgctcttgtaattctttctaacatatgtcctctattcacgaagaacaagaaaacatctccagtttaactgcattttttgtttgttttattaaattctttttttgggtatttgcacgttccaactacccagaaaattactcaaaatatttgccttgtggtctctgtggcactgagcatttaaagcaaactagtgtagttttggcttggtagagattgaacaccctttcgtgtttcaaatatttttagagaagaaattcagatacaaaagccatataagatttatcatcactttgacattaagggagcagccatgggttaaattacttgctttaggtgggtaagggaaattgatattacaccgattctgtcctcagcaccagactgtgtaatgtggggtcaccagaaacctctgacacagctcctgtcctcggggtgtttatgatgaggttttgagaaaagccagactaataagaattagattcacaatgccatgtcttagcaggatgatatagtttgggtacttgtcctctccaaatctcatgttgaaatagaatccccagtgttggcgatgcagcctggcaggaggtgattgggtcatgggagcaagtctctcatgaatggtttagcaccctccctttggtaataagtgaattctccctctgagtccacatgagacttggttgtttaaaagtgtgtggcacctccctcctttgctttctttgttcctgctgtcaccttatgatacccccctttaccttctgccatgattgaaagttttctaaggcctcaccagaagctgagcaaatgttggcacatgcttcctgtacgtcctgcagatccatgaatcagttaaacctattttctttataaattatccaacctcaagtatttctttatggcaccacaaaaatggccgaacacacaagatatgtctgcttggcctccaaaataaatctcaggtctctgattctgcctctatcaacctacattaggccaccatcgtttctcacctaaaccacaactatattcccctaaatgatcttcttgcttcagtttttttccttgtactggtttatcctacctatggcaaccagagttattatttagaatgtaaaacacagcggctgggcacagtggctcacgcctataatcccagcactttgagaggcagaggagggtggattacctgaggtcaggagtcccaggtcagcctgaccaacatagtgaaaccccatctctgctaaaaatacaaaaaaattagctggatgtggtggtggcacctgtaatcccagctactcaggaggctgaggcaggagaatcacctgaacgcgggaggtggaggttgcagtgagcagagatcatgctgttgcactccagcctgggtaacaagagtgaaactctgtctcaaaaaataagataaggcaaggtaagataagataaggtgagataagacaagatatgagcacatcataaaatgatcttgccaaaaaaaagaccattcattgatgtcccagtgcacttaaaaatcctaactctttcttactgcctggaaatctttacatgatcactgctaaaatctcagatcttgtgtgctacccctctgcccctaaggtcactaccctctgatcacattaactttcctgttctttgaagatgtcttggaacttgccattgtttctgtgtgaaatgtgtttttcctgtatgcttaggtgtatcactcctcgttatccagggttcacttacatctcgcctcagtgaagagatttagcttgattgccccatccaaaaagatcttatttgttaacttatttacatggatactatgtcttccccaacttcaagttcatgaggtctgtgtttctgtcttgtttatcaccccaggctcaatgtcttaaaatagcacctcgtaggctctcaataacagaagatggcaccaaattaatacactgaaaatgccacaagattttagataaatgtaaaaacattcaggctttgattatttggtgaacattttgaggcattacgtgagttggagcaaaactcttgaggttaaataatatttgaatgggctctgagaggcaaggggagcgtggccatgcttgtccccccacccttatctgtattctgataagaaaatacagaataaatttctttgaaattaaaaaataactcaaactctctgtaattatttttctttaattttctgagagaaggtttttttttaatttggagaaatttttaaaaattaaataaaaactagaaataatacttaatgtcttgacaaagtattaacttgatctagtttcagaaagatctcattaaactgcctgataaagtgattattcagtgccactttcatagagttttcagtaattatctgaaatgatttttagaatgaggcaacgttttcctttttttttttttgaaacagagtctcgctctgtcacccaggctggagtgcagtggcgtgatctcggctcactactacctccgcctcctgggttcaagcgattctcctgcttcagcctcctgagtagctgggactataggcacgtgccaccacccctggctaattttttgtatttttagtagagatggggtttcatcatgttatccaggatggtctggatctcctgaccttgtgatccacatgccttggcctcccaaagtgctgggattacaggcgtgagccaccgcacctggccaacatttcccttttcagtagcaggtgaaaccgtcttggtattgacacagaaatgctgataggaaaaggtgatgaactcatacacactaaaaatatgacatctacctctaaaagttttagaaatatgtggaaagcattcttggcccttttctcctaagttaagactgttcgcaaatcacttttgagagcgaagtgacgatgacatttttctcactcaagtcctaactcatttctaggcatataatttgaattaaacccttatatataattttctaattagatttttcttctttcatggctttttaagctttacataacctttgtgcttcctttttccattaatccttcaaatgccagcatcctgccaagagggtatttaccgcagtatttccatcattgttaacagagccacaagtttttttccagtatattgaaattacccatccatgagaaaatgcagtcttggatttttaattatttagttgacgcttattcaactatatgatgtaagtaggccttttctccctaatgttttattaccagttaaagcacagacaggtattttactttaatttagatatagagtaggtaacagagagctgaaattttaaaaattagataaattttttggtagttagttttatagttaatcttctctctttttttttttttttgagacagagtctcgctctgtcgcccaggctggagtgcagtggcgcgatctctgcccactgcaagctccgcctcccgggttcacgccattttcctgcctcagcctcctgagtagctgggactacaggcgcccgccaccactcctggctaatttttttgtattttttagtagagacagggtttcactgtgttagccaggatggtctggatctcctgacctcgtgatccgcccacctcggcctcccaaagtgctgggattacaggcgtaagccaccgcgcccggcctaatcttcttaatttgtcacttagagtagggcagtcgccacaatatggaaatgagctgggattagtgttatcactgggaagtgattgtaacttttgggtttgtaccaagaagtatatagaattgcttaaacttctgcatgatcaattactgcagatttttgcacctagctccactacgtagtccatcacatttcatagggcgatttctccactcctttatcatagaaccttaggagagaatgttcttttataactcccttgatggagttgcttaatgctgcctttaatttaattgaaaatggttgatcaataaagtcactttttatggatttatttctactgtttgatgtggcaaatcattaattatcattacctaaattagcatggattgccatgaaagtgaaaggagtaaattgctttatggatttcctagtgcatagtacacatagaacttttctaaatatacatcctcttcagcagttagtttgtgccagatttcaattcctacgctacaagttctccagcaaactagaggtgtccatgtccaagtggacatgctaaaaaattcaaattttacagaaattttacagagaccttacttttgtaaggtctccggaatctttaaaaaaaatctatttaattattgatagaattttagtgaccaccatagaggggagtacctgtgtaagcagaaagcaggaggaaatgaacccatttccagaaaacgaactagacattaaggagaaaaaaagaagagaaagaaaagtaaaaagaaaggagagcaaatacctctaggttttttattctgaaagcccatgttatgggttgaattgtgtatctcacctccgtcctccccgggaaaaaaaaatacacacacacacacacacacacacacacacacacacacacacagacaatattatacataatatgttgatgtcctaacctctagtacctaaaaaccttaaaacctctagtacctcaaaaattgtatatagtatgttgaagtcctaacctctgttacctgtttggaaacagtcttaacagaggtaatcaagttaacatcaagtcatcagtgtgggccctaatctgataggactagtgtccttataagaggaaattttgatacagacatacatagaaagaagattatgcaaagagacacagggagaagatgccataggcaaaccaaggagagaggcctagagcagctcttagaaggaaccaattttgccaacaccttgattttggacttctggcctctagaactgggtggcaataagtttctgttgtttaaaccatagcatttgtggtagtttgttacagcatcactagcaaactaatacagcccataatttatgactagcatttcatattaaaattaaacatattatatgaaagcttccccaaacactggaatactataatctataagagttgcattaactattttcatggaacgtcagaatgtggaatccaaagaaattcagagcctaagctgggtactatcaaagcattttataatcaaacattcaagtatgctctgattgagagaattgatttccatatgtatctttaataaaggaacccaactttcatactttcattgtattaacaagaacaaggcacagactttgttaagcctgattctgaatgttaagtaagccaagggtgaggaactaaaatttgtagagaattgagtcatgtagtgtctactctactgtgggactctggtgttggaattatcaaatgacaatgtgaatgcatcatagagatttatcctggactagcttacacttggaccaaaggtgatttatcaggcttatcattttatattgaagtccataaactctctcttctgcatccctctgttcgggagtgtgtgtggcatagaacaaatcagcctttggcacacattggaggaaagggtgtgtgttttgttttcataggttttttttagtgatgacaatcaaaagcccattttcttgattcctatggatatgaagccgattaagtattgataaggagtaaggtattagagtttaaaatcggggccatctctgagctacatggttaggtcagtggcacctttctctgaatccataatcctccaagccatttcaggccttttatgcagtcctactgcaacccagaactccttctaggccttcctctccaggagcagttatgagattgagtgttaactgcttataagacaccatatgctacacaaaactttttataaatgttgtgcttatatcaactttgacattaatgctattataatcctcaatttacagaagaagaaactgaggcttgaagcggttaaatgacttccccagagacacatagcagtatatgctagaggcaggactccaacccagaactggcagaaaagctgatactttcaaactttcaactaatggtctctgcagcctccaaagtatcagatttctccgtcaaatccttcttgcctggtctgtctgaccaactaatctctgataatgtaacgaaggttataataaatcccttccagagaggatatttgcatttaactggatgtttatgaaataatgtgctggcagaaagaaatgatactcatggtgggaatttctcattctttttctggtggaatgtataatcttggacaaatcatgaccgcaggagtcttcattttatcatctataaatgccaggattgggttaactactgtctaaagatctcttccagattcaaaattctatgattctttcacattaaatgcaactccttttcaacatatgtgtatacttggccctttattgaacctttttataagctgccaattggaaatacacagtcacggtagatatgacaatgagcaagtcacttaataactatcagcctcagtttcctaatctacaaaaggaggctattaagagcacctacctcacagtgttaatattatatacacaagtagcaaaatgtctggaacagagcaagggctcactagctatagctttaataacgtgataactgatggtgtgatcagttctattatcatctccctgcagaaatcacagtttatctaaggttatagtaaaagcacccatcatgacttcttttaatcataaagcatttcatgcagagtgcatattttaactttgtattctaaaggcattggtgtctcactaaaagctgggcagtatttatatcaaacagtatatcatctatgtgttcatttatgcatgcagactttcacccccctccaagctatgagaacaataggcgctttaaaagtctgaagcaagaaggatattagctccatgaatctttattttaaattacatttctgagttagaagtgtcaaaatggtagaacaagttaagcaagattgcattccccagtagggctattgatgttggttgcaaataaattgctggagcaggtgatgatagcaaagtccatgccatcttttatttagcaaagtatttctcttgttaacagctccttctgcatgctttcctttcttctgtttcacatcaatcatatttgacacattgcccaatgtcagggtaaaaaaaaaatgcagcgtctggctaatcatccagatgtttggcctcacactgactgaaacatctggttgtgtagctaaatgttatgttctttcatccagttattttgtgttctgttagacagaactgaagaataaaccctaggatcttcttctattaggataaagcttatagaatctcgaacttgagattccagaaccaaggccttactggttctcatagttgcacagctgtcagcagaatccggatcaattgagataatgtgtgtggaagcattatatagtatgtggaggcattatatggatttgagaagctcatgttaaaagaattctactccctttacttggttatacaatggccaaagaatgtttgtcttctggaaagaagttttaaaacagaataaaaattaattggtgttagaagccaagatttcagagctagaccaataataataacagctaagatatgtctgatgctaactctgatccatgaactcttctaagtgctctgcatagatgtaaaaacaatcctttgaagtggaccctactctttttttccattttacaaatgaagtaactaaggatgagagtgcagttaacaatttaccccagttcagaagctcaaaatttggattcagacaatttgatttcagagtctacgtatttaacttgtaaacttcctctgaaatcaaaatgtttattcagcttccaacaccatcacttattaaacttggttttgtcaccttaaagtggggatagcatgacataccttaaaaggattgttgtaaaggttaattgaaaggatgcatgtaaaacatttaacaatgttgttttttggtaagtagtaagtaaaagtagctattttttctctatgttatgcaatatttggaatcaaatatttcaatactaatttaaataatatattctaataatctcactttctgaaaattcattcaatataatttttttttcttggaagaacattcctagcaggttaagcacttttgatcaactcttgatataggctgttcttaaaataattggaagtccacaaattatatgtttctggaaactattctgaatatggaaaattatattcctttttctttttaatgaacatataatgagtatgtattaaggggaagatatatgctgagcttcctcttgccttccttttctcccccttcatttctgtcaccctgcctttcctatcttcacaatggtcctgtacagtaaactttgtttgcttttgcatttgaactttaggaatcaaggtttttaaagaagctgcatcatgtatcataaataaaaacgaaaaaaatgaagtgtaatattttaaactgttttagaacatgaggctcagtgttctatccaacaggctatgaaatattgctgttactaataagtatgatgatgaaagccactgattcttggacaactactatatgcctgacatattgctgggtgctttgcatacattttctcatttaacgcttagaagttcttgtgattgacacttgggtatcatgagcaactttgctcaccattttttcctatggtccggcgtctttagtcacttgtattactgttgttcagagtgacctttatttgattcatttacctttcagaatcttctattactcatgtatgaggaccacacatttataattagggagtaaatttggtcatcaactcggataaggcaatgggcaaatctgacatgttttcaaagacttttcagtatgctaactttcagtagggctggtttctataacagctacgacatcttttgtcaacactcaggctgattaaattgcaagattataatgttttccgaccctaagtgaaagtgacacattcttgttcttttagtggcttcataaaagtcaaatgtttaatctcaggaggaaatttaaaagatggaagtaaaaccttaatgagatgcaacataaataatagaagtccctttgcgtgaaatgacttgtgatgaggtttcttcaaaggaacaaactataaaatggagtgtttcagaaacctaaaatacactagtaaacactgcgttttaaaaatatggtatcaatgatactcagcattcagtaaataaaaagagttagacaactggtgtctgtaaaaatgttaattttccaaaacactataaatgtatcaccaaaaaataaacattttttaaaaaaattaggtgactattttcatgaatttttagtccatgaaacctgaggagttacttgaccacagcaaagattctttctaatcctttatccagccttttgtgcaatagtacctcctgttccactcacatttcacatgcctgtatgcatgtacattcagatgtgcctgtctttgtctcccagtgcttgttacacagaaggtattcaagaaatggtagccattctcacaatatcattcctattaccatttaaaaatgtatgtggaaaagggtaaagtgcaaacctgggttgttaaaataccggaaggatatctataatttaacaccagttcatttttgttttcaaatcactccaaaatgccctcacttattggtttagaaataatgtaacaaaacaaattgtgttgtgtctccaaagaacattttgctaagtgccagagctgtatataacactaaagtagatgctgacatatgaggattgtgagagatgaatggtgatatttggcttttgcttcccaagtataggtcgtgtccgaggtatagataattgttgttggtttatgataattcgacttgcggagttaggtcagtcagcatagatgcatattttttggatggttttttaacaatgttgcttaaaattttaaatcagattatttgccaaaggggggtgacaagatttggttattagcaaaaaggaaaatattaatctagatttgtttggtcttagtactgattatgaataagtcatcaatagttaatgataaggaatcagtctgctgtgccatattggtagatgaaatgctgctactcctcctattcctgggcttttctgtcccccacccccttccttccctccttcctctgtccctccaactcttcttcacatctcccaactcccccaattcacttcttttccactgcatgccatgttaccctatgcctagttatgatcctaattgtaaccctagttagagtagacacaaagtaaactcaggagcagggattataaagctcaaaattgttcctcggctccgcattttgtgtttattaacctattttacccttgcagcaactccaagcaagtctgtaaattttagcattgagagttctccattttgtgagacccctctgtctggtcaaagtgggatgacagttggtcactatagcattcaataattatccactatggttatttttattcttacagcttttattgaaagtttctttttaaccatagtgccaaagacaaaataaacaataaatattaatgattttcttggcttctatttatgatattgttattttacttttaaattctttggtatcttctgccctttcatcttttctgttctgttcagtcaagacttagctgatcctatctcaacctcaaacatatcttttctatttcatctcttgactagttagaaactttcacggcagctaaaatctcccacacaaatctgagtaaagaaaccctagaggtcaaagattgtagtgtaaataaaagtattttcctttatatatgatataatttatatgtgttatataatatgaagtctcaattagaatagggaaaatgaaattcaataattattagagtattatttgcgaagtgttctgctaatatttttcctcctattaatcaaaattagttttgtattttttttccatagcaaagtagtctaacaatagagaagaatgtcttttaaaagactaaattaggtgaaatctattctttttgttaaattatcctaatgtaaaaccaggtggcctgattaaaactagccttctttgctgcctcctactgtttcaagaaaaaggtcgccttaacacttagtttctcttgctgtcttttgtttggagtatgtgtgggggtgtgttatttatgcaggcatagctcctcattatgggaactccaagagcctgattgtgactgttttttaatgccgcctgctgtgttgtccttaaactcttgcttttcctggaatgcacaactttctcccagctcctggtttagccattggtgtcatgtcttcatgctgcatccttgtgcctctgaaatcgtgttcaaaagagtgtttatgtttcaaattcatccacagtctcaccacatttaaagataattgcagaaggtaaaacactattaataggaacaaatttactagcatctcttttactatgtgtcttatgcataaagcagtttctggttgttgggttatacagtgcctattgtgatagtctattctaccttcacctcccgccccactgcctccccatttaactaaagctcctgctgatatgttcaatttacttttttttcttttttttgaaatggagtctggctctgttgcccaggctgaagtgcagtgatgcgatcttggatcactgcaacctaagcctcctggggttcaagtgattctgctgcctcagcttctggagtagctgagactacaggtgggtgccaccaggcctagctaatttttgtatttttagtagaggcagagtttcactttgtggcgaggctggtctcgaactcctcacctcaagtgatctgcccacctcgtcctcccaaagtgctgggattagagacgtgagccactgagcccagcctgatatgttcaatttgataaatgaatgtgttgaaagatataaaatgtgttaatccctaattgcatgtggctgtgatatttaatatggctgattctaatggagtttgtaacttatggggaacactatgaatgggatattataaatatttgtatgaagtaatacaagagacatttcaacagaaaaccatgtgatctatgccctccatcattattttctttctgtgtaacaaatgaccaagtaaaagtagtgaattaaaatatgagtaagtctattttcacagtattcataatttattataaacttcttttttaaaaaaataaaaaaaattaacttctattcctttaacaaagcaaagcaaaccaacattattatcagctaatgccatttgatttcggtttggtttggtcagtctcagggtggccaatcatttaagttttctgggactgttccaatttaagcactgaaagtttcacttcctgggaaaacacacactcctttgagtatttaccgttgacttccaggtgacccacttaagggcttcttccagaagggcaggcaataagactatcaagactcttcaaagcactcttccccaaagccattagatgaggtccaattttctcagcttgatatttctgagaactgctcttcctttatttccaggatttaagaaaaataaaataaactgatatatatatacatacctttagaaggattcagaaaagaagaaatggccgtttcaccccaatatgtcactatagatatgaatgccactcatagaattgacacgtcatgtttttaacttctgtgctttaggattttcctgtttgaattgtttatgtgcatgtgattttggtggaatttcttcccctttcctctgttccttgctccttcttttgctcagtcagcataggaacatagctcccacactaggaagggctggaggttagtaacatcaagcagtgggctttcaagttagtttgcaccttggtttggaagtgtttgctcaggtctcagatacacaggagactgtgtaatcactcttgtggcatctactacacacagcacgtgagttattcctaaactgagcacaggctcctgggtggtgaatcctagtctttttatctcctgcaggctaagccttggtatttccttcagattacaccaaaaccaaaataatgggcaatgttgtccctgaatgttcaaattaggttgagtacacagagccaaagactatcaaaagaaagtgtcctggccgggcatggtggctcacgcctgtaatcccagcacttcgggactttgggaggcagaggcgagccgatcacgcggtcaggagatcaagactatcctggctaacatggtgaaaccccgtctctactaaaaatacagaaacaaaatcagccaggcatggtggcgggcgcctgtagtcccagctgctccggaggctgaggcgggagaatggtgtgaacctgggaggcggagcttacagtgagcagagatcgcactactgcactccagcctgactctgtctcaaaaaaaaaaaaaaagaaagaaagagagaaagaaagaaagaaagaaagagaaagaaagaaagaaagaaagaaagaaagaaagaaagaaagaaagaaagaaagaaagaaagtgtcctaaaagaagtggtggtacctgtggggcgtgtttggtgtcagagtgtttctgctaaggttattttaattagcctcctcccaaagccctccccctattctccttgaggaactgtttgaccgtcacatccttagaaaggccaaaccactactaactctcctgaccctctgccttatcctcatacccttaaagatgtgacttaaaagagaaaaaattatgttgttaatttcatcaactagggcaaaggggaaaaatgttcatttcgatgcaggaagttaatgggagatgggaggaagctacggttacaattcccataatacattaatgtatatttaatataccaccttgatttgtggcctcaagttaaataactacatatgtttgcagcataattcttttcataattgtgtagcctcaatgggataacatttgtattagtttccataatcgaaaatgtcaaatgcctgtttccaccttccaagtattttggttttaggtagcaaagacaattctttcaatgcgtatctgttctcattaagttctgattgctttataaagaaataaagtcttttcccattgttctgctctgtggaagtcaccttcagagtaagggtgggggtgactgtccttgccaatttttaagtaactgccttgcaagggtgattccctacagagttattttctgcatagtttccctctgggtacagaatgtgggaaagtagatgcaacgcattttagagtagtcatttgctctaataattagcattatagtacagtgtatgggctggcttcctgttgaggtctagatttctacatataatgtaggtttttctattctgtcctatattaatttcattggagttactctttatcagagcaaacatccgtaacatttagtctttttttttttttttttggagacagagtcttgctctgtcgcccaggctggagtacagtggcgtgatcttggctcactgcaacctcttcctccaaggttcaagtgattctcctgcctcagcctcccaagtagctgggattaccggtgtgtgccaccacacctggctaatttttgtatttttagtagacatggggtttcaccatgttgagcagagcaataactctgtagggaatcacccttgcaagccagttacttaaaaattggcaaggacagtcacccccactattactctgaaggtgacttccacagagcagaacaatgggaaaagactttatttctttataaagcaatcagaacttaatgagaacagatacgcattgaaagaattgtctttgctacctaaaacgaaaatacttggaaggtggaaacaggcatttgacattttcgattatggaaactaatacaaatgttatcccattgaggctacacaattatgaaaagaattatgctgcaaacatatgtagttatttaacttgaggccacaaatcaaggtggtatattaaatatacattaatgtattacgggaattgtaaccgtagcttcctcccaactcccattaacttcctgcatcaaaatgaacatttttcccctttgccctagttgatgaaattaacaacataattttttctcttttaagtcacatctttaaggatatgaggataaggcagagggtcaggagagttagtagtggtcttgaactcctgacctcaggtggtccgcctaccttggcctcccaaagtgctaggattacaggcgtgagccactgtgcccagccatttgtaatatttacagagcattgctctttttcttatcatggaaagttattccaatatctattcattctatacacatttattaagcatctactatgtgccaatgttaaagaggtgaaagtgtaaccttggccctcagactgactttttgcaggttatgctgaaagatgaatgctcagtaatagctcgtgccttaagacgtggccgagcaagctttggaggtaaaatagctcatggagtttttatttatttatttattctttaaaaatggtcacaaagatttcagataaacaatctgagtatggctaaattatttttcttaggtaaacataggaggcaagaaattaaaagggtgggagaaacattaattaggctatgctcttatcaagtagtgtgaccttagcgaatttacctaatctttttgaacctcagtgtcctcatttataaaatggaggcataactttttatgaagattaagataatgtgtgaacaatctgtgcagtagtagttgctcaataaatggtagtgattttcacatgtatttggactattgtagaatatagaaaagaatatcatgcaaactctagtcctttaaatatgagtgaggaagaggaatcacctgtgtgtatgtgattaaagctgttagctatgatgaaggcagggtgatttttctctgaagggtaattcgagtacagagatattactttgaagaagtaatatgttaaatgaaatcattggggctgaaagtggtaacaacattctgggaaaggagccgtttactctcttcacctctaagataaaccataatgcatgcatgtatttaataaactgtgatagctagagctgtttcactggggcatcagtaagctatcctcaacccccttttcttttcttccagcttttcacttccaaccccctaagttttatcagaattagttaatactgagtccagctgaatacattgcttgttataaatagaatgctttctcccttcctctgcccctgaccaaacaattgattacaaagtttatctgctgagtgcggtggctcatgcctgtaattccagcactttgggaggccgaggtgggtggatcacttgaggtcaggagtttgagactagcctggccaacatggtgacaccccgtctctataaaaaatataaaaattagcccagtgtgttggtgcatgcctgtaatcacagctacttgagaggttgaggcaggagaatcacttgaacccaggaggcagaggttgcagtgagctgaaatcacgccacggcactccagtctgggtgacgggctaaatagaatgaaaaaggaatgacccatacctgaaatgtttaacataataaaatgactgatatcgattgatgacgttgagagcaatgaccagatataagggaacaatgtgtttttacttggattgtagatatcaagaatacaggagaatggaatgggagggctaacaactctagacaacatggctgcaatctatgactttgcattcttgctataatttactttcagtgcttttacaaatgtaagactctcgaggccagcagtgtatcttttacgctattcattctacttttataattattattattattattattattattattattattatttgcaacctctgcctccaggtttccaacaattcttctgcctcagcctcccgagtagctgggattacaggcgcgggccaccatgcccagctaattttttattttattttattttatttatttattttttattatactttaagttctagggtacatgtgcacaacgtgcaggattgttacatatgtatacctgtgccatgttggtgtgctgcacccattaactcgtcatttacattaggtatatctcctaatgctatccctcccctctccccccaccccaccacaggccccagtgtaagaaatacaataaacaaagtatcttttattttggctacgtagttatgttgagggtcattcatcgtcctccagtttagcctatttggaacggtactggttaatctcaataaacaaataacattgtcagtttaattgttcaattattggagggaaataaatatatattaacctaaatgttaaattctgcaggaaaaaaactgattagacatagacaatatcaacatgggtttgttaaataacttgccttccaacaggacccaaccagaaattggaacctatgtttcatagaaacatgattcttagaaatgatctttacacaattgtaaaacaaagggaagattatgtgacgcagatgccaagaaatcagacctaggcaccatgtacaagtatacaagcaatgccgagttcatcagtcccatggctgctgctaaattgggctttatccccagcaaattaacacagttccagcaggcacgataagtttactctgaccagattactgggttgaatggcatatgccgttattttagaaagatgcagaataacatttccatttagagtcctggcagaacaaagcttggatttgggcaatagataaaaacacatagagagtatttgcagatgcatgtgatagatagaaatggtgagtgaccatttagaaatttagaattggaatttttttttttttttttgagtctcgttctgtcacccaggctggagtagtgcaatggtgtgatcttggctcactgcaacctccacctcctgggttcaagcaattctcctcccccagcctcctgagtagctggaattataggcgcccacaaccgcacctggctaattttgtatttttagtagagacagggtttcgccatgttggccaggctggtctcaaactcctgacctcaggtgatccacctgcctcggcctcccaaagtgctgggattataggcgtgagccactgcacccgacaaaaattgtctcttttttgatatttcctagagcagtgtggctcatttagattgaaatatctgtcagaagctatataccagttccattgatttcaacattaaaatgtctccacatattcttccgcatccttcttccagctcatagctgtaattagtgttatgctccatggagtggcagaagaccagctgaacaaacagccatgtacgtaggaacagttccaggcagctaaaagagcttcttcctcacttgccactatcttaaatggtatctggtgtctacagttgctccttctactttcttaagaaaaaaaaaaaaaaaatccaaatggaaaagaggactctgaagacaaattagtcctttacaattataattttatttgatttcaaagcagtacttggtatagcaccagtccaaacagattggaagaatgatattttcattccagctcctgcatagaatatctttgtgcttttcaattgctttagggagcttgcaacaatagaatcctgttaaatctaacaccattttgaactcttccttgccgatattgtgataagaaatttatacctggcccaggtttatctctgttgataatgggcttcatggctatagggacatgttgatatggtgagctagcacctatcattttgacacctactctttagtagacatagagaataatgggtgcttggggtaaagtgctggagaagagtgtcagcagtcagtgtgtatgaacctagtgatggatgtctctgtgtttgtgctgtggccatatctgtatggctatcattctttcttcctcttctcatttcttttaattttccttcaacagtctttcatttgttgcttcaattcactccatttctccccagttcttcttttttctgtcttctataattctagataaaattatgacatgacttaaaatatcctccttttttgtccgtgattgctttcaatggttctaatgaccccattggaagtctggtgattaggccctgaggggccacagtaatggaaaccttgtgttcagccttcataagggtgatccaaaaatgttattacattacttacacctctttctgtaagtattttttcttcattcacttcgaagtatgggatgcttcccatgtgcaggagaattagctcattcataactcaaaggcaagtaatttcatgttttgctatttataagagaggagtctatcatgcaaggatgcaaaggagtatgaaatcagtcacaaatgtaggaaataaaaggcaataagcttccattaaaccaaacaaaagaaaaattaataattaggcagtctctttgcaagtacataataataatactctatttttcaatgaatcaattaggtaaaaatgaaacaaaataaatgcaaagagagccctcaaaaatatatcacttttacatatgtaatataagttgaacatctcattagaataatgtgacttttttaaaatttatttttgcttcctagagttcataaatcttcaggtggtaagtaggggttctttagctattcataatgcaacttgcttaggttaattagtagagaccctttcccttcacagctgaatatgagtgcccctacttactattcaaaaatccccaaaaccagcactcttctatatattggtgcttggaagagattgtatttttcattgacctgcaatattaggtattttattataaataaagtctcaaacaggctttattttatttgtcagattctcttttggtttcgtctcataaaatattagctgaatagttattatataaaaaggaaatgatcagaatatcacatttcgggtggtggtgtttagtttgtgggttccttcatgtgacaggttgaactgggtggtagagaattctgagttctgtacaacagagtgattgatttctcggtttgcatttcttggcatctggcagtgacaccactgcagaccgagagcagaaaatggacagtagggaaaaatgcaacatttctacttggtccagctgcctttgaaggatgctgatgtttcattttttatttcttaccccaaacatatttatttgctgagtcattaaatagggcaagtgttatttctttctttgtatttgccatctcaccacagaagagttttattggccgggcgcggtggctcacgcctgtaatcccagcactttgggaggccgaggcgggtggatcatgaggtcaggagatcgagaccatcctggctaacaaggtgaaaccccgtctctactaaaaatataaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactctgtctcaaaaaaaaaaaaaaaaaaagaaaaaaaagaagagttttattaaaccatctcgaatcgatattgttttggcacaaattgcactaataacttgaatatatagttttgtttttttaaaggtgccttcaaaatctgatacgtataatgtatgttaaaattgatatttctgtgaaagaggttaagatcagaccgctttctgattgcagagataaaattgatagttaacaagtatttattaaacatctattatgtgactagtactatgctagggcatgatgaaaatgattcaagatgaaccatgcaagcacccctctcttcagcacctctgtgtgtaaaacataaacagaatgctatgattaacactgaaagggttcagtccgggatacttgggataaaaatcggagcactgataagttacttgtcatgtacttacttttttaaaaatttaaaattttttaattatgggtacataataagtatatatgtatggtatacatgtgatattgtgatacaggcatataatgtgaaatatcacatcaagataattggagtattcattacctcaagcatttactgtttctttgtgttaggaacattccaattccacttttttaatttttaaaaatatgcaatacataattgttgactatagtcaccctgttgtgctatcaaatgctagattttattcattctatcaatgtttttgcacccgctaactgtctctacctttcccttctctccccaatacccttcccagcttctggtaactgtcattctactctctatcttcatgagttcaattgttttaattcttagctcccatataaaagtgagaacattccatgcacttctaatttagactcttctcctctttctctgtcttctttttttccatagctcactaattttgggcatctcttctcatttacagtagcttgctgctcttcattcattaattattacaatatataattctaccaagaagcccaaagaactatagtgtttttatgtcattattctcagttcagaaagaaagcatgtgtgtggcacagggaaggcatttgaatgaatgtatgcattttctggatagcattctcgaacagagatttgatgagagtcacatggataattttaacttttctagtagcaatattaaaaacacagaaatagcttctcaataactgaatcagtaatccatttttaaaatctttttcaattcattaaaattaaatagaattaaaaactcagtcccttagtcttttttttttttttttttttggagatggagtcttgctctgtcacccaggctggagtgcagtggcgcattcttggctcactgcaagctctgcctcctgggttcatgcctttctcctgcctcagcctcccaagtagctgggactacaggcgtccaccaccacgcctagcttattttttgtatttttagtagagacagggttttactgtgttagccaggatggtctcgatctcctgacctcgtgatccaccagcctcagcctccaaaagtgctgggattacaggcgtgagccaccacgccctgcccccttagtctgactgaccaaatttcatgtgtttacggattgacaaccatgtgggtagtgcaggttttggatgcatggcaggctgaagcttatgtagcacatatttgaccttcacattttattaagtctaattttttaaagttttgtctgttcatttacatgtggaaggatgatagaaatataggaagagacatgacagaaagcttgcctaggactcagatcaaggattcagatttcccaattccggcttcagggccctgttctgtaacatcacatcagggaaaggaaaatgagagaaaagaagaaagaataagaactaatgttaattcatgtcagacacagtgccaaagatctttatttgcattattgttattattttttaaaaaataaatagactagcacgtagcctagcttacacacttctcattgtatagatgaggaaactgggaatcagttaaactttataaccacaccaagatcattgagctagtaagtggcaggcttgggatttaagaaagcttgtaatgatgttacatttgatggtttaaactgtgctgtgggaagggaatccaagaagataatcccatgtttctgcttcttgtgatgtttgcaaatctgtgttctggagtaagtctttgagttgactcttggagcttctgaaacgtctattggatatactataaccaaagataaataaataaataaaaagatcagggttcctgaacgttttcatctttacattgattgcaatgattacaagtgatcatttcatcacttggagcattattacctctatggggctttacatgatactgactttgtcaataaaaggacatattaggagcaggatttctgtttgggccagaacaaggggacataccctatttttaaaattccccagtttaggaattgaagtgactgcatactaaagttggccaaatttcatgtggctatggaatgagaatatatgaaaagttggttgtaaaaacaattaagaggattggggcagactattttatggatcccttcctccttagcttctgaaatgaactaacattgattctacaaccacttattaaatacctactttttgccatggctgatgctaagtgttgaggctagaaatgcatatgaattatattttaataagcacagaataaagaaaacttgtcttcctaatttttactttaaaagacttttatctcattgtttaagtgccataattgtacaaagcatgctgttctgagttcagtgtttcttggctcattctcagtcaatactctgcatagcatctttgaattccttactcatcaaagggtaatgagttaatttgtgtactctacctctgccaccttttgagctgtgttgttgaccattccctatacatttgcatctctgtctgccagaagatgtaccaggaaaataaaagcagcagaaaatcttataacttcccacctagacatcagtcaccatcagagtttggtctggaaacagaaaagtttatttaaaacaaaattggtactctgtgaatatttcaaccatttgttccatttaatccccattagtgaatttgcttagattaatttttttgtggattccatttccaagaatgaaagcaaaataattacatcaaaaggccactgaaatcagccaaattctctggcaggaaacttattctattcagtcacattcaaactatcaggtatgaaaaatacctttcaccactggataatacaacaatggagttggaaaatcaatcgtgtggtaaataagcaaaaactacgtgcaaacagaggaaagaagagttgttctgaaaatggtatttcaataaaagttatagtgatgacgagcagtgtgatgatgtaggaagttccaaaactaggtagagggtataatcaaaggtgggtacaatggaacaagcctggaggcaaggacgggccagtcaggaacaggtgggcttatagtgaaagaaagtggaggctttagaagtagagtatttgatgaattcttccgtccattctattttggcttctatgtcaaggaggatgacagatattcattgtgtagttttataggaaaggcgattggtagtgacttcaatgttataaagaacttggccaagtccataaaatgtccatggtgtataacaaatcttttatggtgagtgatccatggaattaggtacttagaaaagtcgattgaaacatattcacagaaaggcaaaggtttgatgacctggtgcatggaatgagacagagacactgagaaattttgattgtacaagtttttcctaatatcccacttacatcctgtagcggtgtgggcccatttattcttttttatgtttggtttccctgtctcatggtaaaatcatggacagatgttacccctcaattttctctttttcaattatttctgatccttctcactttaatcagtttacttgatagtctctgcgctagtgtaatttctccagccttttgaaaaatgtagacgcttgagccagacaaaagcacttcagcaggaacatgactaatcttgaagacatagagcagggctgataatgtacgccaggaactgtcagttaagaaatagtgatactgcattgctgactcacagtcagctcatgggtcactatgctgcccccattctgttgagatttcagtacactttccgtatatggagtttctgtgttggtacacatccagaaggtttcttgggcgcattgaccttcacatattgtttggttaatttacctaacttggtattaatcagacagaaaagacaaacatgaagtaaggaaagtcggcctttgctgttctcccttgaacttggcttcacttctatccccaccatttagtaaggaagaacagccccaatttattgagttgctatgagccagacactgtgtaagcactttctacacattattgcatttaattctccaaagaatgagataactattataatctctgttttatagaacaaccagctaaagtttatcgggttttttttgtttctgtttttttgggtttttttttgttttttttttttgagatggagttttgctcttattgcccaggctggagtgaaatggcgccatcttggctcactgcaacctctgcctccggggttcaaacgattctcctgcctcagcctcccgagtagctgggattacaggcatgcgctaccatgcctggctaattttgtttttttagtagagacagggtttctccatgtcggtcaggctggtctcgaactcctgacctcaggtgatctgcctgcctcagcctcccaaagtgctgggattacaggcatgagccaccgtgcctggccaagtttatgttaaataactcgtccagaaggtgtagtgggatgtttgactccaaaatacatgcttttaccgcctcaactgactgagcttgggactacctctaactttcattagaaacacaaatctttttctaataaactttcttcttcttttcaataaaaacatttcccacaaggtgacttaaattcattcacaattaggtataaatactgataagagcagttaacttgttttaagagtctaatatgtgctaagccttatgccagatgctttacaagcattatcttaaaccttgtaacaattttgcaaaaatgttactctattttatagaaccaaaacccaagactatgaaaacctaaatatcatcctcagagtcatacagcgaagcagaaattgtatcagctaatgagacttagtgccatttctctcatattgtgtgagaaaaatggcaatgctcaataaatgttgttctaactgttccaggtatcaagcagtagaaaaagaatatggcagatcaggtggattttgctgtcagccctggaaacactcagctggtggctacataatccatcatctcctgaagctttcattgtccacattttttttctaccctttagtcatgtgtttgtaaggaataaattactaaaatacaccataccttttaaaatatagaataaaagctcacagagagttagggtgacagaacatatgattcaaccttctgccttctggcagacagtaggctatttcttttaggtgggtatctaggaatagatacttgcatataatattttttttttgaatcccagactggtcctactaacattcttgattaccacttatttaagtgaccatcaaaccagttttatatctgatatgtttaatccaaataaatgtctttttttaaaaaactgtttaaaaaatggtatttaaatccttcccagattttagctgtgtatagtctggaaggaaacccattcacatggttttatcaggtttgatatttaatagatcaaattagtaaaacagggccctcacttcacaggcacggtgaattctttgttgataagatctatcaatgatcagtatggatcattggatggcagtgaacgtatacgtttgtggggaaaattcttatgcaccttcatagtaatggtactgcccattttatttgaggataattaaaacacaaaatacccaacgatgctgtttttattgtaggtatatgttaattcctctagagatagacaagactctaaattcatggaactttaagtgggatgttccacaaaggaaactctttaaaataatatagaaaaataaataagtaaatgtcaaccaaaatggcagaacatttaaaatcagtctgccaaatatcttttctcactttacttcatttgttgaacaatttatatgctgatatagatggccattttaacagtgtatacaaagcatttatatccacacatgtacatttaatcaaacctacatgtctacatacacatacttaagacacacatagagagtgtgtgagagagaatcaactcatcataattgtaaaggtgaagaaaattgattccttaagactaaaacacaccatattaaacttggagtttatattttgaaaataagattcaggaagtcttctaaagcattcgaagattgattagaaagataaatttcggcacacagggtctctgttcttgtaactttccctgtggtagcttatccctctgtataatacattttgtcatcattctttctttcctccctgatacaataaaaataatttccaaggttagattctatcttgcaagagcttttccccaaggaggtgcatgcatcttcttaatttattatattatataataattcctcataggaaaactaaaggcaaattaaaaccacatggagataatgcctgactgtgctttagactgttgtctaccactggctctttagaaaaagatcagagatacccctctcttgattgtccattttcttgatcatgcaatgtggtattttaagttctatgctggctttgatgcttttgttagtcaaggtgcatgtgtgaatgtgtgaattggatatgtgaatgattttaatattagcttaaataaaacattactgggaagacaaattttctgaaattcccattttcctcttccacttcccctacccccaaagaaacttgacatattcgtttcaaagcatacactgcttttttactatttttatttttatcgtgcatatcacaaccccttcattagtagacatcattgagcattaactgtgacttaattctagaaaaaaatatttttgagatacccattaagatatcacccctgacaaatataaaaagagaccttgagtttacttcattttaaataaatagactgtcttcatttcctaactctgtgaatctgacgcttcttatcaacaccccaaattactgtcaacaaattcaaaaccatctactgatgaatgagatgtttaggtccaattctgatatgccatgctcattctcatacagagaaatacctacactcttttaaatatagttgttattgctgtgacttgcacctactaaacaaatgtaaaaattcttacagttcaagaaataccagtgaagtgtatattattgccctcattacacaaaatgctcatggaaaacactctatcaattccaattatgttctggggggaaaaaaaaggaaactgaataaaaagcaatcccagaatatttgactgggctggttggttatagctgctgaacaatatgtaattgtaagaagtgtggcaaaatgataaaaataaactcagtatttgttaaagaaatgaaaacgtggcaataaaagattccggaaagcgatttagttttttgcattacttcttcattacttgattattttactgtttcatttctatttacctaccaagttgattcttttgcatctggattttgcacaattctttcaataatatacggttcagtggctataattacaggattgttaaagttcacattttactattcatcttgttatctctggtaatggaaggttggaataaatgcacataattacatggttggtcttaaattatttttatattgctcttgccaggatatactcgaaaagcagtatttattctctaatatttatttttggtggtagtggttttagcaaaataaaagtaataaatacataaatggactggtcccacgagcttactatctatggtttttttcaaattaattctaacccattcatctctctgagcctgctaggggcaggaggtgcttagagtctatggaagaaaaacgtcatgtttcagagctctggtaacaggaaaatgtccctcatgaggtactcatcatttgatctattattttatctatttgtagcagagtaactcagtaacctacagatctgtggaccaacttactaaataaggtgtcaaataagtttgatttcattctaaagcaatgccatgtcatgaaagtaaagtgaatttttttgtttgtattatactggaaatagtctcattgtactatatggcactcaaaacattttataaaaatcttagcactatcaactaaaaattaactcataagctcccgtaattaactgaacagatgactccctgttggccaaagggaccccagaaaagactgaagaactgagttcgtggccattgatggaagcgaggtcagaaacgcctcattacatgccctttatgttagagtttaggcacaactgaccagcattaacattaaaatagagatcataagattaactaaagggactcattgtgacactaaaataccacattctaaataagacctaaggccatgcaaagcaagggttaaggcatgctctgcaaaccgtaaaatctttttttaaaaaattaatcctgcataatgtggcttactttccaatctgactctggtataccctcacatggcagatagcagaccccttatcttgacttaagcatccctttgtattgacctcaagtctttagacaaagcttaactctttcaatcaattgccaactaaagtatctctaaaactcacccatgacttgtaagcccatgcttcaagatgtcccaccttttcaggccaaaccaatgtatacttttcatgtactgatttataattttacctacaattcctatctccccaaaatgtataaaaccaagctgtaacctgattactttggtaccaattatgcaagacttcttgggtttgcgttttcttgggctgcaccattcatattggctcagaataaacctctttaaaacattttacagaggctgatttttccatgaacagcagcatccaaaaaatccacaggatacatgtatcaagtatttattaagtacctacgatatgccaggcattgggctatatatgaaaaacagtgttatcagacatccacctagtgctcctgattaaaaaatggatgtgagctcattttacctttacggaggtccagagatttaaattacttgactagtccctcagcgagtcaggagaagaggggttaaaacctgattcctccagttatatagtcatttaatgttcttggacttaccagtacttttgagtttttgtgttttttttttttttttccttaaacacaaaactacacccccgcctccagctcccaccccctcccacacatatacccttttttcatagaacaaaatttggaataaatggactttaaatgaatgcattgttttgactctgcagggaaatgacatagagaaaataaggaatggatcgtacatgctcatgcactgtctggggcactcctgctgaagtctcaggagtgtctttggtttgttgtctgagacctgagagttaaaaagcagagtgccttttggaggaacacgtgtctctttccgcagcgggacgtgcacttgatacacatcagtgggcatgccatcagtgcctcgcagctcatctttctctttagggtggctgtgttgttcttccgatgactggcttgccctggagaaaaatactgcttaaatattaagattagattagttttcacacagccccattttaaccactaaatttaaatccctcagcaatctacttcccaaccttccctaggcataatattcagtttaataaatggtttgtatgccattatttctcatcaatatataaaaactaaaaggaattttaaaaatccatacatcttggttgagatgaaatttgacttgatgagaagagattattcttagaaatgtttctaattcccaatcaaggcattctatttcaaaatgtaggagcatggttgaaagaataaatctttagaaaataatgtatgagcatggttgaaagaagaaatctttagaaagtaatgtatataataatatacatatatgtatatatacttatatataagtgtatatgtaagtaatatatatctctcacaaatattgttttagtcatcatcatcatcatatacacgtgaatatatgtacatatatgtattatatatggtatatggtatatatgtgtatatatgcaagatatatatgagtatatatacatgtgggtgtgtgtgtgtgtgtatgtatatatatatatatatatatatatatatatatatatatatatatatatatacacatacatatgactccaaaaacaattcctctacaaattgtgtgtcacttccttgacccattacctccccaatgtatatatcatgtgaatatcaaacaattgaatgttttgttggtacaattggattcattcacacggaaacgtggagtctatttcttccttcaaatcctcatcctccaattaattagctgaaaaactgactgcatctctgattctctaagaagcatggaagagaaagaaatgggaaaccagctagcagctcattacatgaattcaaacagttccctttgaagggaaactttttcctggcatagatgatgtcattgatgagattgcaagggtaggcattgtataaagatgagatcctttttaattctgttttcaaaactataaagctaaaatttttagaattgaaatttcagttaacatgacccatgtattagataaaatgtctctttaaagcctgggagctctccaaggtgtggtgtgtttcctatttgctaggtacatgattacgatgcatatggatagatgtttctgaagtgtttccttctaagtgcactattgccagtcagatttacacccaagtagcaaagatgttaatgccatgcaatcctattaatctaacatgttgcttttgtggattagaactactcagactctaccttttagttgtagttattttaaatctttaatactgagctatcaaattttcttttatgatacaaagctactaagtagaagatacttgaatattccattggctgactgatgtgtttattaggcacttactctgtgcccaacacaatgataaacattctcagcaatatcgtgaaagtttaacacaggattcctggcttccagaaatatgatgtttacttaagaagagataggaacatatgtgaaaaagttaagcttcatgtagtatcttaagatgctaagtttagtattctggtggtggagtttcttatcaacaatgtttcacagaagatattgagctcagcttttcattatcaaagcaattgcatgaagaagaaatttgagaaagtacaacccctggtaatgattggagcctctgaaacttttgtaatgtcaatatccatagcatgactattttttatttccggtactgatgtggcagaagttgtggagtagtgtttttgagttatccgctgtttaggatcctgtattaaaagaagtatgtcggctgtgcatagtggctcatgcctgtaatcctagcactttgggaggccgaggcaggcagatcacctgaggtcaggagttcaagaccagcctggccaacatagcgaaactctgtctctactaaaaatacaaaaaaattagtcaagcatggtgtcgtgcacctgtaatcccagctactcaggaggctgaggcaggagaatcacttgaacccaggaggcagaggttgcagtgagccaagatagtgccaccgcactccagcctgggcaacagagctagactctgtctcaaaaaaagaaatatgtctcagtagtgcagttatccttctgtaggtttgtattggtgttcagcaagtatctggtaaattaatgaattaacaagagaatagtttctatgaagcagaaatgcatagcaaagaagtggggtgttgaaaggaacagctgggatatcagttatacaggttgaaatgtggcattggtacaatgacatattagttatactcttacaagttgtccttgagtgggtgcttgatagaagttggcttgcaaaccaaaaaaggttaaacacttgtcatggcctcaggctaatgaccccttctaatatgcaattctgtttttctcattctgagagcaaaccagatgccccatgatgtgcccactgttcttttgctaatgtgttcatcctcagtgccttcattaccagtttctttcatttgacatgcaaagatcttttttcttggctcatcccagagaagtggccgggcaagtgttctcctgagaaaatgttgatgactctggcacacagaccacatacaatttgctgcttcctcacattcacactgaagttggctaaggtgcccagagagaaaccctgagccctgactgcatccaaaaccagtcattagggatgaccaccgtgggatccctcctactgggtgcctggttaaaactgagtgtcagagaagagactggtggctttgtcattgactttcttgttcagatgtaagagcatcatcactgggagaaggaaatgtgaattgtgaaaataaataatgcagatagaagagtcggaagtacagaggagtgttcctagagtgctttatatggagctctattatggtgcataccatggtgtgttgttaagttagtttacgtgtcagtttcccctttacactgtgaaatttagcaaagcagagactatgtctgattcatctttattccaagtacctcacaaaggtaatgctagcgttgaccttaataagcatttaatcatgtttattcatttattttttgaatgaatggataatgattaaaattgaggtttttatctcttgattatggagcttaactcattgtgagcccattgacatcctgaaatacttgctgaatgagagaataaatgaacagatttaaaaaaaaaaaaaaaccctgaagagctaagcttaagccactatttaggctttgaagttgatccatgtggtcttttgttttggattgattgtagggactaaagaagtacttcatacgttgtgttatctttctgctcaggtcactgtggacgatagatagcctttacttctccgctttctcaattttcagccactggtattcaactgcaggccttctttaaaaatgtacctctttctttcaaaattttctgaaaagctagaatttttttgttttttgttttttccaggaaaaaattttaacttactggagaccaatttcttttcttaaacctgtctctgagctgagtatactgtatagtccctataatgattttggtaaatccttaagcataaggtggtcattgtgtgtgacggtgttttctgtttagtgaagacaaatggtgggatgagtctcctgctaggatgtgcagaaatgtgagcattagtctcaaggtacattccgtaaagtgttggtgccaggtgagtattgaggttgatagcttctgtgaggcctggtttcctggggttgtgcccatgttcatatgacagctgcttccacaataacatagcaggtgcgtagctcaggatttgcccactttctgcaagtggacactctcgcttgtatctaaaaggcctctcccatggtgccagaatgcctctgacagcattttcagagctgtgacggcaggactgtagctttatggtgggagcttctatctttgtaaatgccactgatgtcagctctcaccattaaccattttcttttgtcaaatgggagagattcaggactcatggaagtgagagactggcatgatgaggcaaacagggggcagtttaactggctgtttggccactttcccccactctaattctccttctcctttccataaaacatgctttccaatttctgccaataaaagcctttttaaaaaagtactagtctttcatttttttttttgcataccttgttgttattccttctgaaccagtagtaacacaatatacgaagtacattctcttgggtataaggccagtgtataggtgggaatcccatagacctaaaaagaaaaacaatctaggatttctggatgtgctctgaagtggcaccttctaagctgcagtatttgttcaacagtgtttttccaacaaaaaataggatgagttcacctgtgaagcatcctgaagggaaacaccggtgcactgggcagggaacaggagacctagatatacttcttcttttttttttttttttttggtagatatatttatttatttatttatttttattttattattattatactttaagttttagggtacatgtgcacagtgtgcaggttagttacatatgtatacatgtgccatgctggtgtgctgcacccattaactcgtcatttagcattagttatatctcctaatgctatccctcccccttccccccaccccacaacagttcccagagtgtgatgttccccttcctgtgtccatgtgttctcattgttcagttcccacctatgagtgagaacatgcggtgttcggttttctgtccttgcgatagtttactgaggatgatgatttccaatttcatccatgtccctacaaaggacatgaactcatccttttttatggccgcatagtattccatggtgtatatgtgccacattttcttaatccagtctatcattgttggacatttgggttggttccaagtctttggtattgtgaatagtgccgcaataaacatacgtgtgcatgtgtctttatagcagtatgatttataatcctttgggtatatacccagtaatgggatggctgggtcaaatggtaacaacaggtgctggagaggatgtggagaaataggaacacttttacactgttggtgggactgtaaactagttcaaccattgtggaagtcagtgtggcgattcctcagggatctagaactagacctagatatacttctaacataatctgtgactgtgtgcaggtcatgctaagtatgtcagactgccattttctccttgaggctggaagtgtggggagaaggggataatgtagttgagaatccattactggccccaccttggacagagagacaggcaggtaaagggtacacatgtgcctggatggtgctgctactggactcttgtttacattaatgtgtcaacagtgtgctccaaggttctattaggtgttaacaggtgtctcaagaaaaaaatgtttcttaatgagatcagtttgtaagaattctgggtgaacacgttaattagtttattcttttaatgcgttgaatgttttttttttttttgaaaaataatagaatcccttcagaattcttaatatgatatggtgttctgtatattttcaagaggagaggtatatagtgtttctcaaatttatttgcacatgaaatgcctgtgggacataatatctctgaaggccgatgttccttgaaagactgtgtgaaatattgaactatatgatctctgaaagttcttgaattctccattatcatcagaatacctggcccttccaagcccttgaccttcgtctgtggagtattgactctagctgccttccagacattgtcatctatgcttcttttcctctgaggacgatgaaccccggctgttctctcagtacccctgaaaaatgggaaattgtatttttttcttctttgtacccaggagtctatgtataatgcataattctcagtcaaaaggaacttgcttacttaagtgctcaaaggtttttgtcctgtggtttttgtaaggtaatcccacaacatccagataaacaaataatcacaagacataaccttccagagtgttccataacattgatcacaatcaaataatgaggcacgattccatgaaacattaggaaaattataaaggcatcaggcagaaaaccagcaactagcaaatggtttctccatgatgattttgggttcacatttcacttccatatataatacaacttatgtgcccatatttcatcctctggaagcctgccacattatcctctgaatgaatattaacactccttgtactctgaagtagcctctggtattctggtatttattcaacaggttttgaacaagattagtggattataattttggcttcaccacattttaaactgtgtgccttctctgtgcctcagttttctcctctgcaaaatggaacaatagaatccttttcattgagttattctgaggattaaatgagtgaatataggtaaagcacgtaggacatccctggcatatagcagtcaatcccttgtaaaatgttagctgcagtgggtgcaactgactgcggccagttgtcaccacctgtgacatttaccaagacaattttgggtaaaaaaggcagatttattggagaaagtacaaagataccttgcaagaaagcaatgcgcaggacaatgggctgtctaccaagaggcaggagctagagggaagttttatagggtcatactggaggggctatgtccagataagttgtgcagataaggtcctgctgctagggctatgtccagaaactaggtatttgggaacatgatgttctgtcagtcggttgtctgtgataagccatctcctctctcagaacaattgttctccccaatctggggccccttcttcattcttgcttatcttattaggactccacattaactattgttgttattatcatacacagactatctctgaaaggatatataagatatagataccagccataacctctgcaaaaagatacaaagagactagggagccggaaagcaaagatagaggagtaggcttacttttccctacatatgaatttactctattgaatattttaaaatcacctgtgttttaccatcaaaaaaataaaataaaacaagcatcaatatttacaaatgaagaactgaggttccaactttacgattgactttcctaattcaattggctatttgacttccctaatagttaagttagatttgagccagggatttgaactacaaaaaccgtgttttttctagtctaccaccttatatagagagatatgacagaggggagagatgagaggtgtgtgggtgggtgggtgagggtggaggaggtggtactggatattactgaaaaacttttgatgatattgaattctttccctgagttctgtagattttggcactggtctcttgtttcttctatttctactgtgagtaaacaaccattcccaatcctccagttctaacttgaatttcagtggactaggctgagtggatgtacaagggcaaacctgcatggggtgtagggaaatataaatagattggcactgtggaagtcagcatatgtttgcttggcacccaaccctcctatgcctttcatttgctgaatattaagcatctcatttttatctgtcctctttttgatggaatggacatgcaaatttttcaaacctacacaccctcttctttctcttggacaaagggagtaattttactatgaatccatcatgtgtcccaaggaggcaaactcaaaatttgtctgcaaaaagcctttcattcatttcttttcatgtaagaaacaaaattggcaactattttttcatagcttgtaaattccaagaaacttagtatcttttcttttcacttgctctgcagccaaaagcatattgttcagcattgcgaattcacaatactcactgctcctcagtcctggctacaacataattttgaaaagtttatgcagggaccatccgagtaataaatcacagaggaggactgctttaactgttcaccccttagctactgcctgaatgagctccatgctttatcatctcagaaggaagctgtctcaaatgcatgcttcattttattatccaattgtaacccatctagataaatttaacttcctatagatttgctgcctcttagtattcatatcttctccagacttttcattaatattatgatacttggataggagtattcccctccctttcctttataatgtaacagctttaaattgacatttggtgaatgtatcatcattgctattcaaattaggtcagtgtttttatttcattatgctggaagtcctcttagctgcgaaatcaagtttgaatgtctgttacctgaagcaatgcttctggcaaatgtttcttagaggtttttgcaagccagaaattgtcaggcacctcccccactcccacttcttatttctatgtggtttggttcatataaccatttaacatatttttataaagcggtagttgaatagagtataaaataggaaaaaattaatcatctgccctttaagaggtttctgtccactgtgtgggtgttggagagggaggtgggggaagagaggggaagggaggcagatatgcaaacaaaaatcatactatgccatggttttggtacagtcagttaatgtctaggatataatggaaacgtgggaaaaggagcctcttgacgtttactaagacttgagaatgagtttttttcttaataatctataaattgaaatccactctttctaaatgtgcctttggcactgttcttttgaattaggaaatacagaaaaacagttaaatttggttgaacgatacaggaagtactcagaaaaggcaaccatcttaccccaggagagatcaaaagacattcacagattatgttaacccaaagttttggcctcatttctcaaggaaggggctacatcttttagaccacaggcatttttccccagttttgaaactgtgaaggtgtttaggacctgagagattattaataacaggtttcaatgcctgacactcttggacttaaatgttcacctacactcaatctgatcatggacaaactacttaatctcactgagcccatgtcctcatccataaaatgagggtaataatagttccacgttttagtattgttaggatgattaaataaaataatgcatgtaagtaaaataacccagctattggaacaatcgctgctgtataataaaccatcaataattcttagcttttgctatcattcttgctactgttaattagttagtggttctcacttttttctagaaattgctctacctctgtttctcaactgagatattatagtttaagactttgattatgataactagatgataatttagatggtgtctttttttttattatactttaagttttagggtacatgtgcacattgtgcaggttagttacatatgtatacatgtgccatgctggtgtgctgcacccactaactcgtcatctagcattaggtatatctcccaatgctatccttccccccgcccccaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgtagatggtgtcttgatcagcaatctatgctttgagtgttttttgttaagtggctaatgcagtttgcatatttgtcccactaaatctcaagttaaatgtaatcctcagtgttggaggtggggcctggtgggaggtgttagagtcatgggctgagcactcagacttgggcaccatccttgtgacagtgagtgagttctcacaaggtttggctgtttaaaagtgtgtggccatttacctatataacaaacctgcacatagtgtacatgtacccctgaacttaaaataaaagttggatatttttcaagtgggcttcatccctgggatgcaaggctggttaaacatacgcgaatcaataaatgtaacccagcatataaacagaaccaaagacaaaaaccacatgattatctcaatagatgcagaaaaggcgtttgacaaaattcaacagcccttcatgctaaaaactcaataaattaggtattgatgggacgtacctcaaaatcataagagctatctatggcaaacccacagccaatatcatactgaatgggcaaaaactggaagcattccctttgaaaactggcacaagacaaggatgtcctctctcaccactcctattcaacatggtgttggaaattctggccagggcaatcaggcaggagaaggaaataaagggtattcaattaggaaaagaggaagtcaaattgtccctgtttgcagatgacatgactgtatatctagaaagccccatcatctcagcccaaaatctccttacgctgagaggcaacttcagcaaagtctcaggatacaaaatcaatgtgcaaaaatcacaagcattcttatataccaataacagacaaacagagagccaaatcatgactgaaccactcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatctcatccccatcaagctaccaatgactttcttcacagagttggaaaaaactactttaaagttcatatggaaccaaaaaggagcccacattgccaagtccatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcttatctacaaccatctgatctttgacaaacctgagaaaaacaagcaatggggaaaggattccctatttaataaatggtgctgggaaaactggctagccatatgtagaaagctgacactggaccacttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagaaacatgaaaaaatgctcatcatcactggccatcagagaaatgcaaatcaaaaccacaatgagataccatctcacaccagttagaatggcgatcattaaaaagttaggaaacaacagatgctagagaggatgtggagaaataggaacacttttacactgttggtgggactgtaaactagttcaaccattgtagaagtcagtgtggcgattcctcagggatctagaactagaaataccatttgacccaaccatcccattactgggtatatacctaaaggattataaatcatgttgctataaagacacatgcacatgtatattttattgcagcactattcacaagagcaaagacttggaaccaagccaaatgtccaacaatgatagactggattaagaaaatgtggcacatatacaccatggaatactatgcagccataaaaaaggatgagttcatgtcctttgtagcgacatggatgaagctggaaaccatcattctcagcaaactctcacaaagacaaaaaccaaacaccgcatgttctcactcataggtgggaattgaacaatgagaacacttggacacaggaaggggaacatcacacactggggcctgttgtggggtggggggaggggggagggatagcattaggagatatagctaatgtaaatgacgagttaatgggtgcagcacaccaacatggcacatgtatacatatgtaacaaacctgcacgttgtgcacatgtaccctaaaacttaaagtataataaaaaaaaaagtaggatattttttaaaaagtgtgtggcgtcttcccccttattctctcttgctcctcctcttgtcatgaaatgcaccagctcccccttcaccttctgccatgagtaaaagatccctgaggcctctccaaaacctgagcagatgccagcatcatgtttattcagcctgcagaaccaactacacatctttaaaaaaaataaattacccagtctcaggtattcctttatagcaatgcaagaatggcctaacacagtggctttttttttcttttaagtatattttatatttagatgctactattagcagatgatttgtgcgtatgtcttgccctgttcagctttgaggagtccaggcccttatgggactccttctgagagtggggttcctattttccttaggaacccaagacagttctttcagaggatttcattgatctgttgccccatggtgctttgtggcacataatgacaaagcatgacaggcaggctcacagccctcgactcatgctagatctcggttcattctgtatccagggactccagttcatcatatcccttacccaggcctctctcctagctatgtctgtgtggctcacagatactctagagggagaggcaattaatttctttttggcggtgagatggtttgcctgggtccccactccaatcttatcttgaattgtagctcccataatgcccgaatgttgtaggagggacccagtgggaggtaattgaatcatggagatgggaattcatgttctgttgtcatgatagtaagtctcacgagatctggcggttttataaatgagagttcccttgcacatgctctcttgcctgcaaccacgtaggttatgcctttcttctccttagccttctgccatgattgtgaggcctctccagctatgtggaactgtgagtcaattaaacctctttttctttataaattacctagtctcaggtatgtctttattagcagcatgagaactgactaatgcagggggttatttcatgtcagacattgtcgtaagttgtgtcttccttggtgtcttagttttttctgtgctgctataacagaatacctgagactgggtaatttgtaaagaacagagatttatttcttatagttctagaggctgagaagtccagatcagttgggtggcatctggcaaaggctttcttgctgttttgttctatgatgaaaggtggaaaacaagagagagaacaaaaggtgtctaaatttggttttatagcagatccattccttgataaccaacaaactcccaggatgataatattaatccattcatgacggcagagcccttgtgacctagtcaccacttaatgctcccacctctcaccactgttgcattggggattaggtttccaatacatacctttatggaacacattcaaaccatagcatttggcaaataacccaaacccttctttcctcatctgataattgggaaaataatagcaactaccttgtggatactttgtgagaatcccatgcttcatgcaataaggacttaataattgtaagttgttaaattgtcatacatgctccttttagttatgaaaacctgtggcttttgtctaagagttgaatatgagaaggttcaaggactagggcttttatccttggatctctgtagcatgctgaattaatgaaaggtctgtctctctctctctgattaatcaaaaactctgactagtactagtgaaagtcaggtttgaacaattctgtgaagaatggatttggaaggaaaatatgaggcaagaattttaaaaagttgtttctgagttgaatttgatttacatttgctaactggaaaaagatcagggtataatcagtccataatattgaaagcagtttggaaataccattgcagatacaggtaatttaaaaaatctacatgaattaggtccaggagcggtggctcacgcctgtaatcccagcgctttgggaggccgaggctggtggatcacgaggtcaggagatccagaccatcctggctaacacagtgaaaccccgtctctactaagaatacaaaaaattaggcgggcgcggtggcgggcacctgtagtcccagctactcgggaggctgaggcaggagaatggcatgaacccaggaggtggaacttgcagtgagtagagatcgcgccactgcactccagcctgggcagcagagcgagactctgtctcaaaaaaaaaaaaaaaaacctacatgaattattcttcctgtgacatatttgtcattcttcatctctcctttaacattcctatcttcatccttcaggccatcctctgcctacctctttctgctgctacagtgtaagttgaatcatactttccaaaatatgtaaatgaaagtcagaagtaaggcaactcatagtgtttcagtgactttgatttcaatctcactcaagactgggagattctcctaaattctagcaaacttgtgcctctttcccagccttataagaaactgtccttctatctaaatactggaatgccactatgtgaagcttcaaatcagggtggttattctgagacaatggcagcttcttgggatgtggtgtaacatgtactaaatcattatgtgcacatacatttatttttaatcaacctgcgtttacctgagtgctgtggtttgaatgtgtcccctaaagttcatatattggagacttaatcctcaaggcaacagtgttggtgtatggggcctgataagaggtgattaggtcatgagggctctgccttcatgattgaattaatgtcattatcacaggagtgggttagttagcacgagagtggcttgttctaaaaggaagttcagccccctcttcctctcttgccctttgcctttggtcatgggatgaggcagcaaggagtcccttgccagttgtaggcccttcgaccttggacttcccaggctccagaatttcgaagaagtaaggctctgttctttgtaaattatccaggctcagatattctgttatagcagcactaatggacttagtcaccaactaaatgtaatggacaagaatggcctacattaaaaaaaaaatgtgattagaggatcttaatatcttattctgtagtgaactttagaatattttagacactggagattttctatcagatgtatcctgtggattcaataggattcattttgagaggcagctttctgaagtggaaataattctgtactccaggcacagtaattgggttcaagccccagctctgccatttactgggatggggagaaactcttggacagcctgttaggcctttttggcttccacttttcttgtctttaaaataaagttaataattttcattctgcttcactcatggcatagatgtgaggctcaaataaaaaaatattttggaaactaccctgaaaactgtagaacattctacaaatattatctaacaaaatatatgaatgcataattagtgtcttcaagggatgtcataaatatcgtaaaactaaagggtgagctgtatcaaaacttggaagggattgggatgaaaatcaaactgtctaaaatagaatggccaaatacattgggacttggctccagaaagaattaatgagaattacacagattcatatcttctccattattccattggtcacgtctaataacttgccatgaaattgcattgatttctacaaagtgattgcatatgctgttgcctcttttcaactgcacatgtcataattcatccatccagatcagtattttacttttaggaaaagagagatgctaactttttctcagaggagagtgtttagaagtctatgttctatagtccctcctagagaggggggatttcttcagtactcagcagctaatcttttttttcttctctctctttttccttttttattatactttaagttctgagatacatgtgcagaatgtgcaggtttgttatgtaggtatacatgtgccatggtggtttgctgcacccatcaacccatcatctacatgaggaatttctcctaatgctctccctcccctaacccccacactccccaacaggtcctggtgtgtgatgttcccctccctgtgtccatgttttctcattgttcaactcccacttatgagtgagaacatgtggtatttggttttctgttcttgtgttagtttgctgagaatgatgatttccagcttcatccatgtccctgcgaagtacacgaactcatccttttttatggctgcaaaatattccatggtgtatataccacattttctttatccagtctgtcatcagtaggcatttgggtttgttccaagtctttgctattgtgaacagtgctgcaataaacatacatgtgcttgtgtctttatagtaggatgatttataatcctttgggtatatacccagtaatgggactgctgggtcaaatgttatttctggttctagatccttgaagaatcgccacactgccaacaaacatatgaaaaaagctcatcatcattggtcgttagagaaatgcaaatcaaaaccacaatgagataccatctcatgccagttaggatggggatcattaaaaagtcaggaaatggccaggtgtggtggctcatgcctgtaatcccagcattttgggaggccgaggcaggcagatcatgaggtcaggagatcgagaccagcctggctaacatgatgaaaccctgtctttactaaaaatacaaaaattagctgggtgtggtggcatgcacctgtagtcccagctacttgggagtctgaggcaggagaattgcttgaacccaagaggcagaggttgcagtgagccaagatcctgccactgcactctaggctgggtgacagagtgaggctccatctcaaaaaaaaaaaaaaaaaaaaaaattcaggaaacaacaggtgctggagaggatgtggagaaataggaacgcttttatactgttggtgggagtgtaaattagtgaaaccattgtggaagtcagcaggtaatctttttacggtctgagtaatgaggaacctggctaatagttgccattctagatagcattaagggtgaagtctttgctcacagaagttggtgtatccagacagacattgtaattacagcagagcaaattaccatactctgaaagagaagaacacagaaagcaacaaacacatttaaagaagactgtcccagaaataaggagaagggcaagaaatctaagcagaatattccacttgccatttacagcatagacaaggacagcaaaatggaaagtcacttatataactgcaggataaagagatgggtgagatgaaatatactttctccgaatgaagttcactgtatgtgtagtggattaaatgagattgactatttttaaaaagcctgttacaaagaagaacaaatttaatagactattaagaggtaaagaggaacttttaaaagcacatattgattaaaacaaaagttatacactttgggaggccgaggcgggcggatcatgaggtcagaagatcgagaccatcctggctaacacggtgaaaccctggctctactaaaaatacaaaaaaattaaccgggcgtggtggcgggcgcctatagtcccagctactcgggaggctgaggcaggagaatggcgtgaacccaggaggcagagcttgcagtgagcccagattgctgccactgcactccagcctgggtgacagggcgagactgtctcaaaaaaacaaaaacaaaaacaaaagttatagttcagaatatttattgcatacaactcagcaaacaaagttgacctagatacaagagtattattggaatttgttagtgaatacattgacaaaattctgttatttttgtttaattatcactaggtccagtagggtggaagtcagaaattttgacttaaaatatcagctaattgaattagttatttcaaatcaatgtctagtttggataagaatattttataaaaaaacaaatcatagtattaggcatagtttatgcttggtggcatgtagagaaatataaaaataaaagatagtgaaatctttttaaaaattgtgttgaaaggtataatcatttgtgttaatgtattattcaaccaggatgtaggaagaacacacatgtcactgagctttgttctggggctggaaggaagtgcaaataacaatgatgataataataacagcagtagctaatatttatcagatatagagcttgttaccaccacagtaagcaatttgcatggagtatctcagttctcgtgattagtcaggtacacttcttacattggtttttcggattgagatattaaagtccttagaattgaaagaacttgctccaaatcatacagctaggaatggtagactagcgtttttactcaggcagtctcaagataacatttgttgagggtctattaacaaccaggcattgagatggtgtttacacatattagttatctcagtggttcttaacctgggatgcatgttaaacttaccaaggaagcattttaaaaccctgatgcttaggacctacaccaggtgaattaaatcagaaccttttgagacaggggcaggacttggcatcagtatttcttaaatataaacattgtatatgtaaatattatatcaataccagtatttttaaaagtatcccaggggagtcagccttttgaattactgtccatttaatattcaaagcaaagtctatacatttgtattattcctattttatttatgaggactctgagattcagtgacgataactgacttgctcgatcaaggtcacttacctggtaaattgctgagctgggatgtaaatgcagttctgtctagctaaagagcccgcattcttcttgatgcctcagtgtctagccattttacccagagcaataaattcacttgttcctgttatttagtgtttatcatagaatttagctttagcctcaatttcattttattgtcttcactattgagtactcacaaagggagccagttaacaacatctttggaacaaccatcctgtgtggagcattgtgctaattgctgtgggaaagaacaggggaagatatgaaatattccctttacaaagatatctactgttctgccagggttcataactttgggcctgtgacttgacatctgggtggcaaaagaagtctcatgaattgtttgggaagtattcatagttttcatcagattgtaacagagccatgagccaaaatatttatgaacttctgccttgcttggtatgtaaggcatttgattccagaagcagtggcatattatcttgaattttcttcataaaggcaaaacagtgccttttcaagagattttgagtttgatatactgtcaaaaactgtttacagctaagcctagtaaaagatgttgcatatgtggagtgtgtgtgtgtataaaaaaaatgcaggctgtgaggccgggcgtggtggctcacgcctgtaatcccagcactttgggaggccgagatgggcagatcatgaggtcaggagatcaaggccatcctggctaacatggtgaaaccccatctctactaaaaatacaaaaaaattagccaggcgtggtggtgggcgcctgtagtcccagctactccggaggctgagtcaggagaatggcgtgaacccgggaggcagagcttgcagtgagtggagatcatgccactgcactccccgctgggtgacagagctagactccatctcaaaaaaaaaaaaaaatgcaggctgtgaatataaaacaatgaaataaatttcattagtggctcagaaactagatctgagaacaaggatttggttgtttctggcaataaaacattattaagaaatgtgatatcatgaggtaaatatcttaaagaattgtattcatttacacacatatatgtacaaataaatttgcacacatatatacatgctatgcacatatatactatatatacacatgtatgtattatatgcatgcaccaatacatgctggcatgttttatgcaaattgatttttattccatagctatttttcctatataatccattatttttaaatgtattaataattttaatatcaccataaactgaaatgagtaaagaggcctgtaatgtgaatattcatatatggaacataatacgggggttgcgtaattataggtccatatatgtattgtatttcctgatatatttatatatgaaattgctagtatgtgtgaaagatatctacatatattttactaataagagatatattcatatatatatatacaaatatatgctttatagagcctaagtttggggtggaacaaatgttctcacccttgtttgattatgagaaccacttgcagagctttttaaaaacctgagtcccttttacccttgattcaaattcagtacatccagagcgggtcctggtgctgtttttaaaacattccttgaatggttgtgttgctttgcttgagaagcagccctgtagtttgtgtacaggtaggaatgaggaaggaagggtaccagacaacagacaggtaagacagtcaaggggaagaggccaggaaaatttctaccaggagggtggcagtttattgatttgcttatgttaaaatagttgagtccgcgctgtatctttttacttgattaatttaatttacacaaaccaaaggtcaatatcaatgattaatgtcagagggaagggtattattattatttttaaccctacttctttttcaactactacatatctgaccttgcagaggaaatcttggagagaaaatagccactttcatacgactatcccttggtcaatgcgctacttattaaactttattttcccactgaagaaagaaaatcctaccttcagggaataaaatagagattcattttctgacctcctagtataatgctaaaggaaaagcatacaatctctttggggagggagctgttaggaaggccagaggcagctgtcttggaaacatacagaaaggtgctattgggacagagcataatttaaagtaggtgagattggaaaatagggatttttccttctcttttacatttttttttcctttcttgaacatatacagttcttcagttaagtgttagcctgagattaaatataacatttatgaagctcctttcaaaactcatccctgcatgtgaatggaccatttcctcctttataccactgcactgacttctaattacatgcatctttcatgaaaatgtttgtcagactgtctgatgttaaattgcaagataattgataacaagacccatgtcttaatcatctttgttggtgctaaatacgtgtttattgaatgaatgaacaaacacttggatgaataaatagactgtaattgttagtaactccatgagacctgcacatttctttgttattggcactttgcctccctgtttctcttgagcttcatggttctatatctacatcacaggtagtctagtgtaaggttgaataacaacactcaaattaaaaagtaaaaatcttaagatgcttttggtacctaagcataatcataaaacaatggtcttgtttaatttgaggaggagataagtgatcaaacccaagaatccataaatttggcctaagtattggtatttatttccagagatgggcaaggaaagagtgttggaagaaaatacaaggtaagttttacaacctgtgagtactcagaacctggactttcatgtcttttagaaagacacattgacaataggcagaaaatccttagctacaactcactggctgaaagcttggtcagttaaattgtgaatttacatggaatccaaatgaagtgttcagacatttcaaacatctcttgcttaatgaggttctgtgcctggctagcaggtcagcagtctgatttcagtttacagatgcagtcttaaaaaaggaccctgagatcatctataacacttccctgtcttcctttgctccagctgcattcatcagcttccatcagggttcacagcaatgaaattaattgacaagaagctcaatcttaagagcactctgaactgtatactcttgccatccacccgctaactccaatcctacatgaatgaatgcaagtgtagttttttgagaaggggccatggctcaagcagtgccatatatgtgccttctatacaactggcttggtatctggtaaaatttccattgcccagttacaaactagccagtcccttgcagacctaggatcctcttagaatgccctatcaggaagttctttgcaagatgttttaactgagcaatgaatttatagaggaggacttgaataaattgtttcaaaaatgaaaccatttgaacacaaatcatgtctttcactaagacccagacaaactaactcatatgtactccacacatctcagtgtagtaagcagatggaaaatattcattgttttttttttttaccaatgagacactagtaacaaagagaaagtgtagaaattcttcaagatccctagaggctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaaaaaaaaaaaaaaaaaagaagaagaaaaaaaaaaagctgggagtttcattattcctcaaagaaggcacctcagaccaggttccatagggcacgcccctaaagagcccaaccttctcagggttctaaaatgtatcttaagcccaagcaaaatccttgactttccatttagatgccaatatgccatcctcataatattcattctcatggaattttgagttcccacactcttacatagctcccaaagccaacttattttactgctgaaaaatacttcagtacacttttattgctgacactggtttctctatacttcccccagagatattcatgttataagtaaatctttttccaaggtgtgcttcatctcctggctggaagcaagaaaaaaaatgttcaaagtattgtagcactttttacagagtgtgtatcatgaaatcaataatcatttattgagtactgactattcactgtggggccagatattgagaatattggagagcaattagatgtggtctctgactccaggggtctacaaacggcatggtggggaacaagctcattagatgaggagaaaaaataataatataagtgagtataaactcaagaactataattatgcattgattaatgaaacaaatactgaagatttactttttaaaaagcgttgtgctcaaggctatggcagatgtaagtttataatatgaccacttacattaatttgctaggtttgccctgacaaattgtgaaaaactgtggctgaaaacattggaaaatcagtttctcccagttcgggagaatagaaggccaaaatcaaggtgctgacagtgctatgctacctctgaaggctctaggggagaattcttccttgccttttcctagcttctggtggcggccatcaattctgggctttccttggcttttagcagcgtcactccagtccctgtttctgtggttgcaaggccttcttccctgtgcatatgtgtgtgtgagtgcatgtgtgcatgtgcacctgtgtgtgctcctgtctttacgtgacctgatacgaacactagtcttttatttggaacccaccctaatccaatatgacctcatttaaactaattgtatctacaacgattctatttgcaagtaatatcacattctgaggttccagggggacattgttcaacccagcacaacccttaaatatcctattgtcttgttggaggttattttatgggattcatttttggtgttccatggcttttcagaggaggctcagtgtccactgatagtctctgggaagactacgtaggcataggtccgaccattgctatattttcttatatctatgaaatcctaagttaacattttaaactacagtctactgtgtgtcaagtgttgtcctaggctcttatttacttaattcaatcttatcctcacaacagcctttgcagtatgattttttccattgtatagatgggaaactagttcagaaagtttacttacttacatgagacttataagctaggcgctgggatgctaaacaaattagttccaaagtctactattcaggctgaacttatgcatttctggtggtgaaagcacagcctacataaccattagtttgtgatttagaccttagcccaaacattcgtcattatcatatttgaagccaggatggacccattgttccagatctatatactgtatatcagttagccatatcaattaataatcttttgatacttgtcaaagagcagagaaccgcagaaattaagagtttattctcttcattaaaccattaaagattggaggtggctattgtgaattgggcatgaattatagcataagcctatatatgttgcatatagccccccgtaacaagcctccttgttgtcttttgtgttcctaacttatgagcagggcagagattatcactgaacacattgcagggtaaatgtaggactctgagtcacccattggatttttacaggctgaaacatttacagtgtcctgcttacaattctcaagcatcagttaggtgcaggaacacacaggcagagtcagtagctgcccagggaactagtgtccagtctaatctcttcacaaactttgtgcgtgattcaggaaggattattacaggccaaattttacccatggacctgttttgtttagtaaaatattttcaaaaataaattttggatttgaatgactttagggaaggcaggaatgatctaggctctcacaagccttagtcattacccctggcctgaattacatatttatgtgagccctctagtccctggaagcagttctgtttgtcaccctgtacttagaaaagtggaaattaatgtatggttcctggacaggcagcaccagcatcaccagggaactttttagaagtgcaaatcctctagtcccacaccagacttactgactcagaaactctgacgtggggcctgtaatctgtgttttaacaagccttctggttgattctgatgtgcattgtcctaggagaaccactgacttagagataagttaagaaactcttcctttcttgaagaatagcgtcttctgctttctaataatgaacttttctgtaatgcctcaagatctacaaagatgtcttattttgcttccagagtcacgtgagaaaacagtaacaatttgagggaggtgttgctctttcagctttatccagagatgtgcggtggcttgttccaggtgttatatgacaggacaatggacctcaaactcaagattctttttcctctacacttcactactttaactctcctgattattttgtggactgatgaataagtacgtgtaaactgattttagttttcctggtaatgaaaaaaaaaaaaaacaatgagtattgttactcttgtaataatcacatcattttttgtctttctttctttttctcattttatttttagacagggtcttgctctgtcacccaggctggagtgcagtggcatgatcacagctcactgaagcttcgaattcccgggtttaagcagtcctcccacctcagcttaccaaggagctaggactacaggcatgtgctgcaacacctggctattttaattttttattttatttttttttatttttgtagagacagggtctccctgtgttgctcaggctggcctagaactccctgggctcaagtgatcctcccaccttggcctcccaaagtgctgggattacaggcgtgagccacttcacccagcctttttttctgtgtctaaaattcagttactctctcattcacttaacagtttagaaaatactaactatacaacatgtactacgctagatgattttttaacttaaaaatgtgcaatgcacatgcatattcataataaaaatccatctttctaactcctgagaggtaagcaaaaacttattttactgctgtaaaaatcacataattggggacaaaaacttgcatgtaatatattttctatgagactgtattgactttgagagtggttagagttaatggtttgaattagcataagtaaaattaatgatattgtaggtcttaaatgtaaatgcaattttacaccaggcccagaagaaattcccctcacctaccttaattggtcagatgaaaatatttggaagaaatacctcattcaattttttaaaagcatattggctacttgccaccattgaagaattagatctcaaactaaagggattgtcgggatgggcttaaacagccttttgatttgttcattaattcatcaattcaacctctcacaaaacaattgtatgttgaatgactgctaggtgctgtgtgctatgctaggtgctgctgatacagttatgagcaagacagactcagaatcttataaatctttttgtacaaaagacaaacaattatttcagtgagttgattaaatttaatattaatatttaataaagcagaagtaattatacctgcaaaggaaaaataaagtgtgtttttagcacctataatttgaggactgtgggatggtagggttatctgaaaagagataaataatttgttgtatatttgtttcttttggggggtgaatgccatgtgccatgatgtgggaattaattggaaaaccataggctatgggagtcagaagagacattagaggctctaatatctgtcccacttttctctaatttagaaatctggaggctgggacccagaaaaggtaaaatgaattaccccaaagccacacttagtgaatgaaagatgtgtgaacggacatatgcatgggcctccttaatcctatgctagggatgaggacatgcctttcccaaaaataggtgaaattaccatatgataaagaacatttttagatattgggagtagggtagggtacaaggctttggaacagcaaagttaatcagctcagtagggggaaggaaaaaggaagagagaaagagcaggacctccagtggaacaagagtctgtggactctgtcaccctgttactccctcttaatcactcagatgatttgctttttctgcttctatttcaaaataagctgctaaaactgagatgcagtgcagtgaaagcacatcatgatctatgttctcatttttgcatggagggagtgagtaaagacctcctacttaggtagtcatcttgctgtccctgcatgtagactaaggctgtgagagagaacttggtgctttataaggcattccctgtgctggtataaatttgacccttgcatgtgagtgatggtgagggacatctctgagaattgttcctggtacaacatgtgtggatttcaacatgggtactgcatgctggagagatcttgatatgacccaaaagcaagaccagaggcaagcttgacacgatggagcaaagggtggaaaggtagaaaatagaatgaaaaatttttctttgctgtcacctcctcgattttattcaaatcttaacccaaacaactagattgcattactgggctcttaaaagttttgttggaaaagtgctgctaaagaataggaagacaatctaggcaatgccattcaggccataggcacggacaaagagttcatgaggcagacaccaaaagcgattacaacagcagcaaacactgacaaatgagatctaattaaactaaagagcttttgcacagcaaaagaaactatcaacagagtaaagagacaacctacacaacgggagagaatgtttgcacactgagcatccaacaaacgtctaacacccagcctctataaggaacttcaacaaatttacaagagtaggatctcataggtttatttacaataataattcaaatgtttcagatttgtaattgtcctttgaaaccattgctttcctttaattccagctataccaaagactctttggaatgggtaaattatttctacttgatagactaggaaagtgagtcacaaaaaggctcgcccagagctactggttattagttgtgtgtttttctctcctattccacactcgagaaaaccccgaagaatagggggtggttaatggtaaaaagaaatctagaagaagagttctggaaatgaaagacagctaggttttgagtttctctaagaaaaggtagggggcaatggatttaaactaggggcatacactgcgattaaatatcgaaagaaacacactgagatttaaaaatgtataaagggcttatgggaacgaagaactaaaaagaaaatatgaggcaagaacatagggtggcgacagaacaaggctgtgagacgtgtgcttggtttgtttaggctttaaaacttgtcaaagtttaccgttttctctttcaagagggatgaaagaaaggatggtgcttcccttagtttgtttgctttcttctttcatgtatctgccctggcagatatgcatacatgtgcaggcccgtgtgttcgtgcacacatatgcacacagataaagtgggaacagagagaagccagtgggtggtggtgagagatgggggcagaattgatgcatcagggggcctaaatccatgcaatgatcaagttcatagcaatttccccaggagactgtatcatattccagtgaaggggagtacggcaggaggttgccatggcaacaaaaggcctgaaatattaactctgactagcaacaggccagtgaaacagcctagctaggatttatggcacattatagtgtgaaaagcaggagaaaattactgtaaaggcaggaattatagcacaacagaacatataaactcccaaatccgtcttcctaattaaaacagcatgctcggaggtagagcacatagtaaggccattagcttaaatggggatgtgctatcatcgctttgttatcaagtttaatgtccttaagactaactgtgtgcactgggagagtgagagcaagggtaagatagtctggagacagatggaagcaagactcttgggcacttgaattcttctcaaactcattcttggtgacataaggtttcttcagatactagtctctgatcccacaggagattctagaagatgccttgatccttctatttgtaaataaatcatcacttctcaggcatgaaggctgagagactgataccacagtcaatccctctggaacccaccaggaagagaggagcaactaatcaatgaggtttattgttgaggaaaaaggatcttggatctcccgactccctagaggggaaaataactcccttgttgtcacagacccaaactttcttttatgtcttagtcaacagcctgcccctaagtgtttgaatttgcaatgcctggaggaagtcttccatgtaattcatactttatgagggaacctttgtcttcttgtgattcttattagaaactcccaatttctcgaactctaatccaggaccttagtactcagtctggagatgggtcagggaaaatgagaaaaccattattttacaagggttcattgttcatcctttattctgccagccattcaacaagtatttaatgaataccttctacattctagtaaatgctgggaacatgtccatgaacattaaacaaacgcacaaataattacttaataaacagttaaatatacaaaagaaagtacagaatgttttgaaaattatgaaaattcttcccatagcactatctttatttccctatcaccatagttgccaaagtgcccccacctgacattcttttaggtttgccagatgaccaagccctacattcccacagctatgtcagcaacatactcaagatcatcctttagacattgcattcccctcccctcccctcccatcctctcccctcctctcccctcttctcccctcctctcctctcctctcctcctctctttcttgagacagggtcttgctctgtcacccaggctgcagtacagtgattcaatcctggctcactccaacttctgcctcctgggctcagatccttccacctcagcctcctgagtagctgggatcacagttgcatgccacagtgcctggctaatttttttttctcttttgtagagatggggtttcaccatgttgcccagctggtctagatctcctaggctcaagcaattcaccctcctcggcctcttaaagtgctgggattacaggcatcagccactacttctggcctgtgtttttcttttttaaagataagacctaaagaggattttgactattttgaaaatatattcatatctgtgtatttttggttattcacttccaggtcctaaagttgcaattaaggagaaaaaaatcattgattattcttagtagttttgatgaggtaatgcaaggtttttctgtagcaaagtcagcatgcgtcgtgaatatggttaagctatgtatgattaaaggattatttatgttttatttataagtatttgctatcaataacagctcccaaaagtaagattcaccagtattactacagcatatgggacttttgctgtagattaataatgccatgatattttctttaatgaaggtggaaatgattgctttattttaacaaagggacctctatggtccccctgagtttgagccttgaatgtagacgatcagggatgctatatcacagctgtctccctgctgataatgactctccttggggtttcataatttctgcctgaaatcctttggtttcctctcaggaggcatggagtgaatttatagggagattcttcaatccagacacaaaaaaaggttttaaaattttttgtgtgtctccatatttgactttctgtctcccattctcatttcctttactttcatgtgtgtgttttcttcttactgtgccaaacacataataaatgctcagtatttgagattaatagatataatcattattattttgtgttattctttctactcctcccttataaaaaaagggattcctcccttcatcatgcttcccatgccttcatatacttcttattggtttgcagaacaggcatagttatgatggagaaagtaaagaataatgattaaaaagaataataacaaaccacataactaactgtttgggtttaaatgacagaactctcaaatccatcttcctaattaaaacagcatgctcagggatagagcacatagtaaggcttttagcttaaatggggatgtgctatcagtgctttgatatcaagtttaatgtccttaagattagctgtatgtgccttgggagagtgagatcaagggtaagatagtctggagacagatggaagcaagattcttgggcagttgaatccttctcaaactcattcttggtgagtactgtcactttctaggtgtgccttaggcaagttatttaactgcttcgtgccccagagagtggtgggggaatcaagggtaggacacatgtgagtcactcagaacagtgcctagtctttagtgaatggaacttcgggtgttcattattgttgatattgcaggtgtaaagaatttgattcacacactcctatcatggattggagggaagttgaatattggttcatatcttgttttaggttctggtttacttgctgcctgaactaggaatataattcgggatttgcagctagtaagttgaaattaagaagaactcaggcctttagattaatcaagtacatatacagtattgaaattatgtctttttatcagtatctttccagaggcccagttaggggagctcctggcatgtgcccggcatgtaaggagtgtccacaagtgtttgcagacctgcactgaacactatttctcttttgatatgatgcagtttaacatactcaaaagagttgagccttatcccctttgctcctcaaaaccaaacacagccagttttggattaacttttattcagtcatgttttatgctgtagggtccaacctaaattttctaggacgcagcccaactaactgaattctttatgtcacttgaaggataacgtcactacagttaattttgataataacatggtttgaaggattcctaactgcttgcaatttatgtaatattctcagtgctctgtgaatttgtagtctgatgaaaacactgaaaagggaggtaatgtttactatttctgattattattctgtatccctcatgcagacctaacctcaagcatttgcagccacccaatgactttttttgaaggaatttttactagtgggttcatctggggcagatgaaaatgtttgcattttagacactccaaatacagatataaaaactttatgtctcctcctccagctctaccttcaactttcttttcactttctttcctactaagagcacatatttccaggctcattcttcatccctaaactctgtccctctccttactcctttgttccgtcttttgtcctctccctggaatttctggtcatttgcattaactacacttataagtcaaactttctttgttcctttgtgggtgtactcagaacatcattacattcaagtaaattcatgtgttttttttctttttttgcccttttatttaaaagcactcctactggccattagaatagttaccagaaatctcctttggtctatggataagaaattctgcagaacttttcaaccaagtaattagatcatattatgtctaaactggtgcctttttctcaactgaatccaagtaggagtatagactgttaacaccttcaactgagtaaactgcaatctttgcaaagtgaattaatatatgaatgcttgctaaggcaagataacacatttttcaattaacaaagtaacaggagctcagggtagcatgtgatatatatatatattctgctacatacatatgcaggtatatttttcaatcaacaaaacaggagctcagggtagcagactacagatatacatgtgtgtatatgtgtatatatatatgtagcatactacatatgtatacatgtgcacatgtacatatttatctgtgtatatgtatacattatgtatatacatatataggtatatgtatacatatatgcatatgtaggtatatgtatacatatacatatataggaatcctatatatgtagtctgctacacatatatattcacatatatatacatgtatatatgtagtctgttgtcctgagctcctgttgtttgtcaattgaaaaatgtgttaccctgtcttagcaagtgtgtgtgtgtgtgtgtgtctatatatatatatatatatatatatatcctcaaaattttacctagagtaaaaaaatgaaatgcctacattacataaagacccatatgacaatattaattctgtgagctgagacatattcatgccaattctccataccttctcccccattgcccattctccagccctttgttgttcactggtcctaactctgctttcttactacaatggcccacttactgcatccttagtttttgacattttgaaatcacaaggttctcatattaagcatggacattttctttacttttttattaattacaaccacagaacttctctcgtcccactccttcttgttttgtctttgggtaaaaggaataaattatatatttatcataaattttaactctacaaaatggccatatttatactttcttcagatttctctcagttctagttaaggtttttttttggcttccatttgccccttatttgattattatactccaagtggctgaagaaaaaatacattcaatataatctgtctgtaattttcatgtcttcctcattaccgtaaaatataatgcttatttgagacacacacacacgcacacacacacgtgcatactcttggcctagatcaaccacacagattcatttattttaccttctcattaattagaccctcaagcctcttaatgttgttttaacactaatttgttgagttctttctggcaccaaactaccccaaactccatgaagaactgaatcatcaatgtattatttataggggcttctttcgtgtgttcgtttaaaatgtagttatctaattaatttattaatttatattgtcaataactattcccagaaggttttttttttttcagatctactagagaacttaaagctttttcttttccaggaatggccaaaatatccagaaggacaatatcaagtaataattaaagttataagctcttggtttgaattcttgctccactagttatgtgaccttgagcaaattacttaacttctctgtgccttacttttgccatttgtgaagtggaaactaaatagcctttatgtcccagtaacaatgcaaagtttattcattgccgattagaaggggcacactgttcaagatgctcattaattcattcactcattttatgtaatgactcatttatcaatcctttgttgagtctcaaccactgtcctaggtaatgctgatacaatcttatgttttgaagctcgccacaaaatttgatcaccactagagccaagatttaacacattatttcatttaatagctattttgagtcttcagggtacaatttacagttttgggggggaagatgtagggaaatatgactcgtcagactcaattaagtgcatttactcagggctacccatctattaagtggcatggttctctaaccccatagttcattctctttttctgtgcaccactagtaggttttgcataaggtaattttgtccaagtggttactgtgtgggtcctgttcacaatcttgatcatgattgtattccaacttctatgtcagagtttgcaagcatgtggcttataaactcaagatggctggtacaatgttgttcaatatttaatggaggggtattaccaagatctagttttctaggttttcttgagaaattagaaaatctggcaacactaagtttgtaataataccagggacaactagccaaactgccctattttgttgaatcatgtgctgtctaagtcctcacagtccttgccacccccaaccctgcaatcatcctacatgtagtgtttctatttatcattgtatttttgcttttatatctcttacatcttgtcacattgtatagcctgtctagcatttgaatttttgactcctgttttaagctagagatatgcttgtcactgaacacgacttgaataaggaaatgagtaataattatgactctacatgccctttatagtacacaaagaactttttaaacaaccatgttatactgctactttgattttacagtagtttgctccaaatgagtcaaatggtatgtagtagagtcataattagaatccagaacaattggtgtaagtctagtgcttttctcatttatctgtcattcattcatttattgacatatttattcaacaagtaaacaattataagtaaatgtcaaatatattctagaccgtatagtggatgctagagatatagatgtgactaagatacagtcccaggctttaagaagctcatagtctatttaggaatgacagataaacggatttttctgagtgcattgtgatgtgaactgagaaatacacagggtatgtacaaggtgccatgttaacatcaaatggcatgtgattgattttatctgtgactcagacatacctctgccactgtagggagtagtataattgacatgggatcctggccagtctccttatggtgatggtggttaatctacatgtccctgagtatcatggtctttacagaagcaggagagtgaaatgtaaaaagtgctggaatggaaatcagggcaccaagtatatatggtcctggctctgacatttgcttgctccttgacgttagaaaaatcgttgaatttatgtgtgcctaaatatcttcaccaaaaaataaggaggcataagaggggagataccagatcttacaaaataagtaggttttatttacaaatacttatggattagtgggggccctttcactaggctacaaagaatttgaggctctatctatgcttagttttaaagaatgctatggtcaaagaagctatgtttgtcataggcactagaggaagggatagaaagattctgagatctaggggcaaaagggattttgagagtgcaagtgaattaaaaagctaggatcagctggctcagtggctcacgcctgtaatcccagcactttgggaggctgaggtgggtggatcatttgagttcaggagtttgagaccagcctggccaacatgatgaaaccccatctactaaaaaaaaaatacaaaaaagtagccaggggtggtgacctgtaatcccaatcccagctactagggaggctaaggcaatagaatcgcttgaacccaggtggcggaggttgtaatgagccgagatcacaccactgcactccagcctgggtgacagagcaagactctgtctcaaaaaaaaaaaaaaaaaaaaaaaaaggctgagatcaagtttctgctgcaaggacattttcattagttaaaataagaaggggctaataccaataaaatgcatagcaagttgactattcaaaccaaaaggcctccagttgaagttgtgttttaatttaagcactagtagggcccagcaaatcaaatattgaaagatgctaaaattagtctgattactttgtgagtcatcaaattgatttgactgtccttgcccttcatataatgtcccaatagacacttaacctgactctacttccttgaatttggcaaagtaagcacgatcattggagttactgcttttgggattatttatttatcacatcacctctgccatcattacttcccactcgtctttgtttggcttactttctactgtgcttctctctatcaaatctttgcacctccttaggaagatctggaagtcacctctctgtaaatctgagaagttattttcattgttgttggatgataatgcttaagccagtgttggaggctgcacaagtaaattacatggttttagaagcacctcctccttccatctgtgctgtttggttgtattctttattggatctgggatgatatgacttctttgcctggggctgttgctgccattacgcagttttggattcactgttgcttcataccaatgttggtgctgtaaatgtacatgataagagttccacagtgagatggactacaagacttctggacccagagccccctaaaactagatccaagaccagattatgcactgctactgaggttggcctgctatggtacagactgctcctccttccccaaggatacaggcacttttacatagagggtacaacagatcttgacctgcaggtgttcaaaaatcgactcataacttccctcctcttatatctatcttatcagtaaacaaatattaataagtcataggaatgaaacatgcgactctttttggttttgttggagtgatcatgccagaactgggactttctaatcttgaattcaaatcatgagagttaagcctgtcatgaactgtgagtgcaagctgacccaggaaccatgtggttctcaaaaaaaaaaaaaaaaaaaaaagcttatggctctttttgtgccacaatggcagaattgagtcattgctacaggcagtgcatggcctgcaaaacctgtgatattattctctgctctgatattaacatagctggaatgtgccccaaatgtatttcaatcaagagctttcatgtattttttgaaataacctggataagaaaatccagattttagactcaccattctgcgggggagtgggggcggcagggggtcattgatcctgtttgttttctctcttgcatgctgtccttggagatcagaggattgatgtttgagtaagaaatgcagaataggaccatatgttaggcagggttatagacagtaaagcaggtcagcatcctataacttgatgactcaatcatcctaacattatgccatctgggcgctgatactgttcagctctcccttttcttatgaaaagtttgactcaggtcaaatagggtgtctttttttgtttccttagaattttgttttctcttccttttagggattagttcttttagtcccacctttgagataaattttataatttcaaattttgaattctgatctaaaccctcaactgttctttctcccacagtaaagaagttaaagcaatcgtagcaaaaaatgtagagagtatttctttccccatccccaactttactgagatataattgacgaataatatcatatgtattcagggagtacaacataatgtttgatgtatatatacattgtaaaatgattaccacaatcaagctaattaacatatccatcacctcacatagctaccgtgtgtgtgtgtttgtgtgtgttaagaatatttcaggttcactcttagcacattttaagtatacaatacattatcattaactgtagtctccatactctatattaggtctccagaatgtattcatcttataacctaagtttgtactatttgacccacacctccccatttcccctatttcctgacccctggtaaccacacttctactctctgtttctatacattcaacttttttagattcaatatataagtgagatcatgcagtatttgtatttctgtttctagattattttactctgcataatgtcctctaggtttatccatgtttttgcaaatatcagaatacccttctttgtcacaggatgaataatatttctatatatatgtgtgtttatacatgcatacatatctctctcacacattttctttgtccattcatctgcacggacactcaggttgatataatgtcttggcttttgtgaataatgctgcaatgaatgtaagagtgcagatatctattcaaggtactgatttcacattttttggatacataattggtcctccatatccatggattttacatttatgaattcaaccaactgtggatcaaaaatatttgaaaaaaatgtgtctgtactaaacatgtacagtttttttcttgtcattattccctaaacgatacagtgtaacaactatttacttagcatttacattgtattaggaacttaagtatcttaaagatgatttaaagtatatggaaagatatgcttaggttttatgcaaatctgatgtcatttcatgggagggtcttgaacatctgaagatttttgtgtctgtgggaggtcctgaaaccaacccctgtggatactgaaggataactgttactcaaaagagggattgctggatcatataaagttattttcttaatgcattcatgtatgcactagtgtgtgtatgcctctatacacccatgcctgtcactctatgacctgttgtcatatctgtacattcatgtaacaatcgccatgtttaagaaatgtagcattgagcctatgtcttaactgatgtatcctgtttcaatctatcttgaagtggccaatcaccctatccccaaagatactgctactcaaagcatggtccctgaaccatctaggaacttattacaaatgcagaaccagagaactcatgcctgatatactgaattggaatctgcatttaacagatttcttggtgactcatatacatgttaaaggttgtgaacactgttctaagaaatgtcttcacttcttattcctttggcttgcagtgattaattgggtagaggaggcagcatatcagaatcattatgaagcttaaaataaagtgtgcctgggttttagacccaagattaaatctgaagcgaaaccaaatgtctgtattttttaatgattccaaaggcaatcctgatgtacccaacacagggcaagggtatatattgcaaggagtcacagaatctttttattcttttcttttaaacctcctggcaaccttctcttttgctgcctggtcaacaaagattatctaatgtggttgatcagcttttcactgtcccgttcattcttatgacaatttgccctaactatgcacaaactgagaactctttttaagggtaaataaatgttctcattcatcctcacaattgatttaaaatattgtaacattttctaaatatgtacaaacagaaagctatctcatagttcttgtatgaccagaaagttattgaaattttacaaatcaaatgcaaacaataccatgtaaatgaagaacattaacgtggcagatgacattttcctgagaataaagctctacttgcaacataaatacaacacaattgctatattttaggttctttagaatttggcacattttactgctgtatgccttgtgatttctcagttctgttattatttgtctctgtttgaacccatgcaaaaccttcatccacacagcttagactgtcattcagccctctctttctgcaaataaatctaatatatgtctatagtcagcccacttttcttctatgcagatttcattaatgaaagtagtaattcttgtcagtgtgattgcaagcacaaactcaaagataacattacatggcagtccttggttggcaattgaatggtcagtattcagttgaaaggtcatcaaccagaaatatggttagccattttttagaagaaaacaaattagaaaaaagtatggataacaactttggacaccaaagaatatttctataatatttcctgctcagtctgtagtggaaggcagtagagaatagaacttacaaacatagccttggagtgagaaagatctggaaactatttatgatagttctacttactagatgcatctcttggaacaagattcttcgcttctctgtaacttggtttcctcgtgtgtatgatggagatgattattatctatttcataggccaggaataggtatgatatgcaagaagcacctgtggccctatcttagcacatcataaggactaagttatcaggagctattttaactattataatgatgttatcattgttgcatctttattataaatgtgaacattaagtttttattaattaaacctgccacatatttcttccatttgcttcattgtactcttaagatgtttattcatttttctcacttcttgctttaagaacctggttattacagaggtgaaaaatcccatcaaaatgctagagaatttggcacaattattgcttatatttctcctattgctgcttttactgctgtagctgcctcctgaactgctgctgctgctaccatggcttctagatgcttctttgacaatttatttattttccagtggaacccatctgtgaagaagcccttcatagcagtaatatcctggggctgggcactactacaataatgatgctttcgttaatcaccccatgtaattttagtttttgctgataaatactacaataaatcgattgaaactgatgaaaatagctcaaaatttagagacatacagtatttcattttaccatcagcgtatttctatgtttatgcaatagggattgaaaaagttcaatccccatgctcaaaaacacatacttccagctctctgagatgatatgccagacagggcttttgattagaagccttatttttttgcctagttctagcttctgtatgagtggagactttattaacaaaggtaggtttggagcactcaacagaagcgtagagaatatatggaaaaaaaaaaagaagaagaaaaaagataaaagggaaccaaacaaaacaggtttacaactgttttactaataagagggaaaagtctgctcatgagttaaaccaagactaaagataaagaaagaaagaacatccaaaaccttcatgtgctttgtatttgtacatttctgacatatgcatgaagcatgagggaaatacagtaatacactgaggtatgctgccaacatcctgactattcctagtcattagatagcctagtgatgtttttcagttagaggggtgctgaccttactgttttcagtaattataagtctataattaccttttatattctttaagtgtatttttgtaatttcaggttaggtatacaagagtggaaaccgtgtttgatctgacgttttggctcttgtatgaggcagctttaaatagctgtcagatttggtttcattttagtgaagggttaagtaattttaaggcgttaaaaccatgggcaataaataaccatccacagtcatcgaaggaagttgcttcttagacaagagaatgaagctagagctgctagggacattagtctgataaaaagtcacatcagagaaggtttacctccaaatgattttggtggcaaagaagcctgtgcatcaacacctgcccttgagcacagcagtcaataaaaataaggtaacacaaagcagctctcttgaaaacaaaatcagagcctatactcttaagaagttcatagccgtcacaaaaggaccctcgtggcagtagaagctaaatggccaagaatgctggaaatggggctgcaagtcataaatggagaaagtctaaactaagagggtaaacagcaggtgacagtaaattggagcacttggccaggcaagccctgcatctgccacagtgagatcagttactggagagtcatcccaggcctatttcacactgccgtctgggaatgtgggactctaggttcttaagtgttaactatgggcaaaaaagaaacaagaagtataaagtcattgagaagattgtctgcagtagggcaggcatggatgaaaatcgaactctactttgtctgtgggtgaattatttaccttctatctgtcctgggtctgtaaaacagttataagaatagacagggttaatttgtgaaacttagatgaatatgaagtatgagtaaagtaccagacatttagaaatgctcatcaacatcttgaaagaagttctttcattgagataaaaagggtctttgtatctctttctgtaattcttctgaaaacagatggtcagggtagagagctggtgcaatagctcaaatggtaaatgacagacataagattcaaaagaagctcaataggaagaatgatcctaagacaaaatggatgaattgcaatagggttacataaaccatttccttaggtttagaaaagtcgttattccatttctaggtaggagagattccactgaaataatgtttctgtgctaaaaatgcaaaagccaatttataacttttaaaattataaattgaataagtgcaaagagtgtgatatggctgctagatattggtagaaaaccatccttctcatttgtgcccttattagatgtcatcaagagtcttgtgtgcctcctgctgccacatttaaagaggggagagagagagagaaagggaggggagagaaggatgaaagagagagagaaagacagaaagtgaggcatgtccagtatggtgaaatcagctgtaatcaattccagctcaaccactatgagtccttggacaagttacctcattgacaaaatgaggatggaagctccctccctggcttgacctaaggattggattacataatgcaagtaaacaactctgcacagtacctggctcataactgggagctctgattattcacaggaaagagtggtgagagacagctatgagataaggagctgcagaagctctcggtgatctgccaatataagagaagcttaaggcaggacatgacaactgtcatcaattatttagatacctgttatgtagagaagcaattctcattaatcagcctaactctaaaggaaagaaccaggaccagtagatagaagttatgggaagagatattttggctccataacagaagtaatgaaagcagtagtggtgtagtagtaggaactgagaatgcaaatagctcttggagtgttccagttcctgttctaaggactctgcattcttatttgatcctcagaacatctatgtgaggtaggtataattattattattttcattttacagatgaagaaactgaggtacacagtgaagtaaatttccaagaacatgtaaaatagaaatgaatgacagagctggaatttgagcccaggcattctgtctcttaacccatttatgctggaggttgtgattttttaaactgatgtatgacagaaaaatcagaccttggcaaatatcttgagcagtaggctataaataactcccacatgcttagtgttccaataatggaacactaggcataagtggctacacacattatctcaactgccccaaaaagtagctcaaatacacagggaaaggctgagtgactgtacaccatggttgctagtaaggggattcctgcactgagttaggaattggcctggataatctctacggtccctcccatgacatgtctgtcattttataaaaccaaaaagcaagcaaaaaacacatggtggcaaaagctaatacaaaacctagagtcaaacattcatgaggttttctcaatgcaaaagaagcctaaaatattcacctgtaatctatttatatcaaccttatactcagttataaaaggatggccatcttattgtcttgttcaaggcagagcagaagaaatacatttgaatctgggagtggtagtagaactaatagcagcaaggagagactcatgaatctttaggagaaaaaggaggtgttaacgcactgaacaaatattaactgagtgcctcttctgggctgagataagaaaatcattgtgaaaccaaataagaacaagcattgcaggccccagatatttagagactccagtgacgtttgggcttttcctgaactttagtgtgcaatgtcattttaaaaagtattttaggggaaatgataaattatagccagtttcataaaagaggtatacattatatttttaaaagactttatatgaactgaatcatttgactttaagtttgggtgtaaaaagggtatacttcaatttctctcaggccagcttgctccccagtaaatgacaaatatgggtctcgccgcactaagatattttaatatacttcagtgggaaaggctctgatccagaaatttgcagttgtgctattgataaaatttatgagaaactttcttctgtgggcctcagttttcacatctattaaatgtgctgatttaactaaactatctttatttcctttaggctcagacatttcctatttcttttatttctataactgtacttattttcattatgtagataccagatggcaaaatgtcctggtagtgtgtgcaggactcaaactgattctgggaaaatggggcacaagtgaattctaaggtataaggagctgaagtgagcagaagcctctagaatctatttctatttctgtcagctacagaatgtaggcccagtttaatattaggagacgttgtctagcttttaatattaggtttcagagttgcctaacaaaacccatagaggttgtttcttgcttagagtaatttaatgttataaggatcaggcaggtgcaacatggcataaaagtattacttgccccaatgccacctttaatttctctcaatctttcaaagcatcaaaagaaaaaaaagttctctctttgtctattgtttataaatataatttattctctgtgcttaggtgattttcatagataagaggacattcattgtattcagtaaaacttctagagcagtccttacactagtaacaagtttcctgggcaatactgctttgttatcagacttcaccatgtagatctcacatccttctcttttctgatcttgctcttatcatttcaaagttacatgtagagtgaggatgcaggtttcatagggtttttgtttttatctgagacagagtcttgctttgtcacccaggctggaatgcagtagtgtgagcatggctcactgtagcctcgacattctgggctcaagtgatctcctgcctcagcctcccaagtagctgggaccacagatacatgccaccacccccagcaattttttttttgtcttttttgtagagatggaggtctcaccatgttgcctaggctgggcttgaactcctgggctcaagcattcctccctcctcagcctcccaaagtgtaggattacaggcatgagccaccaggcccagcccatggtgttttctgacaaagctactccattcatttgctgtttgaagttgattagtgaaccacattttgatgttcactaccttcatttgcttttatattcaactgcattctttaagaatcttccctcagcagttagaaggccaaagataatttaaatgggattgagggatatttccctctcacattagtgctgtagagccacataagaaggtattctatggtagaaatagatttagaaaggtcaaatttgaaaaataaagtaagtccagacccgagtgataagatggatggctgtctagattgagcatgcaattctaatacttcagttccacattcttttttttttttttttttttgagacggaatcttgctctgtcacccaggctggaatgcagtggcacaatctcggctcactgcaacctccgcctcccaggttcaagcaattctcctgcctcagcctcccgagtagctgggactacaggcgccctccaccatgcccggctaatttttgtatttttagtagagacggggtttcaccatattggccaggctggtctcgaactcctgatcttgtgatccacccgccttggcctctcaaagtgctgggattacaggcatgggtcaccgcgcccggcctagtcacacattcttaaagatgtttcagcttttgatttttaaacagaatggtatggagaagggcttttgctggaggtgcttcagtcagttagcttcaactctgaatgaacaccgaagatgtcttggctttcctaaagactcaggctacagattcttgctcatggccaggggtaaaatgcccttcatccaatttaatgctctcccatgtgtagcaaacatatcaactactctgggttggcatatgggggttttagtaaaactgtgtaaagaatttgccatagaaataggaatagtctttcactttccattttgtactctgggtcttctctgattatatatctcttttggttttcctttccaagctccatctttatcccaacctattgggtatacatctgatcactgctttgctaacacgataatacttgagactaattaacaataccttagtgatactgcattctcaaataggaaaatttcaaatgactagaagaagactagttgatgcctaggaccagtactagaatggttaagttactggttggaaacttcagtgtgcttgtttctgcaggaggagaactgctttaatgtgaattgcattagaaagctcccctccacttttccttccccagtgtttgtctactgaatagcagggtgaaagcgtcggttgctctcatcgcctcacaatcaggccaattgggcataactgctttctggtagaattcatctcataataaattgcattcatggaagatgcctagtatgtggtaaacatggcatggacaggccaatactagagaaagatagaacactggctcagaggagacacaaacaaattgcctttctgctggctctgaaatattctttttcagtgtagttaaatataaagttgaaatgatgctaactacaccttgatccaaacaacctcttcattgcttggcttctgatgggaatgctgtaggtagccatttgttttaatgattgatttcactaatactgagtcacaattgcactcctcttgaagttgacataagatctccatgcacagaaaatgaattcattagaatcaaagtgattgtataagaaactcaaattatccaggtgttgaaatgcatgtctactttcttttcagacaatggaatcatttataaaacatatagttatttaaaacacagacacacatacagagactatcatatgggattgtgagagattgctaattaacacatacaaattaagacaaatattcattaaaacaaatattaattcctcaaagtttaattcttaacaaatattaattctacaaagagctaaaaggctctatgtaggtagataacggcattcagatttacctcctaatctttacagtaattggttttaagggttggagaaagaagtaaaggaggtaaaagaatgtacatagacaataataattatgaataacatttactaagcatctactatgtgttaggtactttgctaaccaagcttagcatttcacatatattatttaaaattcacattaactacctgaattacattcaattattttactcttcagggagatttgtataagttgtgtaaggtctaaaactgttaacaggaaagctgggagttgaactcaagtttctctagttcctgagccaagatcttagttgctaagttattaccacattctcagagcctctgaagcaataccactgaattcagggcttatgtttattctagcagcatctttctttacaaaggggtatgtaaaaatagtagtccttctaatttctcctccctccccccaatatttctgggattatgcaggcgatactttgcttttggaaagaatgaaatataggcaattgacagaggcagggtcctgactttcttttttaattttttttccttgatgatgagcataatcatgtgaataattaagcttcaagagctaaatgactgattggcagcaagctgactaactgttctttatttataaggatatagctttcatgggaaaatgtagggtggttggtaaaacatcagaagtctcccttgagatttcataaatgccatagcttaggggttaaactcacagacatttaagtcacatgttcttgagttcaagtccaagttgctggccctttgggacttttaactcccctatgatcgattgctataaattaaaactcagttaatagaatataatgtaagtagttatatatcggaaccaatgatagtacctacttcttagggttgtcaagagcatccagagagctaagttatacaaaggactagctcgatcactggcatgggataaatatttgataaatgtggtttgtaatattttataaaagtgacaaaaattcttatttatgtaccttttttactatgaggagaatcaggttggattcttagaaaaccttcagtgcctctgtcacagccttgcaaagactacttgggatatgtttatgttgataatttctccccttttatttttctatcagtcagatttataataagaatcagctgttctttctaaaagactattgtgcctttatattattttctttaattttcaataatcctatgaattagcaattattatcctcatttttacaaatgaggaaactagagatccgaaaagtaaacagcctcccagctaataaacagatgagctgcaataccaaccgaggtcttctgtctctcacaatccagttctaatattaaaacaaaaggctttgagaccatatgacccaaggtgcaatctgtttttcagatcagaagattgggactctaagatagaaacacggtctgtccagagtcacatagcaagttggagacagaatggacactagaccctaggcctctatttctggtctagagctctttcatcatttccaggctacttgtttgtttgcagcaatttgtatgttctgtagaggaagattgaaaagagaaatggatagaaagagagagcagagatgaggggatgagagtctggagagaaggggagagagagagagagagagagaaatagattcatatatgaaggttagatcaagggccagcatccaagggtggtctaggtagagtactgggaaccaatctcaacctggcaggagaggcataattaaccagtgtctacatctgtgatattatttgtccttgctccaaaatgacaatagtgattacagtagatgcagctgacagtagcagatgacacaacctcctttcacctcctggccagctgcagcgctaccatcaccagctatagcagctttctccctggagattcagctttttctccactgatggaaggctttccctccatcactccaatgtcagagcttggccgatttggttcctcaggagactgtagagaaattcactcccattgaagcattttcttgacattttgacattcaatcagagaaaggcaaaaggcaggctaagggcccaatcatcaggtccatgaagatcaagctatgttttctgagtacctattgatagaatgtgcaggagattattactgtttgccaaagctctattgatcttggctttgtgaagctcaaagtctgtttacagccacctataaaaaccaacagccacttcttttactgaaggttaacgtgctgtgtttatttaattgaatggaaatggccttgtgttttccaaatgtcattgttaataaattttcaagggaatctgtgactagtgtgtaggtgttgaggatgggagaagggactgtcatggggagggacggctgttggaatttgaagttgctggaagcaagagataaaagacaaacacatagatacgacattggaataatttccctgtatagaagtgctataaaatatccttactctatattagtgttgttttttaaacttgtcagtaagaattctcccctgggtgttttattctttagcctgcgtctgtttttgtttgttcttttgggtttccaaaaaatatatattttaaagtgacattgagcattttagtataattgtgagttttggggttgaatatttttcactattatttgatcagttttttccttctgtaagagatttaacagaaatggctaaaattaggagccatattagatagaggaagatattggcaatcctattgacctgctttttaagaggcgtgtttcaactaacaggaggagagatgcaaagagctttcaccaaagcaatcagaagacctgtaaacagcctcagggaactgtaaaagtctgtgagggtctctagtgtaccagatgaaaagcagaaactttaggtagccgtctgaatgtgtcaaatgggaatatcagaataactcactaaatttcctttttcaactttcctcgcaaggtttgtctttttatgtggtaaatgttggtgagttccatttttaagttttactcttcccattctacttcagtctccttagcaaacacacacacaaacacacacacacacaaacacacacaacacacacaaaattgttcttcttgaaagatacatgtaaatgaatggtgagtaaaaaattaaagtctggacgcagtggctcacgcctgtaatcccagcactttgggaggccaaggtgggtgactcacttcaggtcgggtcactcacttgagaccaggagttcgagaccagcctggccaacatggtgaaaccccatctctactaaaaatacaaaaattggtcgggagtggtggcatgtgcctgtaatcccggctactcaggaggctgaggcaggagaattgcttgaaccctggagttggaggttgaagagagctgagatcgcaccactgcactccagcctggcgacagagcgagactccatctcaaaaaaaaaaaaaaaaattaaaaacttattgtctcaaagcagccattcatttattcaaggaattgctaaacttttctaagggaccaggcactggcctgagtgctacatcgagagagagtaataagatcgaggatcccattcccacgttctgcacgtgtgtgtgtgcgtgtgtgtgtgtgtttcgatctgtgtgtgttggtgggtgaatggctatgcaaatacataacaatttaataagtcttatgatactgggagtacctgactctgattagggggcactgctttaatatctggcaatggaggatatatccatcttcattcgctccttcatgcccccatctaaccttgattaaagtctgatttcaaatagcccatttgttgaacattttatcaaggtttttcaggagcctgacagaaaatgtaaagtcgtcgtatgttttgttttgggaaatactacttctaaaacttatttgagtgtctcagctttttctttcttttattttattttttaattaaaaaaataatattatcttttatttgtctttaagagacagaaccatgtctgcctagtaccttcacttggtcaaatacctcttttggtggaaacaacacaaattatgtaggttgtatatacaggatgaactcggtttaaagataagacatgaaattcagtggaaatattctttaaattctaaacagagaaatcaaaacaaaggtatattcatactgcatgtgggtataagttttttcttacatatattatatatacatatataagtgtaacacttttaagaattttattgaccatctaaatatatagcaaaatcagctgggggtacaagagtgtaactacttccttttttcctaagttgtggaaaatgtgagaaatgagaagtaagcaagacggaggattagaatcacaaggtaggtttccctagtatgaattcagtacctgaaaatcttcttagttctgagtttgaagcagattctataaaatcctgtattaaaataaatacagtaggaattagcaaggatgggggaataggagtgggcagatatgttcttgaagagaataaatgcagaacattattctttgtcaattaatttttactttttatagattgttagactatttaacaaattcttatgagaaaagtgtgtttttaagtgatctctgggaagatgttcctgataataaattaaattaggactgtgcattgcggagcccccaccagttgtactccctctggtgaatttaataccagacgcaacctagttagaggtgacatgaaatcacagaatttgataatcttttttttcaaagttaagcaaatatagatgagctcttcttgtatatgtaagatgccagatggtgtttttgagaaatcgattcgtgtatagtaccagtccagacaaatgggtccaatccttctatagataaggcgacccacttttcctattcaaccatagggctccgttgtctggcacacattatttaacaaagtgacattgtggagtcatcagtaagaatgtggcttctggagtgaatttctttttgagtttgaatcctttgctgggtgatcctggccaaatttcttaacctgtttgaacattagtttcctcgtctctaaaatgtgagtaacaagagtttctcgtaggaactatgtaaaggtaaaaagaaactgtctagcatagtgcctggcacataatataatttcataaagtgtaactcttgttattaaactggatagctcaatagatattgctccagaaacactagtgcatgaggctgccattacgatcgccaaatgatagcagctgtgaactgccactccaagccctttgcagatgcatgtacttcttcgcaagggcttctagtcattgacttacccagatctatcgtcacctcttgaagaaacaaccagaaaacactttccctacttacagtgaaataagtgagtatccttctacagaaggacagttagttcttgaaccaagggacttcaatgccatatgagaaaaattgtcttgtatacaatatctttggagagtgaaagagttttaagcatcttgatattagaaattaaggctacaatgcattcaggttgcctataagttattcatttctgtatcttgttgtcaggaaaaaaaaaaagaatacttcaaaattaagttttttccatctaggatctcagatctcattgtataattttcatcattcaactggatttaataggtctatcagtatgtacagtaaattattttcaaaattcttcacctaatagctaaaaagtaagccctaatctggttttctgtgaaattgtcctcgacagaataaatagttcaggtgtctgaaaagaaaaattccatattcctatatctgggttgacacttaagactgcgtttgtgaagcctccttatatcttgaagacaggatgtatctatcttgctggtgagaattttgctgttctggagtctatatcaggtacctcaaacgtgatgagtgatagaggtcatgttttgttgtatcacagtttgttgaatctccctccttagagattcatttgactgaaaaattaacaggtttatttgtgcaaatggtagttgcacacccaattattgcttctgggtttcccatgtgactagccaagactcaaggtgaaagtttggcctgcagctttggcaaacaaaggagaagctaatgaatcataaaggtcacatcttcttgaattttcttctctttcttcactgttctgattacttttaaaaaatctctattccttatatattctgagtacaaaaactcattagcaagatttggttctgttgtctggagaattttctgctcactgcaataggaaggtgatccaggtaccacataactgtctccatgaagatgtttgcaatatgttatgagttttttaaagttattgtttgagaaaaggccatataaggagataatttttgcttattactaattagcttacccctcttctgctgttcttacatttatgactatttacttgtaaataaaagttattgatctttttagaagtccattggattctgctgcttttatttttgagaatcattttaacttacaaacacatattaccttttccaaaaagtgaccacatagctttgtgactcctccctcatatattttgagcacacagaaattaccatcctctcactgagtactatacatcggggcctctggctcttacctcctttctcagatccaggactgaatgcatagctgaaaagatgactttagtctttattcacaacctgtaaactaaagaaggtcattaaaaaaaattcttcgtatcttgcaaacaaaagaactgagatacctatctaagaatggcaagtctgagaagcaaatacctggctctagccctctgccataagtttgcaagcttgtgtagacctttgtctgagaattggttaggtatagaaatacacttcagcagagacttgacctatatgactttcaaatttgttatgattctacaattagtgtttgctaaaatcaaaactgtagaatatagtatagagagtatattaattgttggctctatgctgacccaaaatgaagtcttttaagagattagagtactacactgtctacatttaaccaggtgtcatataacaattaatgaaaattcaatgttttatacttagaatttttaagtaataacagatgatggatcaagattaaaactgtattgacagcctaagcaaagaaataaaatctaacaaaagaagctttaaaagaaatgaatgtaaaatcctatattttgattaaataaatcaagtttgcaagtaccaggtataggagttttggactgacagaactttacactaaacaagatgtaaaagttttagttgtacataaatttaaaatgaacctgccttactgtttcttttaaaaaaattaagaaaaaaaaactctacgcagtattaagttctattaatagacttctaatttattactaaattatgttgactcttcatctgaaatgtatctatctttttactccattaatttctcttcagtgatctagtcacagaccttattatcctttacatgacagtagcttaataatggtatccttgcttttctccctactacagtctgtcctctgcatgtagccaatgttatacttgatgacttaaatctgatcatatcattcccaagtaaataagccaacaatggtcctcaataattaccgaattaattattccctgagaaatggggcccctcagtgtaatatctcatctcaatcattttttttagttttgcagatagcacctgccatttctaaatatgtgtctttaattcatcttaaccacttcggattatgacatcctaaaattgccatatatttttatatttccatacttttgctcaggatcttctttggttaaaataatctttcctacttcacctttgaccaaccactgccagtgatccatgagattcaaatgtcttctcatttggaaggactgcctgataacctgctacctcagcttcaggagaaaccagttgctggcctctgtgctgttctcctacctctaaacagaatgtaaagtactattattttctcttcaattgacaaggcgcttctatgattgttcccatcttctgttggtattatttttaataaaaagatctcatatattgtgttaaagtactaaccttgagaagacccccagtctgaaagaagaatatttcacttctcccttccccattttcaatcacacatattattgaataattttggttaacatccttaatattctaaagtatcttgaaacagttattttttctattttcagaaataaggttttagtgataatactgaaaattctaaactgtgagcttttgtttcagggatagaaatttaaaaaatcatgaggtcttctgtcatgattttgaatgtttaatctactttgtccagtgggcttctgaatcttttgtgattggcacgtgttactgagatgcagacacatgcaattctggtgaccgagttctcaagctacagtttattatttcacactgcagtaaatgtatggactgagggtgaggggactgtcagaagatgtgtgtcttgggtgcctgaataatgcttcttttgctattcactttcatcttaatttagagtcatatatttcttgttaccttttggttttccccggcacctaacaatgtaatcttcacaaagcagtgctacattctaaatttatagtgcagtaaatgaaagaggttggatccattgtgcttcataattcagagggaagaatgtctgcagaaagaaacgtgggtattctttggaatgccatatgtgcaataattgaaacattttgaggaatttccaatttacctcttaggaggaattcaggtttttgttctttttgaaaagaagatgattgttacagacttgggaaatcctaaaagaaaaaagaaggactgttgggacatcctggttgttcttgacccccgcaagaacagctacagttctttcagatcacagcacttgaagtcagaagcctaagtgggtgtccagagaattcaatgccgaaaggttttgcccctcttaactctcctgaccactagcattctctctaccttagtgtgtgggtaggtctttgttatgtctccagactcacactagttttttaaaaaaaatacttaggtaaatagcagtgggaccccaattctctttttcttgtattccagatgaaaaagaaaaaaactcaccagtttaaagtgctcgtttcatatgttcacgatatctaatagatgttaaattttggtaccaggaagtgagagagtgatatgaaggaactagtgaaataagattttaatacctggcaacatttcatagatgataacactggtccacttgaacacttgccattttttattcattatatctggtctagatgggtctagctaaaactttattccgtgcaacacagctcttgcctatttagaagcctttaactgtgtgtttaattatcacctggagtggttcttttgcagagaaaacatagaacgtaggatccagtctttcacaatgcaaaagttgaacctctgtcacctggcatgcttgaggaaatttcagaagctttgtcctcaccttagacccactgaataaggtcactaaggaatggcacccaggaatctacattttacaacctctccatttaatacatatgcttgctagaggttaagcaacactgtgggctcacctgtagcacgtagcactaatcagacaagactcaatatctggccagacttttagatgataatcacaagaagcaataacatttttctgaaacaaaacaagtggcaaatgatactgtgaaatctctggcactggttacccaatatccacacataccccacttagctctagattagaaaataaagaatgagattcagcccagaggcagccatgcgcacaggtgcacaatttggaaaaaatgagaccaattcttaaaaaaaaaatcaagctgaagtcaaagaagcttaataaaaatgtaaatcctctttcaactggctccatgttttctgtctcttcatgaacacctgccacctggtgaataatgtcaaggcctctcagagtgggtcaggaaagcaaaaaggcccatggccggaaatgctattaggcattcaaaaatgaacaatccaggtaacaaaaactcatgtcagtggtgcaggtacgatggcgtattctcttcataagaaacactatgcaaatgaatcgcaaagcgtgagagagcagaacttttcactgctgccttctgtcaagttgggaacactgaggtgaagattgagtgcaggggatttggggtggggagggtcccctgtgaaacagtttctgaatgaaagtgagggaagcaggcatgggatagaaggataatttggtctgagatgcaagtgcggctaaagcctcagccagtcccacggtgagctctgaagttaggttgtcccttctgagatgacctaaattgcataaacggatctgagtctttgtacctcccgtgcccatccaaacatccagtcaccatatgaggccacacccattgactgaatccggttctggagagggactgaggtttggtgcaagttgtccgcagccaggacttccaacatctggaggatgagcaccctaatcttgaaggctgaattcagtagcacatccactgcaactgaatatctgattcaaggccaaaaattgtggagctcagagccacaacgggcttctgatcttccacaggctgctgaatgcccctggcagtccactgaagtgataatgttaaggaaggaaatgattagaagtaatttgctgagggatcagagttgcatttggagctatcagcaagtaatgaagcaagaatgtcaatcgacaggtgaatcaaagtcagggcaaaagaaagggaggaggaaatttgctcaaaaaaaaaaaaaagccattactttcattgaggcctgggatgaggtaagtagagaaagtttgcaactgccagagattgctaaataggaaaaaatcttttgtgcacgtgttgctggtgggattgggacatgaaagatgttgtgggacagaatctcactggaaaagtcaagaatcagagctggtttcaaaaaaactcaaccttcaaataaaggatcccctatctctatattgaacctggcaatgaatacctctttcttttccttattggttggcaaggatgtagaacactaagatacacacacacacacacacacacacacacacacacacatacattctttgtttgtttgttttgagacaggatctcgctctgtcacccaggctaagtgcagtggcatgatcatagctcactgcagtcccaatctcctgagctcaggctatcctcctgccacagcctcctgaggagctgggactataggcatggaccatcacacttggctgatttttaattttttgtagagatgaggtctccctgtgttgcccaggctggtctcaaactctcggactgaagggatcctcacacctcggcctcccaaagtgctaggattacaggcacgaaccaccacacttggcaaatatttaattaaatattaaatatatctaattgtttgataaaaagggagagaggctctccttgatggaagtaataggttctggaatgcagtgagttctgctcggaatgccctctgaccactgcctccatgtgtctaatataacctatgacattacccatagaggtgccgctttttcattgggggacactgctccaaaagtgcctggaaccaggttaaaccattgaggttataaggaataaagggcctttataataaagaccatttctgtgactgtgttctgaaactgataaaaagcacttctttctgtctttggtgtcttccttgatagttgtaataagaatagtagtagttattcttctttttcttttttcttgtttgatttgtaaaataaaaacacttttcctttcctctctggtgtttgaatgcacccagtctcatttcagcagtccacaatgacatactgaaagttgtaatagagctacagctttgctgtatagaggtccatggatatgttttctaattataatcattcttgagctgtttgtaactatttcagactgcttacccagctgtatgccactggcttgtttctatttcaggaatcatctcttcctcttctcctccttccccctccattcccaaatccccacattagtagcggccaagttattttcaagtacagtgtatatgtaagtgatcttgatctgctaagaaaagacatactgtttgtttttattgggcaggcagcatcctagggaaaaggagaattacaagtctaatttggttaggaagcatcctttttcgcaacagtgaggactgcaggtaccactaaaatcattgctgttcattactaattggattaagtcctctctgttccaccaaccctgcttttaaaatttcttctctgcttttcattcagaaactgcctcagcctgcactccgttatctacctccaggctttattgcaacacctcccactgcctctctcctggaccaccttgtccacgctgcacacagttgccaaattcaactttctgtgttgcaaaccttgttgtggctccccctgtgtaaaaaccttttagtgtttctcatctccatgaatcactaatccatggtgcttagtagcatgtcaaaggcccttccgaatctatctctagcctacctctgtggaccttatctcttggctctcccacctgcccccacccacacctctaccccttgctttttgcttttcttttccccaaattctgagctgcttatacgttctttcccttcatggtgttttatacctcagcgctttcatgcatatagttcccagtgtctggaatgatcttttggataaatagtgacacttcaagaaatatctttgtcccaacttcagaaacctaattttcattgtgatgaatagctcccacagttttttccccgggctattttgcaagtattgaggattcacatgttaatcctgaaatgtgcgttctaaaaaaaaaaaaaagctccatctgagaacccattaaacctctagtttaaatacccaggcattcttaaaaatcgaatttgcattgtctttgctgcagtgtcttctcaggtaaccaatgcagccatgtcagattgatacatcatgttgttaagacccccatctgtctctagggtagtagaaaagatgcagctacggaagagaacagaactgtgctcctgaacatggcatggctgccgaacctcacagataatcctgaagcaggcaatctctgcagacttctggggtgatttgagcatgtgtagcttttgctggcagctgagagaaatgggaagtcccctgagctgaaagttgggagcactacatcctcatcaacctaaatctgccacatacaatctctgtgatcctggggaagtcactggacctctttgagtcatgctgtcctcaaatgtaaaatgagttttacatttaaatgttctaaataagttcctttagaatgtttcaattaaaaatttatccatctgtatcagataatattggtgatctcattcaatttttttagttccctttttgattatttttgtacccccaggcctcagcgtggcttctcttgcaatagccagcatggcttgttcttaagaaagttgtcctcagtctactactctattgcctctggctggaaaaactcgggtaggtgcaaggtgtccaccagcattttctcctgggatcgggctgctgccagctctggcactttgcctgggactgtagccttgtctggactcccctttccctctgcgtgggagtgcttccttatcaatcatttgccctcgaatccatgtcttaggatctgcttatgggttggactcagcccaagatattctctatctaggtatcctggttgagtttgttaataaaagttcggtttggatttagacgagacaaaccaaacttggttagggtaaatagaggaggaaggtgccttgtttcctaaattgtgtttgataaagtgcttaataagggcggcttccaaagtggttccaggtaaagaagtactaaaaaggcctctttattaatgtatggattttctgtcactgatgtttgtctgcctatgaatagtttagactagatttttcaagtaagcactttataatatctgtaactctttctaggtgttttataaacaactaactgagtagagcagcaacaacaaagagctgtaagttttctgccagtaacttctagtttttacctcctcaaaagctattttaaacaaatatgtgtctaattaaatctcaagggaatgtgaaataaaaactggaatttgagttcagagtacctgaaagagcatttttggaaaagactttgtttatgccatttgtgcatatgtagatggaatcaaaatgtataagataataagagaaaggtgccattgagcctccaagtagaagcccgatgacttcacttatgcccggctgatcacccaagtgtacagttagtcatgatttgatatctgttgtagattaagcctgttgcacacagtttctaccctgatgtttggcatgggccatgcaccatacattgaaacaagattttgaagtaaatagaaccacattttccactttctttcatgcagttattttctctgcaagatgcattctggctccttttgtgaaacctcagatttgattctacaagctgctgagaaacacagcacctgcatgccacccaccaaagagagtgtttacatagtctgttgtacatagaaagcatgtgggtgtgagtatacgtatgtgtgatgaaatggttcaattgacattgtacttacaagataaactgcatgtatcaccaaattatttgacttctctactcagaaagcattaaattttgaggtttaagtagacattaaacatttataatttaatatacatttaataaaattaatatttatgaacacatttgccttgggaattaaaagtggaaaacagtgtcatttacttgctaatggccaccacggtgccatgcagttacagatttgatggcctgcatcccagtgacattgctccaagaccagagacaagaccattttttgtttgcatggagctaagtattattttcagaaaatcaaaaccaaaaggtatgttttgcttcctagctcagggtctctggagacctgacctgccaggtatcatttgctcattttatttaaagaaaataaaataaatattcaatggagaagttaaaagtctctttccaactcaactctatatctcaaagaattattttctcattctgtcaagccatgttaaaattttcaagtaaagtcgtaatcatttctacattttctttcctgtttgtcttgcatctcttaaaatggttttaatgttagaagctacttgacaatggatgtgaaaatagatttaactcagcaatcaatatattatcaataataatcattaatttatacataaacatcacatgggtagctttccaagtccatcctgttttttgtgggctcttatgctggttcagagatgatatatgccatttttataaggtgaagaagtggagcagtataaattgtaccaagcaagtattgagcactgcgaagttcactgttccttagagaaatgagctatgcatttactgctaaaaacaaacctttcataaaatatttttttgggcaccaacctagtgaaggagtaaggaaaagaagtggatggttttagcatttaccctatggaagcttatagcctggatggcaagatcaaattaacatgagaaggcagtttggtgtaatggttaagagcctttggattcagccaaggcagaaagtgatttgaattctaattgagcccctttttagctgtacaactttgtaaaagccctttaccttctatacctcagttttcttatctttaaaatagaaatgctaatatctacctaatagtgttgttactattgtttcttaaagattgacaacaaggcgtatgaacagcatgcctggaaaatactggatgctcctcataagtagttatttatttattaatatcactgacacaagtgaaataatccatctcttcctaccccagcacacttatcataacaaatttgtaatttgtatgtttacaatatcttttctgatgaattgatccccatagtatatttagagcagtggtgtctggatttgtataaatctctgtaactctagaacttcacccagtggccaatacataaaagattctaaataaatatttgttgttgtcattgtaataggggaagagtatgctccaaaacaaagatactgattttaaaaacgaccacactttcaaaaaaaaattttttttaattctagagaccagcatcgagagtaggagtactcagtacgattatttacggtaatatatttattgggtaaattaggcaccatctggtgtgctagcttagatggctctagttctttattaatagatatatgagactctggggtaataggttgctagatccatatgctattcaggagacaaatttagtatacggtaagcttgctacaggatcaagtcgcataagaaaatgaattgaagtcgaagaaatgcttaggttaacccaacaactctgataattgaccaatgtggcaagggccattctgttccaaaaataattaacaatatgatcagtactgaattaatgttgttacggattataggtttcaaattttcccttgttaggaaaatcaccttttaaataatctcatagggttttgaacaaagagcacagtgtttctttttttttaaatagaaacccatacttgagaaggtagcaaagagtagcaaagagacctggatctctgtagcaagttcttggcctggtcttcattttcaattctaaaaattttgagggaaataaacagctgtccaaacaaaatgctgaaagaatatccctggacaaacagaaaatctttttttttttttttttttttttttttttttgagacggagtctcgctctgttgtccaggctggagtgcagtggtgcgatcttggctcactgcaagctccgcctcccgggttcacgccattctcctgcctcagcctcccgagtagctggaactacaggcgcccgccaccgcacccggctaatttgtttgtatttttagtagagacggggtttcaccgtgttagccaggatggtctcgatctcctgacctcgtgatctgcccgccgcggcctcccaaagtgctgggattacaggcgtgagccaccacacccgaccgacaaacagaaaatcttagaggggcatcaaagcaaatcatatggatggagagtgtgaatatgaagaaaagcatattctttcttcacacacacacagtatgtgtgtgtgaagtaatcttcagccaaagcaaagactaaaatgacctgttcaataagatggaagcaaactttaaaaaacaaacaaacgacaaaaaaaaaaactgtcctccttctccgccaaattcaggatacatgttttatcagcccatgtgctattaatctatttgtgattattctatttcattttctctcccatgcttttctcatttcttctcctcattctaggtgagtataggaagcatcagggctggggccataaaaagcctgtggccaaggacattgcaataagacagagaattttagatacttcattaattatttttcctaccagttaaggattccttgtgtaatgacagaacaaggagaagacagcaaaataatactaatgctaataaaaatatgtaatacagagtacttatgatgatataagcattgttttgtttgcttagattattctgtctggtgttcttaacagcctgtatgctgggcaataaaaatagagtctcaggaaaacagaaccaagtttgctataatttggagagacaaaactaagctaagattctttaagtaatgttcatggggagtttgtgcatatgatttatcagaaagagctgcttctaccagggctcataataataatggttcccctgaactggatgctaaatttatcaactggttattttgggcttctcttgccagtaagcctatagaaaacaaaaacaaaaacttttgctataaccttgattattcagagaaaataaggtttctgctacacagcagggacaggacatggttggcaactgggaaagacactcagcaaatattacagataccagaaggaacctggagaaactctgattctttttcattttgttcttaaaaagcaggcgtctgaaatgtgcccaacttcagctaaagaaaaaaacactattgttgggtctagacacaaagcctgatttgctgattttatttttcttcatttagttattttattgttctgtaaatatggacttaccttttttgcttctttattttatcttttggtagaaccttgagcagggacaccctagacgttcaactgttccgtgtgatcagtgtctgccttaaaatgtctgaattcctgtactgcatttcccagtgaagtttagtgtttatggcaatcctcccgatggggagagaaatgagccggcgaggccaaaagcagcatctgtgacttgctaggatcagctggctctgtgtgcatgatttccacttcaaagggtacacagacaacttggtgatagtccatttattgcagcctggtcttgtcaattagtcaaagttatcttctatacagctacagtaagtaatgtaaaatcatttacaatataggtgttagaacagcagagacccttagagttcatgtatttgacttcctccttgcacagttgaggaaattatgaaatgcatgtctttagcttcttcattctacagtatttattgagatttttttatgaagaagaaggataaaaagatacaaacttgtatgaagttagggaactggagaagctaactcattttctcttttttttcctgtgtctttggcacctctattagatctggtccgtagtgggtctaaataagtatttattgaagaagtaatacatgctttataaatgatggccaaatagctgtttgaatggataaaaaagcttcataaagaaagtgatacttgtactacgtcttgcaggatgtgggagaattggaaaatgagagagaatagagaaattaaccaatattatagtccagccaacagcaaagattgaactaaaattctggtctggtctagaggtaaaccaataggctcactttccaaaagaaaatctgaagcatttaagattatttaataaggaagaatttcctctggtgtcctgaatgaggaatctttggggcaagaagggtcctgtcctatttattatccttaagaaattccttgctatttttagttctcaacatcagctacttctcattactaagtaaaagccagattacttaacttgcactcaccctaattcatcttatccactggcagcaaattccttccttagaatacttccccactggtttttgagaagtgaaaaggattaacatatatggcagtggagtgttttatgtaatagtctttttattaaccccattatccagctgttggggtgctgggtagagaaggaagggaggaggaggaaagtagttgttggcactgggggttcagagccgccccagctccttgagatgaagggatgaaaataaatcctctgtattactgaagcatgtgaatgccatgaagtagtgggacctgaatcaatacattgcatttacagcagagcaaaagaaagaatagggttttcagagtttatttatcctgcttctctgaaaaatacccgtgtgaactattgggctgagagtgttgagtccattgaatttgactctttcactgccatatctttggagagaatgccttcccaaagagtcatatccaaatgtaatgtccctcccttctcttatgagtgacttacttttggtattccactgggtggaaaaaagcttttcttacaggatatatgaactaataatagttatacgactgcttcggatttgtcgcgctccccttggataagtttaatatgattttgtacacattaattaattatcttaataacagacaaaatagaaggaagccactaccgtcctttccagtgcatcagatgaatcaaaatgaatcaaagggctgggcatggtggcccacacttgcaatcccattactttgggaggctgacaccagtaaatcacttgaggccaagagttcaaaaccagcctcagcaatatagtgagaacccatcactacaaattcctttttttaaattagctggacatggtgacccatgcctgtagtcccagctacttgggtggctgagtcaggagggttgcttgagcgcaggggttctagactgcagtgagttatgatcaccactgcagtccaacctgggtgacagagtcagaccttgtctctaaaaaaataaatttaaaaataacattaattaattaaaatggatcaaataaacacatacatattgtggagattgtgagaaataagccttgttctatgtgtctcaggtttacctgaactccaagtagccctgatgactatatggcagttatcacaataagcaacagcataaaggactttgagaaatcaacagatcttatttttaaaaatgaattttcttaaacatgtattcactcagctggcagtggtggctcatgcctgtaatcccagcaattttagaggctgaggcgggcagatcacgaggtcaagagatcaagaccatcctggccaacatggtgaaaccccgtctctactaaaaatacaaaaattacccgggtgtggtgacacacacctgtagtcccagctactcgggaggctgaggcaggagaatcacttgaacccgggagtcagaggttgcagtgagccgagatcacgccactgcactccagcctggtgacagagcaagaccccatctcaaaaaaaaaaagaaagaaagaaaaaaagaaaaaaaatgtattcactcaatatgattaagtacctactctgggctagatattaattagatcattgagagtgtaggtgtaagccaggcagccagacatcaattctcatggacttgcattctagaaggagattgaagagatgaggcaacagttgtagagaacaccttactgctcatgggatagaaaattaccactgggatgagggaaagttgctacttttgattgtggtcaagaaaagcttttcaggagatcacccttggcttgaggctcattgataagaagaggccagccatgcaaacatctgggggaagaggaaagagcaagtgcaaagatcccaaagccacagagatgtttatgtgctgggagaacagaagaaatcccagtgcttgtagtgcagtgagcaaaaggaagtatgaggccaggtaaagtaagaaaggttggcaagggtcagatcatggagggcctttggggctgttgtaaagagtttcatttcattctaaggcaattggaatccatttgagaattgtgagcgggagagtggtagggaccaatggccagtatgtgatgacaggtaatgtgatctatgctcctatttttaggggcaggcctccttaaagatccatttattgatttaacaatattaaatgaaagttcactatatgccatgctatagtgttctagggtttcagcagtgactatgacaggtctccagctttattgagcttacatcttattgaggagaggcagacaaaaacgaataagaaccgtgaagaaaatatagagtttatatgataaaaattaatgggatgaagtgctggaaatttcactggattggagaccactagggctacttcagtaattagttttgaggtctcctgttgttgtttctcagccctgatggtcaagaaattctttcctgttttgcttgtttccatttctgtctactgctttttattctgttgtcctcttaggtagtacacagccctttttctgaaagtcttatctctgatgaagaaaacactttttctcttcaaacagtaacttagtcttttgctttatttcctagagactctgatttcctaaagtttttcatatttgttctatgtattcattcttttcattatttttgttgctctccacataaaaatataaaaacttatcctgtaaagaagtattaatttagacatcatttagccagaatatagcagaagaattattttacagttcttataaggtacctactaatcctccctcctccctgccccctccctgtcttctcttttctcctttccttcctttctttttctcctatcccaaaatactagttaaatagtttctctcctttaaagtactttaaagataacttcttcataatgaactcttgtgtgcataagcatttcttttcctgttaagaagcagtggacaatttttttgttttaaagacattctagaagattttaaaaaattattgtggtaagaacacctaactgtgagatctatcttcttaatagatttctaagtgtacaatacagtattagtaactgtagacattatgttgtgcaggagatctccataacttattcatcttgcattactgaaattttatacctgttgattaaaactaaagatccttttcaaaaaatacttcttaagccatggcttcccctggttgtggactgtaacccttgatgttattgaccatcttgggattaagttccattaagaaagacagtgttagacattgtggagaaataatagcaaggaaatgtttgttctggtccaccaaaatattgagggaccaattttaacctccacatcgttccttctggggttttcaggataagaaaaaaggagctgtggcttgctgctatttcagtagtcaaataaatatttttaaattgcttgtttcattagtaggatgtttttctgaaaagacagagtatatacccctcaggatatttctgccaatgtgttaaagtatttgtaaaaaaaaataaaataaatggctttgtagaatgttcttgtttcccaaatggctactgattttcttaagaaaaaggtagcagcaatttgctgaaaaacaaaaatgaccttttattagtcaagagaaataagataactaatttagattgaatgtgtttatcctaccagggtccaaaatttctattttcatgtattctccttttcttataaaggctccctttggaactatctaggaaggacctgccaacatccttgaacagtgaccattcagtctctactatactagaacccatctgatgatgaaattttgactatatttttggagatttcattctgtcattggatagctctaggaagtgcttttacaccttttgagctctggtcttgagtccagtaatttttacgtatcagtccttgttctgccttccaaaaccgcataatcctccttcaacttgacgtcctttatgtgttttgagatggcccccatgggcttccaagtgtttctggctaaatatcctgagctcatacatgtgttcttcatacagcagcactttgaggcctctctccatgctggttaccttcctcccaagtctgagttttaatgtcctgtttaaaatgttatgaacacagctacttagaaagctgtgcagtcatctcagagtagaatcagacaaggacctccttcacacgaagtgcttcctgtgaggacctatgtaatctgctctgtcttctgctatcatttgtttcttcccttctctcctttgcatcatccactccagcgacactggtttccttgctgttcctcacacaagccaagcaccctttaacttccttttaaagccctttacccttatttcctctgccttgaactctcctccttcagaagacatggggcattctccctctctgcactcagattactattgctgtcccctcagaggggcctgcccttcccaacccattctaaacagccctcccccatcatgactaccccttgtcatgcttttattagcccttgaaattcccagacattatgttatcattccatttatttgtttattgtctgctatcattattagagtatgatctctattaagtcaaggactttgctagttcctgaatgtcttttcagtacccagaaaagggtctagcatatagaaggagcataataaatatttgtgaatgtattgactaatttactatccatgcagattatctttaggcagaggatagagaataagactttttagtacatatttaacagtgtgtgtagccatccatacagtaaagaattctgcaactcacagtcaccccaaacagcatttgagcttttagatactatagagcaacctgtgtctgtgtgtgcatagatatgtgtgtacatgtacacacttatgtatatacatacacacatacattcgtatacatgcgtgtacatttatgtatgtattatgtgtatatctctgattaaatgggtgaacatgtggtttggggacccgtgtccaagccctctagattgtagaagctggaaatgacaaaagtgaatgaagtgagggaaagtgagccagcaggactgctcactgcacatgaatttccaaggatacagttgttcttgaacaatcacagtcagtatatcaaaataagcgctttattgagtagggtaaaaggagttgctggaaagactgtaaattctctcgcagaacaaatgataactgagcccaggagcccttttgttcttgggggagggggcataaattccctgaaagtatctgtcgcagggaattgctctgcattcatcatgtccgcctcctgcatcattcatgaatgtcataagactctaaagaattggcacttcatagtgaagatgattaaatagccactatacttgtcttttctgctgcacagtgctttttaaaggaattccatttaggttgtagcatgccccttcgaatcccttcgcatttcttgcaacctgaggtctctgacatcagaggaaggcccttgcttgttgggactggacagagctggtgggctagcacttcagtttgcttattttcctttgatggagacaataggatctggaaaaaaaaatgccataaagctcaaagcaaatcattttttagggagtatagaaattgctgtttagattctgcagtgaatgagctgtaatttttttcagatattttcacttctcttatcacttccttgtggactaagaataatgaatcagaacaagacacttttatatatgatttgctattttatatattcaaatataaggcctcaagtcattttgtagccaataaagcctatgtatgcagtgtaaatactgatgtaacagagtataagatatagaatcggccaggcgcagtggctcacgcctgcaatcccagctctctgggaggccgaggcgggcggatcacctgaggtcaggagtttgagaccagcctggctaacatggtgaaaccccgtctctactaaaaactataaaaattagccgggtgtggtggcaggtgcctgtaattccagctgcttgggaggctgaggcaggagaatcacttgaacctgggaggtggaggttgcagtgagctgagattgcaccactgcactccagcctgggcaacagagggaaactccatctcaaaaaaaaaaaaaaaaaaaaaaaagatatagaatcttacttctgtcctctcccctgcatgcatttcttgtcatgtatacatattctctttctctctctccctctctccacacatactcactccctctctctctctaagtgccctagagtaattcttacttcccaaacagcatccttaagtgacagagtgcaaatgattgaattaacatttatctactcaggtatatgtagaatctaaaacagttgaactcctagaagtacatagtagaatagtggttaccagaggcctcaggttgggggttggaaggagcagatgttggtcaaagggtacaaaatttcagttaggagaaatacatttttgagatctattgcatagcatggtgactacagctaataataatggattgtaaattgcaaaattgccaagaataaatttcaaaagttctcaccacaaaaaataataagtatctgaggtgatggatgtgttaattagcttgatttacatcattccacatagtttacatatatcataacatcacattgtaccccataattatatataattatgatttgtcaattaaaaataaggccaggggcggtggctcacgtctgtaatcccagcactttggtaggccgaggtgggaggatctcttgaggtcaggagtttgagaccagcctggccaacatggcgaaaatataaaagttatctctactaaaattataaaagttagctgagcatgagggcacatgcctgtaatcccagctacttgggaggctgaggcacgagaatcacttgaacttgagagacagaggttgcagtgggccgggctcacgccactgcactccagcctgggcaacagagtgagactctgtctcaaaaaaaaaaaaattaaaattaaattaaaaatataaagttggtcaataaacaaattttcataagcacttatgttagaggcaacagaaagtatttagagagaacagcagactgtaattaggagagaggagctctgatttgtttccaccagtcatcactgtcacctcagacaaattctgtaacttcccagggcctcaggatttgcatctgcaaatgaggacacaaatggtggctccaggattctccttccactcttatgacacatggctttatgtgtcaggaggggctcagccatcaggagggaacagaaaaaaaaaaaaaaaagctcaggatatcaccactatttctgaggaactcataatttaatgatctctgcaatctctaagctctgctgggaaatgagctccagcataacacgggttctgggtctgtagtggcatcgctgactgaaagataggtcatttttaaaatagtggtatgacctttggctgtgatttcctcataataaacataatatgatttttgtgccaattttctgttaattatgggcttctcctaaaagtttatgagtttaggaagaatgttctttttaaagtagaactttggacacatgttaggagatccaattaaatagatggatcatggaaattgggtcatcactggttgttaccagtaagaggatcccttagagataatgtgttcacctgttaccatagaagtcttatgagctgtgcctgtaagttaccagtggcttcaaggcaggtagaccttttgagctttaatttgttcctagaaggaacctcttcacttctcattatccagactttccctagaagtgggagggctgatcaaaatgccagccttggccctttgcattctgctgctccagccatgtgggtctgatttgttcttactgctggtttaagagagattaaaaggagcaaagctgttctctaagtttcttgatctgcaccgtggcagccagagtcagaggaaatggagacaatgggaaagggactaaatcctagagagtgatgtgtctgggatctcgggaagcagacccagcgttcaaatgcaggcttcaaatactaggtcattgctttggagaatcttcttgcacccaaaacaacttgccacaacctatgtggcccaatgtgcagcaaaagctgagcctgagataaggacagacaggatatatggctgaataaagaactttcaatttccttttcttagtagacggacaagtatcccatcattaaaaaaaaatagccacataaaaaagcagtttccaatctaagtgcacatggggtatgccaaaatctttgcacatgattgacttaatcagaaggcccaatctaatggagagaagtactgtattaatttaaatatggcaggtgctttctaagtttattgcaagagttaaagaccaattatcttgtatttttccataaaattgcattttctaaaaagagactggtgtgtctgaatacatccatcataataaatcttcaagcttggatggaagtgactgctgtttatttgcagcatgtcatatctgtactattgaatcaatgctaaagttatcatattagaactaagatgagggcccggaaaatgagtttttatagactcacagcgtgattttgtgaataaaagcataagaccaggaccaggtgtagaaagtgccttattccagggcctgatgacctggaaggcaattttcaaatgtagggattatgcagtcacctctcacaaggtccagggtgaagaacaagtaagaaactttctattttctggggaataggcacactttcaaaggaggaagaggtattgagatgagacagagaaattgagatggaaagtgtatttgaaatatgtgtaattaggcaggagaaatgagaatcacaaaacactagcaaaagtcattgtcttgctaaaaataataaaggaagaaaaacaaagtataagctaaggctttgaaggtgataaaatattaagaaattttgcttctgtatttataggaaatcagtttttaaaagtataaactaattactaatatattacataataatgcagtgatgttgcttgtccatgataaaaggtaataaataaaaatttgtttaatgaataatgaaaaatagctttcacatttggagttgattttgattcattttgatctcttatgtggctcttggctgtagactatctttgttttaagaagagcaaacccatttgtcctaatattcctggagaattatttcattcaaaagaataaaaatatcagccaggcgtggtggctcacacctgtaatcccagaactttgggaggcagaggcaggtggaacacctgaggtcaggagtttgagaccagcctggccaacatgctgaaacagagatggtgccactgcactccagcctggacgacagaacgagactctgtctcaaaaaaataaataaataaaaataaaagtaaaaatgtcatgtatataatatagagagaggttcaaatacgctaagagaaaaagaagccaagatcatgtaagcattatgattacaaccacatgcagactatgtttttcttctggctgaaggccagagagaaaggcaagtagctgtatattcagtgggtgttatttggtcaaatcgatttacatagtcttgcaggtcttccaaatactaaatattaagtacttggaaaatagctgagcaaaatctgagtgcattctatgatgatacagtagcacagtcttgcttgggacttaaaatcatggttgtttatggtcatggagttctaaccaaacccttgaacacaaaattcagtgagctcaaaatgaaactaacactttcacattctaatctgtatttccttttctatctactattttatttgtccaaatttgaaaactctgaaccaaccccagatccttctttttttactccccaaatatcaaatagatcacaaaaggcttttattcttcatgtctttcatatctgcttcccctgatttctcatgctcactgatccaattccaattttcatctctcgtgtctggggtattgcagcagtcttcctctaaatccccatggtcacacattatcctccctccatcttctctactgcagacaaagttatttttctcaaactgtgcattttcccactgatcaatgtagtcattctccaactttttaaatactaaaatcactctttgaaaaattgatatggaactttgtttttttttttaagacagagtctcgctctgtcaccaggctggagtgcagtggcgtgatctcggctcactgcaacctctgcctcccaggttcaagcgattctgttgcctcaaccttccaagaagctgggactacaggtgcatgccaccaagcccagttaatttttgtatttttagtagagacggggtttcaccatgttggccacgatggtctcgatctcctgaccttgtgatccacctgcctaggcctcccaaagtgatgggattacaagcatgcaccaccaggcctggctacttttgtatttttagtagagacagggtttctccatgttggtcaggctggtctcgaactcccaacctcaggtgatctgcccaccttggcctcccaaagtgctgggaatacaggcatgagtcaccgtgcccagcccaatcatatattctttaacattgttgtattatttcccagcagtttgtagcttattttgttttaatgctttattttcctagtaacaaattctaaaacgatgttgaataatattgtgataatgaacatctctattttcctgattttaatggcaaaggctatataattttgccatttagtatgacaatactttgctgttgataatctctatcatatttagaacatcttaattctatcttaattaaattttagagggaatggctgctgaattttttccaatacttaaaaaaaatcctgagtaaaattatattcaaattctactttaattaggtaaagtaatgaattttgttaacagatatctttaagctgaaatacactacttttcatgtttctgaaatcatatttttcttctaatataccattgaaatgctattcaaaaaatgtttatcaatttttgtaagtgaaattaaagtgttttgtttttgtgtagcatatttattaggtattggtattaagattatgttggatttacaaatgaattggaaaatttcttagtctgtttgggccactataacaaaataccataaactgagcagttttgtaaacaacagaattttgtatttcatagttctggcggctgagaagttcaagatctaggtagattgtattggtctctggtgagaatctcttttctcttcataggcaacatcttcttctataacctcacatggtgaaaccttacatggtgatgtctgttttataagatcgtttgtccccaccatctcccaaagaccttaccctataataggaacacattgaaagttaggatttcaacataggaatttgcagggggatcataggcattgcagtccatttcatgaagatttctaaccttgcctgtagtatggtataaaatggagtaatttagaaattatctcttatcttaaaagttatgttgaaaggtagatgaaaattacctgtaaaatcacctagatctgtattttttaattattaaaacttgaatctcctttccaatggtgtctatggtcattagcctattgagtttttctactttttcttataaatctttgacaagttatactttttcctagaaatgatccattccttctgactttcaaatatattgctttaaagttgtacaaagtatgattttatatttgtaatcttttctattgtgatggttatataatttctaatgttctatttttctcctttagtttttatttctgtttttttagaggtttatatattttctttgacattttaaagagcaaactttgggatatttttaacttttatattatttcaaatattatcgggtaaatttcagcttttatttttaatcatcaaaaaccatcttatttatcttatttttgtaatagtgcattaaggtgaaagttcagtttatttatgtttattttccttattattatttgagacattttcttctgagtttctgagtaaagctttatctgaagtttatatgacttgatatataaagctgtctcttcattaatactctaattattaggttttggtcttttttactgtatattttaagattgtatgtataaagagtactgtttgttcaataacttaattatagaaatcattaaggatttctttgtcaacaagaatattatcagtttaacaaatgttccaatttgaaatatatacgaattactgaatatgcttctttggtaaaattcctgagttgcttatcacccaatcatcatggtcattctttgccaatttatttaagcacttactgtgcccctatgtgttccaggcactgtgataggtaccaggaattctttcatatccaaactcttctagttgtgaaagaacccaaatttgaactagcttagactacatgagttagctattaaaagttgtgtataagaaagacctggccaggcacagtggctcatgcttataatcccagcattttgggaggccaagacgggcggatcacttgaacccaggagtttgagaccagcctggacaacatagtgaaaccctgtctctactaaaaatacaaaaattatccgagcatagtggcgggtgcctgtaatcccagctactctggaggctgagacaggagaatctcttgaacctggaggcagaggttgctgtgagccctgatcaccccactacactccagcctgggtgacagagcgagactctgtcaaaagaaaagaaaggagaagagaggagaggagaggagaggagaggaagagaagcagaggagaggagaggataggagaggagagggacaaaggcacaacttcacaatatagattataaaaactaggtattttaaaaatgataagatttttctctctgtggccagatctaaattcaacagcttgtctttactctttcagtcaggattgattttctcatgactttctccccataagcagaaatgtggccacggcagctgtgtgtctcttatgtcacagttttatcatcagagaggcactgatggagtgtttctctggttccaggtttaaaaaaaaaaaaaaaaagttcattgaagttctctagcctagcttgggttaattgattacaccttagtccatctgctgtatataagagcagaatcttttacggacatgacaatttcagttcaaatcacatgataaatatggaggaaaataataatttctttgtgaagaggcttaatgtttcaagatagagacagaggatgtgctgcgccgatagaataatgaaagtctcctatagtcaaaaaacaaacaaataaacttgaggcagattcttcacttcaaggtgctcaccataaaatggcaatactaaactatttctagaactctatatagagtgcctgttagttattttgatcctgttacaactctttcagatgatgaggtagaagtgttgtcgccttcttaatcatggagaaactgaggctcagtgaagataaatgattgttttagaacagaagcatggactttaatagttgggatttgttcttttcatccaattctgacctgggttctatgattaagaggtatgtgtctcatagaatcaaatcatcacccttcaaaaatattagccagcttttccagaaaaatcgtgttgtatgaattaaagccacaaatacaccaaagtcatccgtttacagcccctggcctcttgtaagtatgaggatcatataaatcaggcatttaaatcaaagcactggaaataagcaactgctttttatgtgtattgtttttccagagaatattcaatacttagctaccccttcattgttcttattaaaaaaggtatttcaaggctgtgaaataaaaggaggaaaagaagacaaatgtgtatgttccaaacttctcctttcctctaatcatgtctcatgtcatcagaaggaatgcacttctgaaaaataaaatgctacagaaaaggctgctgagtaattataaaatgattacttttgtttttcctttattcatttatattttgcttatgaacaaatgtatatatggtctttgcttttagttaatgctctgtaaaatagaataacgtggctatccttaaagatgtcacgttgcttttctgttgtacatccctgttaggttaaatctgagatgcacttatctatttatttttacaaaaacaatttgcaatgtgatttagaaatggaggagtaacataaaacaatttgactaaaaatgggtgtgattttcttatctgagactgccaaaaattcaccaaagaaaaatcattcaaatgtctttgtggttaggtttcttttataaattgaaagttgtgttctatttcatcatgagagatgctgtgagctctaactgatgagcatttataaaatatttccacgttgagatgaaatgacaaaaaggcaagatgaattaatgaacattgtatattcttattcctttattcccattctactccatgcctgaatggcaacgtgaagatatgtaagcataggtaagccaggtttcattgattagttcaacagcatttatttcctgtgcattcacagtgttgagagataaataaattaaacagccctggcttccaggagctcgtagtagagaagcattctggatttccattttgtttgacaataaaacttaatatttattttcttaagcctgaatactgtgcaatttcctagaacttattttgttttgctatataagaaactagcatggttatgaaagttaagttggctgtgagttaatttctcacatagacctcattataaatttacccttcagaatttagagttgtctgagtgtggtataattaatcaggaatggactattatctgaccttactttattcactttataagaggacaacctcatgtaaaaccactgtcatttaagtaagataaaatgagtacctctatactgccagttgcattgtgaaaggattgggttttcatcttgtttgctgtttttgttttgtttttaattttggccacatattagaaagccattgtccttctttccatcatcatcaggtaaatggtgagaatattagagatacagtttgacataatgaaaagaatgtagattgttgagttagacctggattaaagtcctaattccattcgatatttggtaaaagatcttggcaagtagttttaccttattctatagcttccctcatctttaaaaccaagatagtaactgttatgagctgaattatgtcccctctacaaattcagatattaaagtcataaccctcagtatctcagaatgtgactgcatttgaagatagggttttctgaatgtggtgtaattcatcgggagtgggctatttctgaccttgctttatttttcagtttcagaggttattttggtgggccctcatccaataagactgatgctcttataagaaaaggaaattagggcatagattggtacaaagggaaaaccatgggaagatacagggagaagatgattgtctacaagccaatagagaagctgtagaaaaagccagcactgctaacactttgatcttgaaattctagcctccagaattgcaagacaatgaatttctgttgttaaagttacccagcctgtggtacattttacacagccctagcaaactaacacagcaaaaaatatttcaagtgaaaaatatagagttttgaaatattatactgtatactaagatatataataaataatatatacacatagctggtattagtattaatattgatattaacattagtctagagttagtattgccaaacagtaccaaagagtttgtgaaagaaataattgtcccaaaggaaaaacaatgagcttatgaaaattcctttaagcaagagggaatttgagtgtgtccgtggaagctttatttttaggtcaattttagcgtctacagcattgcgtattctaccactaatcatctttttccttagcggaagtatcctgaaatttgatgagtaaaaatgactttcttttatatttttgtgatataacagcttctaaagtaatgtgtttctgaaaatgtcattacccctaagacttacttacaaagggtcatgatgtgtttgtcaaaactcatcagtgtgtccagaaactatgtgcgtgtgtattttagtcaaactttctgggagttaaagtatatataaggtaacacagcaatggaacatcgcaatagttggcatcagatttgcaaatggcacaattatttgtttcctcttcactggtccttgaaaaatacataatgttcccatcaaaagttccagccaagcatatttgtaagaacagggtttgaacataacctattatatcatgaagaatggctctcttccatggtatttaccaccagaattaagtagtggtagacttttttttattcatggaaaacatttagtgaatgggtagaatgttatttgttttatatttttctctcatcagctcctttggagactttggcatcgggcagaaaaagggtctcactctgcacaccaatttgagttcccatgttatcaaacagatttaatgctaaactaaactggtgtttgttctgcttataagtctttgagttgaagccttgtttctggaatattgggacatgctctgaaatgttgcctctgtagatcctagaaagtaatgatgttttctgctttcatgcgatttagttttaattattcttccttcaacagagagaaatagattgccccacagggagggaaccctcaccttgcttgagcattgtctaagaaatggctttttctcatgatgtacttaactgttaggcaatgttgtcagtttctcagcttactgagcagcaaatctgctcatttctttgccaaggaaaaagaatgttcttaaaaatagatgaactttctctcttaatgttcagtgcattcaatgttgctttatttaaggctgctttatcatcagttctggtgtttatttcaaaaaattcaaagtagataaaacagatcattcactaaattccatctattcaataaataatttgcagagctgtttttaaaatgtgtatcatttaccctgtactccctagtggctccctctgtaatgcagaggccttgtttgcagtttttccatctgttattcacctttctcccctccttttggagctcttgatctctagggatgtttttagggagtctttatcccattagtcattgggacagctttggagaagagggcatagttaagaaagggaggatctgattctattctcaactccactacttagcaacagatcaagttgtttaatctccttgagcatcaattttcttttttattaaaatagtaaccaaaatatttgccattaatatttcagtgagtgttgagggaagaggcatcagatgagacactccaaaagaaagcaatttgaaaatcatttaattctatggcaatataaggcccagctgttataaaatagtgaacattattcactcctaaaacagccagagagatgagcggcagaggaaaaccatagaacaaactaagtaaaagaaattgagaaaatgtattctttggaaaatcagatattacgagatccttcagttaaatttatgtctctatttgctagaagagatatttatcagttccaaagcaacaagcctttcccttttggttttattagctacatggtaattgatatgaatttaaaagataggtttaatttgatagcaataactacatctactggcaggatatattttatgtcattgatagtccttttattttccaaaaggatttaccagtttatagtaaaaaaacacgaatgtggataagcttgtgaaagagtaataaaaaagaaataaagaataagaaacctgaaatgatagaggaagaccaacataccttaccattatgagattttatactaagtcctgaggcaatgatcaaagagaactagagcaggagactgacatcttgtttctcatcctagtttatctatcatgtactttgcacataattgttatacttattttattacttaatttattgttctacttgttataattgtccacaagtaaattatccagttctccttaaatttaactctcagaggccgggtgtggtggctcatgcctgtaatcccagcactttgggaggctgaggtgggtggatcacctgaggtcaggagttcgagaccagcctgaccaacatggtgaaaccccgtctctactaaaaatacaaaattagccaggtgtggtggtgcatgcctgtaatcccagctacttgggaggctgagagaggagaatcgcttgaacccaggaggcagagtttacagtgagccaagatcatgccattgcactccagcctgggtgacaagagcaaaactccatctcaaaaaaaataaataaataagtaaaataataaatttaactctcagatttcccctgggagatgcttccaaaacttgttccattttaacatcaatagaattatttgagggaaggctattttgatatatatatatacacacatatatgtatatatatatataaaaaaatacatgaatgagaaaaaattatattcctcattctcttaaagaaacgatagatcactcacttaattagctatatatatatatacacacacatacatatattcacatatatatatacacacacacacaaccaatattgtattattgtattttagtacttttattaagccattttacctgtaattatttgatggggtaaataataaatgaattctagtctattgtattttttaactgaaccttttttgtttttcacacacatgcatgcacacacacatagacaaatatatatatgcttatgtatatgtatatgtgcatacacaatgaatgtatatgtatatgtacatacacatatgtatgtatatgtatatgtacatacacatatgtatgtatatattatttgtatatctaaagtgaatcttaagacaagaattctatttctgttgatagtctcccagaaaaagtaatatgctatttggctataagactggaaatagaacccatgccataaaggcagggccagggggtttctaagtcaaaacaacaacaacaataaaataattacctaagtgatcctaaataaagaaaaagtaaattgccatcaacaattatattctaatacaataagcaataaaatgcacccaaaatttaagaaccttggagaaatatgtggatgagaaaaaattatattcctcattctcttgaagaaactataggtcacccacttaattagcttgttccgtaactttcacccaggactcctttatgatcgcatggaagactgtttgatccttttcttctgctggatcaccatcccaagcacacactcacagaacacataccaaaacactctgtcaatatcaccatcagctccatcacagtaagtagttagccaattatgaaaacaataagccaggcccattatttgcaggttgtgagttaaaaaaaaaagagtcatccttgttgactatttgaagatgagatgtatcctcttaatctttgttagtggtgactgtgtagagatttcattcctggaatactgtgttggttaaaactcagcaaagcaacctcagctgcttgcaaacttgcaaatcctgcagtgttaaatggccaaaatgctactatagcaattttttcttcagttgaattggtcagtttttgccaacaaggatgaaatttacatgattctgaatataaacataagtagtatgatcttgcatcagcatactgaacacggtgagaaaccagcaatcagaagtacgaggctcaggggagaaagcatgtaatgtggtatagcatgcctcagaaatgaaaatctttgatgaattaagaggaggttcttatagttcccaggattttcccaagaagttgatttgtaatccacattttaaagtaacacaattaacttttttatttgaatatgtaaaacaaaataattctatgtttcctgtaggactctaggcattttatattaaaattaacacgaagtatgtatttacctttaaaaaccatgcaagatggcaaagcatgaaatgtaaagagaaaaaacaataacaacatcagagtagaaagttataattgttaattaccttcctctaatgtcccacagtattggactatgggagcattcagggcctttattcactcttaccagcaaatactttaccaagaatagatattttcatatttttttcttcatagcaaagtaatcatatgccaggtactttgtatcttttatgctttcttcacctataaagttagaatcatctaacatagtgacatcataaattcagaataacaaaagcaatacaaataattttaaatcaaatttttagtctatcctatcaaatattgtcatagtgaagttttgttttttgtttatttaaagattaaagccactgtgactttctaaccatatataagaaattatatatttatgtattaaaatattcttctcctttgtattggagcactgagaattactggtaggattgtggatgaaaactacaagtaaaatgcttaaagttgttgatatggtgagatggccagacaagcttttgaaaacatgccaaatttgggggctgtgactttgttttcattctgctttagtctgataaaaagatgtgaaaagaactaagtacagacaactgtttgccccattggtgtagtttattgatacagtttattgtgtaattacattggtatgtggtgaaaaaaggctttcagaggtagaaggctcaggctggagacttgaaagtggtactatttaaatcagataattgagtctctgtttccaaatctgtaaaacagtgttaagatataaaatatcccatacaattgttgcaaagattcagcaaatgaatttgaaaatattttgcaaactgtaaagcagcatgtatatgctgctatcaattttttgacttgttatttttgtagtgacaaaattatttcctgatagagtatgaatttatctctgtagcagaatccactatatatttaggatagaaaagtaaaagatttttataaattgccatgaaatgtcacaggctgatttgcattttctggtgattctatacattaatcactgagtaaccttcagttttccaaataaagaataaagagagtggtgatgacatttgtaaccatctacagaggaattatttaaattcttcacagatggagcgatatcaagggtaaatcattatagccacatttctaattttaagaagctttgagggtgtttgtggatggtaggaagtaaacattgttttgcatatagaattaatcatagactttgcataccacaattccaaatcctccagatgagtgtagagggctttcgagacaccatcccctaaggatcgagaaattcataaaaggaaaataatgttatgctacatgtaatatacaaattgagcaaattggagcaactagaatagtgacctttcaaagaagacaaattagattctgtatgcctcagaatttaatgagtcttagtgctttaggaaggatgacatatgacacatattcttaattctagtctcacaagagttaactttattatttctcaacaagatgaataactcacttcttctttggtcaacataattctacctaatattctctgtaaactagctctggaaatacatgcggaccagtgcttgagatttttagtaaatgtaaaaggtatctgaatggttgtataatgctgctttaaaagagttttaagggttggaacatggtcactgagaaatacacaagaaaatctgttaccaaatgtgctctgaattttgagatgagtaacccgtggaagtattcgctatgggtaacaccacttgcctaaaaccacagaggcaacaaatggcatagcctttctggtcaccaaatctaaatgattttctccaactgaaattaaaaatgtgtttcttgaaatgtactttttataatttctgaattacaaatattttctttatttttattcccatttgctttgtaagtagttctaaattaatatattcttagtaactcctgagttcatatggataatagtaaaaacacaagtaaagagtaaacatactggtaaacccactaatcataattgacaactaccacttgtcatgttcaaatctcattatcctgtgatgttttttctgtttcttgtatcttcttcctaagatttagtttgaaaaaggaaaagaaaatgtatttaatgccagataaataccaccactagggaacaaaaaaaaggtccatttttaaaggactcctggaggccaggtacggtggctcacgcctgtaatctcagcactttgggtggccaaggcagtcagatcacaaggtcaggagattgagaccattctggctaacatggtgaaactccgtctctactaaaaatacaaaaaaattagccgggcgtggtggcacgtgcctgtagtcccagctactcgggaagctaaggcaggagaattgcttgaacccaggaggcaaagggtgcagtgagccgaggttgcgccactgcactccagcctgggcaacagagagagactccatctcagaaagaaaaaaaaactcctagaaatcatttttgttaccatgtttatagcaacacaatagtgaaataggcaaatgcatttagtcacataacttggttttcttgggccactgctttctttcctgtgggagtgggagaaggtacaagcaggagagacatgatgcctttggactgctctgttaccttcagttttgtaaggctcctggctccactgaccagattatgctgatagataagagataggggactagttttctaccttgtgcctgtcctggccaagatgcaaaattaagcctactgttgaggaagaccagaaagttgtttattgcaatgtacccaggctcccagacttaggatgttatttaccctccaccgttatgcagcgggaacttaagatgttaagaacgactcttaccaacatctgctttgttatgcattcattctgcctgcatctttaatttggggtgatagctgccttcagaagctttgggagccgttcctctcagtaaccaaatactgtcccatgggggacatttcctctctgcagctgttctgtgtagggtctcaacagtgtgctacagctggctgtatgcaatgtagtgccttgatgtctccctctctccttgcttttgcagctggcgctacgtacatctttgggaaaagtggtgggcttatcctctacacctggccagccaatgacaggcccagcacgcggtctgaccgccttgccgtgggcttcagcaccactgtgaaggatggcatcttggtccgcatcgacagtgctccaggacttggtgacttcctccagcttcacatagtgagtacagggccttggcctggattttcttatgttactggtggtctgagttagtgattcaggtagacgcagcagaacattctagatcaatatggcaaaggtgcacatgcttataaaaattgttttcagatgtgaaccatcatatttacagggttcctgggggaaaaaaacttaaaaactcttccttcttccccatgtatatagggaggaaaaagaaattcattctttgcaggctcccttcccaactgtgtggcttggcctgtggcagaatatttagcagacttctagggtatatttaagagatttacctggtgtggatcttacctggtgcaagcagcaaagccaagtggaatgttaacaatctcctaggctgggatttggcaaaccttctgtaaagagacgtatagtaaatattttggactttgcaggtcagatagtctctctcagagctactcagttctgcctttgtaatgtgaaggcagccacagacaatacatttttttgaaatgcatgagactgtattccaataaaaatgcatctataaaaacaagctgcaggccgtaatttagtgacccctgtcctaggcttcaagcatcactgtaagagatgtaataaatgtgtgataaaaactgagaccagagtgccagagtgggcggggcaaaagggaaacagaacagtgatcaagagttgagtaattcatgtgtattgcatactcaacattttgcttttggtcttgtacatatgcacttaatagcactgcacccttaatccctgtagatcataagaacacagcaaaggctaagaaattaaaaatgatttagaagaaaaaattcttttgttataaggatggaaaatatttttacagcaacaattaacccattttatcacctgtgcagtctgcagttaagaaagtaggctaaagagagatatgattctcatccataagtacccaaagtgcagtctccaagagcaaagagaggaattgttctcattagttagcaatgacaaggctagaaagaatggatttaatttggagcaataagaatttagtttaaatagcaggaggaaaaggcagttaagaaaaaagatcaactggggattactaccaacctccaaaaaggaggaaaaggaacattgattaggaatctctgaatcagagttttgctaatgtgcaggtgtatagagagaagcagaggatacaatttcattgctggtctctggagttggagatggctggccggaatcatgcatgacaagcccagctcccacagcagtgcgcatgtctgacacttgctcttccagcatgccttggaaatgagagcagcttaaagtcctaggcttgagctggaagtcggtctagccccagtataagccagatcagggcaagactctgcttaggagcttaaggaagaactggttagagatgatcaccttcaaaatgtggtggaggagtcttgaatagagttgtgaacttttcaattttttctcagatgcttcaggaaccatatggtgctatgagcctgagctaacacattttaaaaagctatgccaaggagcaaaaagaaaggcagccatacttactacactttatctttatttggcctctaagaaccaccataatttacaaaactctgtgagatttatgctacatataacttaatgactatttcatggcagctataactaggctgttattaccagctcacttgcatttccacagtgatttatcttctttttttgttcattgtgactgcctaagaaaaatatgatttggcacagacatgagcatctttttgagtcaaatagtgtactattgttttatccattcctgctcattcatgttttgtagaacatctccacttttaagagagaggttttcctattttctgatggtttacttgaaattagcagtgttttaataaaattgtcatgcagattgtggtaacttctaggaggaaccagaacattccagtatattttaatataccattataaagctctgtcatttctttggggtctttgaaaagtgaatactctaaacatactttgagattcaggtaacatccattgtgtgcatttattagtgtgtgtattctgtataagcatacccattagatttgacatagtataatattattttctttgtatgagcaaaattaccagacattttatatcaaaatgtaaagagccccctgggatactgtagacacttgggtgatacagccgattgcttaaacgttctgtgaaagcccagtagattttcctccaaatcttagattaggaaatgatgtcacctgaccctttcagaaaaaaggaaaaaaggatcctatgctgtggggaatctgtgtgattctagagtgaccctgacatgttcatggccctctcgagcaccaggccccttcatgggtctagtcatttgaagccatattttatttccttgcagattatctctttgtctactctgaagaaggcaggtttctcatcatacttgaaagtaaagaaatctaagtagaagactaaatggcttaattatgaaaccagctttttgttttggacatttaagtagatacatcagggaaacaaagccataaatacttattaagatacttttataacttttacaatctgtaaaaggtggttctgtttgttgaatggtttgttttcttgtactaaagaaaattactgaagagagaaagagctttggggccattaatgaaagtggaagggattgagcataaggcagaagatgctatttctccttacagtttgcctagaagagaaacctcctgggaaaaagaaaaagtgatagaagacacaagggggagatgaaggcaggtggttttctcagtttttttactgctataacagaatatttgagatttggtaatttataaggaacataaattaatttctcacagttctggaggctgggaagtctaagatcaaggtactggcaggtctggtgtcttgtgagggcccagtcttcacctctaaggcgagcactgcatcctcaggaggggaggaaccccatgttttcacatggcagaagggcagaaagagtgaacccactcttgcaagccctttttaggatagcattaggcagagccctcatgacctaagcgctttccaaaggtcatacctcccaacactgtggcatcggtgatcaagtttccagcacatggaattttgggagacatattcagagcatagcagcagaatatatttgcagcagaatatattccagggataagggaagaggacagggctctgcctaccgatgtgcttcaacaagggattacatgggggcaaagcttcattctttgaatatgagtgttctttataaaataacaacaacaataaaaacctaaagtactttggtgctacttgtgagtggtggtcaggctagtaaagttggtcaaaaacaaagtacaaactccaaaattagccagcggtgtatatgtgtgtgtgtgtgagagagagagagaaagagagagagagagtgtgtgtgtgtgtgtgtgagagagagagagagagagaaagagagagagagtgtgtgtgtgtgtgtgtgtgtgtgtgtgtgtgtgtgtgtgtgtgttggggagaaggagaagagacaaagaaagtttgtatttttttaactttcaaagaagacaattcctagaaattcctgaagtgttttgagcaacatcaacattgtcgttggaatatttcctttttacccccaagtggacttatttgaaggaagagaaaatgctcttccaagaacactagagagcctgaccctggggtaagcacccactctagaatagccccagggcaggagtggcaaataggcttcatcttgcctgaaaattctcagtgcctcactctctctcttcaagctttacaccaggaagatttatgagaacagcgggcaaatccacaggtaggagatctagcttccattagtcatgtctgccacatgtgccgatgtgaggttttgtgaacgtgcactacacattcatcacatctgctttaagctccacagtattcctccacacgtgctccaattttcccatttcttttcctttgttatcctgaaatccctatgtattaaaatttctttggaaaagcagtatcttaagctcatgttgcactgcaagtcctggaatgatttatcaattcatctgaagtagtcaatcttattgccatccttctcataccagcctaaagtcagctcctgtgacagaatttaagttttgataggagagttggacagaaaggaagaaaagtggccatggctagtttggggatgtgcaatgttgtgtgggatggtagaaatgagtgggaaaacttgggcaaaatgaaggcatttgtgtcctagattgagtaactggggcaaatgaagaaagggtcaccaagacagttgagtgctatgagcacttttcttcttttatgtatgtattttaagttcaggggtacaagtgcaggtttgtaggcttgttacataggtaaactcgtgtcatgggggtttgttgtacagattatttcatcgcccaggtattaagcttaatatccattagttatttttcttgatcctctccctcctcccaccctccaccctcccaaaggcccagtgtgtgttgttctcctctatgtgtccatgtgttctcatcatttagcttccacttataagggagaacatgcagtatttggttttctgttcctgtgttactttgctaaagatgatggcctccagctccatccatgtccctgcaaagaacatgatttcattcttttttatggctgaagagcacattttttctatttcatgatttgctcagattgtctttcattctggccaagggagcagaggctcttatttctcttgctactttcttttaaacctaaagtcttcccactcatctgggccttataaaagttaaataggttttgacaaaaagtgttgaacaacacaggcctttggtcattttaaaaaatcagagagggccaggagataaaaatgatttagaaattgcttgcttcaaattaactaacatttctttgtttttggttcacattccatgatgcaatattttctgaatgaattataaactgttatattaataaaattttgaattaagcatgtttgaaaaaggcaaagagatctttattgaagtatatgtgcatgaaatgagattctgtagagcgagggtgtcttagggtagaggaattttttaaaatctatttcaaatgttagtttccttccattgaaatcgattgttgaggaattaaagctcaattttggagaaaagctgctatcgcttgcgagtgacatctgcctattgaccccacatctaggctttaaggagcggtgtcatgttacactcaccttcatttatacaacagggaaaaaaaactgaataggactagagaagagattggcatgaagtgcttgttattactatcatgaaactcttgtcaacctctttcaccatctgcaaaatagaaggtcggggagaactgggcaataattagcttccctttatgtagttaatgctgagtgtaaaaaagacatcctattaatttctttctctctgtatgtaatttacagtaaatcctcttggattcattttttaattatgagcctttcaggaacagtgaaaatttatgtgttaagatatctgttttgtttgacaagaatctataaccttccccaactatttccttcctgacttaaaatgtagattgttacatacacgaggatgaggggcagacaaagaactgctgtccagactgacccccatttcacggtggcaaagtgttctccttccaaaaactggaactttgaaaacagattgataatattctatcagtgtcatatttggggaaactggatatttattaagtttcacttgtatattattgtttttacatagtttatagcacccaacgagagtcctgtagaataaatggaagtaaagctgaatgatgatgaatggtctgttcctcccatctattgcatttataaattgccagcctggatgcttcatttgggctgtctctatgtgggatatttacagtaaacgatcagcatctgctgggatagtccttagtaaggttaggtggctgttagcttagattcatctctgggtttggccagtgacagaattggatttgagtcaagaactgtatttggggaactttccagtggagtacagaagaatgttggtgtttttgagactggtaacgcaaataaaaaaggaacgaacaagaaaacaacagaggtatccaacagatgcaatttcgtttcccatggagtgctgtgcactgcaggttgactccgtatttccttccatcgctatttgttcttagtgaaaaagacctctttgggatttctgagcttaggagtttttccagatcattagccacttatacggagaggacctgctgggcattgtctctccagctttcagcttagccatgctatcccagcagagtcggagaagaaggtgggagaagggagtagaagtgatgattggatgaagtgactgcttatgtaacctggactagaggcagctctctgcaggggagctggtgtgtgttttctcagatctctattattcccatgatatttctatctaaatctgtttactttgattccacacatggttttgagaggcagcaagccatagtagaaagatgtgcttaatttgaaaccaaaaaaaagttggatttgagttccatttttcaatccatttctgtcagtgagctatgtgactttcagcaagtcattctactacttggagcttcagcttcctcttcttataaatgggcataaaatattatgttgcagggttttctcaaagatcaagtgaaataaaatatttagaagctgttcattatcagcaaaacactgcactaatggagaatggtggttttcctaataaaatgggtgctgtagaggtgatgactgcattagagaaacatatatagaaggaaagttttagtttaattgtttgtataagtctgcttggactttttaggcaaaattttttaatttctgtttcatctgatcaaatgtcaattttatgaattaaccagattcacaatgaagacttttggagcatctctttagcataaagtgaagaagcagttacctctgagggaatttaggtcatgaccttggttaggtcaataggataagtgaccctatagcctccttggtgtctcattatatagcgttgtgtctctatccctgttacaagatgataatgcattgcgcttctattctctttagtataagcttccaaagggctctagactcagcagtgaaattgtcgcctgccttgccctgaagtttattctttaattttatcgaccatgggaaatgggaatatgccactttgcatgaaaacagggaaagaagagaagaaggaagagagggaaagaggaggaggaaggaggaggagaataaggaaaataaaagagcaagaagaagatgacaatagccatgaccatcaccaccaccaatagaagtagtagcagtaggaaagcaaaacctttctagataggcctagtatcaaaatggttttagactctccttgggtaccagataaagtcacaaagagcttggtcgtatactcggggatagagcccccacaaaatgttgctagaaccaaagtcctaatggaggtacagccagactgtggggagctaagtaggtcttgccaccaagtacactggaaacctaaaaccagaaatataaacagaaatacttcatagatttggattccccaaaatatgaaggaaaagtgaattataaatttactatgcaaatgaaatgtacaataatgcaatcataaaaatcaagctgacaaagtgtgtggaaaataggttatggctgataggaaattatgagaaggaaaggccaaatggctatatctttctcatttatggttcatacaagagcccttagactgttagttaatgacagttatgtttcagaatcctcaatgcatacaaataagaattttgaaaaactaagatgaagagaatttagctcctgagcatcattcattttatatatatataaattgagtttttattatgtgtcaggaaaagtgctgtgtgttgagggtactgtgaccaaccttggcttgcatagcataaacaggcttgagaggccacgacaattacaaaaacaagaaattaggttttctactcattatgaggtgatgtatatacaactcttgcacaactcctggcatatagtgagctttcaatcatggatagattttgatattattggtactcaaagatttttcttcaactaactcattttaactcaaaaacttgttatattttattttcctaagcaatgaataaactttaatcaggcctctgaaatttgaaatgaagcaatataaaattctaaggagctgggatattactgatttaaagacagctgggtggcacatatactgggttattgcagttatcaagctagctgaataagttctgaatagcagaagctttttagatatatgaatctaaaatgcaacaagcaaggcaaactctaagtgccatcacgtgaatgctggggctcacaggacttaatggcaagcctcccttaacaccatcagttggatgaattatctcattgacccaccgcttacactgctccttgtcattactcctggggtattgttcagtgcaacagggcaagaaataactcattgactccctgaagctatagatgatggattttagatccctagctgtattcagaaggcataggagctcagtgtattgatgggggaattcattagccacccactccacagaatcagtttcttagatcctggtgctgtcactgctgctgttgcaacttgttagtgtttcagggacagacgtcagagggaactgtataactacattagcctcacagatagtaccgacagccagacctgtcatttcctggcctgcgatgacacctctggagcctagaatcacttaaagatatttagataggccctgttgatacgaccaagctaaccttcatcctgaaatcaattcatactcaggatgacaggaaatgagttgtcattaaggctcatattctatttttgagtccttagttaacctcttataattcagtttatttttcctcctccatttctgtaaaatggcaggtaatttaatgacatagattattacttcctacatttactcgggagcatgtgtttcagagaccatcttacattgataccattactatcactttccgctaatattgattgacaaaataccaggtaccagacactgtgcaagaactttgtttacactgtcttataatgagctcatgaccactcagtgaggtagtcactattaatatcctcattttataattggggcaactaaagtttgaagaagctaaagcattttcccaagatagcactactaataaacagctgaatgggctttcaaatgcaattctgacccttaattactattacacccctaatgaaagttttagagtagaaagcatagtggtaataattttaactcaattcatacttatgaaacagcaatttacttgggattgttggagatgtgaagaaagttaatatctagccggggggtagaggggaatgaaaatcatatgtacgaatctttttaaaaacagaatcagctatataccaaagaaggtaaaaatactgctggttgctgagatttttttttttaatgtacatagatgggatgggacagattttgactagtggaatctgaagaaagagcatacctgatgaagataccagcatgagtgtcatatcaaaggaaatacaggatgtgttctcaaattcatgaattcaattggaccgtaatgaatggcataagaaaagaggcaggtaatatggattagcacaaagaacatatgatttaggggcaattggtctctgattcaaggtctagttctgcctccaactagttctgtagcctcggatgaattatttgactactccgtaaaatgcagatggcaataatgccaatttgtagctctgtgaatatttataacctatggaaaaatgcccagtgaattatctggtacatagtggatgttccattaatgatagccatgttcttgtgttttcttcccaggtactttagggacatagtgtagaagatttgagttttataccaatgatcgattgtttctgaaagcaaaaggaagacatttaaagatttttttagaagaagatgaaatgcccagcacttaatttttagggagattattttggctctgttaaaagaatgttgttcagtgggttcaaggaaaacagcagggtcttgagtaagtgtttctagagaaacgtctttaaagacttattctatgatgatgcatataggaaggtaatgaggataaaaccaaagaacagttcagagattgaatcggcaggtgttgtcagcaggttggattaaaaaggagagaactgagaaatgtctagattgggaaggttgtgatttcattaccaaaaacaaaacaggggacagataagtaaaacagataagagtttgactttagtgatgcaaaacataaggcatccaagagccaggctattgaaatttccaattggaaatacatgatgaactcagaggagagataagggctagaggtgggggcctagagaattcacagcttggcagtgacagtggaaggtttaaggagtgctaatgtctcaagggagatgaataggaacttgggaaatatatacatatttttatatatttaaatatatattattttatatatttatacaaatatatataatgtatattaaatatatacatatacaagataaaggaggaaaggaagagaactaaaaaggaaaggctagagggtaggggataacctagatagtgaagttttacagaaatcaaaacaaatgagagacttccaaacacaagttgttccagagctgttttttctatacctgttaggcctctttcatctgaaatcagtttacagagatgtcttcttcatctttattggtatttattatggtgtaatctttgccacttcagtcctcttaccagtattctgcatttcttctctgtcacgggcatcattaactttgagccagaggacccagcatctactcctagagagctgccaccaattagcagttaccctatgtaaatggtagaggtgtagctactattctgccaccctcgtaatattgtgggaaaaatccaatgacagaatgcaagtgagcatgccgtgtcatcattgaaaagtcctacaaaataaataaagtcgtttttatatcaatattggtatacctaccactcagcacagctcttggtacctaaggagatggtgattggagacctggaaatgaagaccaaagagatgctgagatggttgtagtttccaataggaagattagcaaccaggcaagtggcagatcagagcccaaatgtgagtggctcaactgctggaccctgtaagctgttgtggttctcaaatgatgtccttatcttgttcatctctcagctcttggcacctcaccttttggagcttcagtttggaaagggcaattcggatttaaatcatactgcagtttcctaaatagaacaaatcccctgatcctagtgatcatgtgcaatgaggcatggaatctgattacccttatcattatcttagcttggatagctacaaacgttactaaatggttatgaaattatctagccctttattaagtgcaaaaggtagtacttaggttactaaacttttttgaaaataattccgctggctgacttttcatggctaaaaacccatattcttatctgtggagtgtatctttttgtaatcacatctgtgtttgctgtttttttaattgtccaggcagtatgttagccattttgtgtctatcagcccatttggtcctgacaacactgttaaactagtggcattacctctattttatgaagtaaaaaattaagcctaagaggattaagtaaccatttgttaaaggtgttaaggaaagaaaagaggacttagacttaatcattgatatgtttgttttcagtgtcatagatatagatatatactgcttttcataattttctattcaatataatataatatatatgtaatatatgttggatgtgttgaatttagcaggacctgtaatatttatttaaatccacagttaagaatgataaacaggactagagaatggaacacagaattttggctaaagcagcatacataacttaaaataagtcactttctttttggattcaaagaaactcattttacattacattttttgcttcccagtatttgtttttctcaatgacgttaaggcacctaattacccccaagccactttcttaaatactcctatgcaaaatgaaaagattggcctggagactaatctgaggttttgaatgcagtgcggtagaataagtgttttagaggtaactttagttcccaaatctcaataaaaacacttccaaatttagtgtatcaaagaaaagattattggataatgcattctcatctttcggtgtatgataaatgccatatcagaagtcctcaaatactcttgattaaaaacgctaaatgatctcaaataacacaaaaacccatttattcctactggagtcagtatttaattttctatatttgtaatttaaatccagatgtgggtgtcttcacagcgaccatggcctgtcatcccttggtctgttagcttctaatgtctagcagcagagtatagtaaatacttgaaaggtagaccttcacactgaaaatcacatttattgaagtgggagcagattccatttaaattgtcccttacctgatgcctaattcctaaggttaacaggttttcatgtttgctacttatatcagcagtactggagctggtttttttgcatggctaaacagcaaagcttaaattcaatactagagcgtgaaagaggaaaatgagttttggtgtgacgtgtgaatgacgtggttttcctaaataccatgaatgcacaatgaatgatccacaaagcacagccgcctcttaaaagaagacaaaaatctccctgaggtttagttgagaaaagatacaggagcatatagcaaaaactacaacatgatacacttacgtaagatgcaggtgggaagaatagaatttccaaattaaaattagccaggccagcagaaatgagtaacctaatgttatggcttggatccgtgtccccatccaaatgtcctgttcaattgtaatccccagtattggaggtgggccttggagggaggtggttggatcatgggagtggtttttaatggtttagcaccgtccccctagtgctgtccttgtgatagagttctcataagatctggttgtgtaaaagtgtgtagcaccttcccctctctcttcctcttgctccagacatgtaagatgtgctagcttcccctttgcctcctgccatgattgtaagtttcctgaggcctccccagccatgcttcctatataccctatggaaccatgagccaattaaaccccttttcttataaattacccactctcaggtatttctttatatcaatgccagaaaggactaatacacttactttcgtgaaaacaacttttctcttaaccacctcctactgtctgtcaagtgtagttctaagtgcttgggatccaagagtgaaaaggatagacaaactccctgtcctcatggtacttacattctagtgggggagtccttaatgggcacaagcaatcagaacttcaatttgcagaattttgtgaaaatgtgctatcatatatattttattaattaactagttaacaggcagggaggatctccttcaaacttttgttttcatctttgtatttttctttctttgccaaatttccactttaatctctttcattctaatatgctcacgagtcacttaatgaggaggatatgttctgggaaatgccctgccaggcaatcttattgttgtgtgaacatcatagagtgtacttacacaaacctagatgttatagcctactacactcctagctatatggtatagcctattgcatccaggctataaacctgcacagcgtgttcctgtgacgaatactgtaggcaattgtaatgcagtggtatgtgtgtagctaaacatgtctaaataaaaaagcacagtaaaaatgcagtattgtaattttatgggaatgtaacaacccagtgggttctgtttgtccactgcccagatggagccaatttatcaagacaggtgaattgcagtagagaaagagtttaatacatgtagagctggctaaatgggagaccaaagtttgattatcactcaaatcagtctccttgaaaatttggaggctagggtttttccaagacagctcggcaggtaggggtctgggggatgggtgctgctgattggttagggatgcaattatgggatctggaaaatggtccttatgcactgagtctgcttctgggtgggggccacaggactggttgagtcaagagttgtgggcccaggtgggggacatctgattgtcagaagtgcaaaagcctgaaatgacatctcaaaaaggccaatcttagctgctacaattagggatgttcattataggagtaagtgggaaagttgcaaatcttgtgacctccggaataatggttggtaattatttaactctgcctgcatcttagcataattcaggtgtctctcatcctcttaacctggtggctttcattagttttacaaagcagtttagtttttgtgaatggttattatcatttaaactctaaactaaatttctcccaaagttagcttggcccatgcccaggaatgaccaaggtcaaagaagtttggaggttagggcaagatggaattggttagatcaggtctctttcactgtcataattttctcactgttatatattttgcaacagcagtttcaggaccaccttcacatactcagtctatcattaaccaaaatgtcactgtgttgctcatgactgtaatcaaaaaagcacagagagctctctcgctatctggttctatttctaccaccctgacaaccactatagtttgttttcaacaccaaaagaaaataacaaaaaaatagcatcttcaccctcgattctagtttcttttttcttgaaatgactatggccatttctattatttcattttgaaattgtgcagaattccttctgaacatccatctacatttcacagacaacaaattgctaaaaacacctaaacaccactaacctgggggggagaaaaaaaaacaaccaaaaacaaccaaacaaaccaaagaaaacaaatcaaccaaatgaaaacccaccctctctggtggaaagactgcaccatttttggtaaagactttgcaatcctgcctagactggatgactgcctattgccctaacactttccttcctacccccagttatttacaagatcaccccttatggtaacagtattagtacaaatgaggtttttccctttacttaactgaatgctagaagaaacagaatggaaccacatgttccctttgattcacacccaaacactgcaaaacacagagtattcgcttcctttttcaagctgtgtgtgcacattaaacacatgcaaacattggactgaaacagacacagtaagtcagctctaggggaaaactatagaagtctttttattttgtttctctaaatctcaatcttttatttaagctaggtctttgcagagattcaaagaatgatattttgtaatggttctccaaagagcagttagatgtgtctcatccaaatttgtgtatttaccttatcatcacagatactgttctggaactgggaacttagcattagctctcttcttagaaatgactattaatttttgataaaaagaataaaaaacaccacattacataatggatataagagaacatagacggcatgataggaatattctgcctgtgtttccatgaattgcttctttgttaaaaagtgtttggtataaattaggccagtggtgtcccagcactttgggaggccaaggcaggaggattgcttgaggtgaggtgtttggtataaacagtatattaacaaagaattctcctatggtataaaccctaactctagcaggaagatcaaatttctctttgaggcatgcagtctgagctccagtgactctctgcaagagaaaagctgatattgtcacattgtgagtcatagtgactcccaaggatgtatttgtgtggatgtggttggtcagaaggctttgtgtgcactgtgacatctttatgctgcagatgccaagatcacagggtccacacagagcagttcatttcacacagtgggaaatgatgcgtgtgtgtgtgtgggtgggtgtgtgtgtgtgttttaaaaaacctaaacagagcaacactgttctgtgcactcaaactctacagctaaccgccaagggccatcttataaatttggacattgaattgctaaaatttgaaaacacagccactcctattcacactctaccatctggaaataaaccctaagtcactgtgggtgtccatatggaagtcactgttctgcttccttttatcttcatggtagttcaaggttcgatttcctcctagggagactttctgttgttcccattgagccagctctgctgtccccactggtcacgaaccggatcagtacatggagattcctgagcatatgcagggcagcggcatgagagcatctaaaatagagtcattcccattgccccagcacatccttccttcctacattcctgggagaaaagagcagaaacaaaggcttttctttcttctctcttttggatgtttggtgatttgcatacagaagttaactcacttcatctactggattccaatcattcccttcctggttcctgatcttagagtacagggtgcttcttgccttccccttgtcaatataagggctttagaaaacgtgcccagctggtattctttaaacctcctccaacgcacaaatatatttttaaatgcagatatttcatatacaagttgatatttctagtttctttttgaaaatcggaaggtttaactctactgggccagtgttattcatagcattggtcaactggagctgaggagccattgccatttttatggatattcttttaagccccccaatctccaccactccctgtcacctcactcagcttcatccatctgcctgacccctggagacatttgattttgtgcttcctctcacacagaacttgtgttcacaatttggggtcataccttcacatattatatgtaaacagcactctggaacgttttcaaagtcacagctattttaggtatttagtttagaagaggttagaagttgacttttacattagtatcttaaaggaatatatttgcctgctcagaaacatctggggcccacatattcagatctttcgtacatataatttgctatatagcataacacattgaatgattttgactcagtagctcgacttattttttgtgttcttttaaaatctttcatattaagcatagaattgtaatttattgatgaatattttattttctgagaaaagttggttattattcttaaaatacattacctataatgttcatgtttcctatgttttaatatataatattacaatattgatgtgtcgtgattttttttggttgttctctaattaggggtctttatatgaatctctgattacttagcagttctctgaagggggcagtctttcagagatgcatttaagagctctgaattctgttaagaatattaaggaacacaatttttaatctttactttttactccagggctttgggctgtctgtatcaaaatgcttcagatacttcctctagggattgctttgcctgttccatccttaagagagtaaagaatttcttctccccaccaccccccaactcctgacaatttcagctaaatttttttcttccattgctttaggccattgcttcaagttatatcaccttctgagactatgaataattctttcccttcaattatattgttaccttgaaggtatttataggctgtgatcaaggcccctggagtcactgctttggcagactttataaatttagctcttaccacttctcctcacattttttatcttccagcctttgtagcactccttttgtgtgtgtgcgtgcctatctgtgtagcttctctgatattttaatatccttcctaaactagggaggtcagaatagcacatcatattccaggtattactgtgagtatcagattttagagagtgaaatcaagggagaggattaccttgaaattgaacttaatctattttgtgactcagaaaaatagacaaaatggtagaaaaagctaacggggcactgtcaacatgttttcatatattttaacgtactgttagagcaatcctggaagcttaagggggaaatgatgatttttcttagagagaattctggcttccattagatgcttgaacgtgtcctttagagtaagattttctttacaaatccaggcttcaaatatggctatgtaataagatgggttttttccatagtacatgagctcttaaatctgtattattgttattattattattattaatattatcagacctgtctttgtggcttaaaattaagaaacatcattaaacatttaattttacaatgaagaaaacaaattgctacgtaaaccatcttgctactagctttaagctctagtccaggtcattctgcattttgtcaatatagtaaattgagtaacagcctctgagggccctgcaaagagccaaggcccaatttaactccctagtgccagggtctccaaatgtttttggttgtctatacatactagaaaaaaattaactctgcaccaattaaaaatatgtatatatgtatgtagaatacacacattgcttatattatcacacatacagaaacatcaggcattttaaaagataagattagatacatatatatcccagtattattccctgaagttcccatgaaccaaccttggcacccctgtggatgcccaccccaacttggagaccactgctgtggtgggaaaaccatggtgacaaacggagccaccaccctcagcagttcccaggaggaaccccagtatcaatggttatgtactgcagagcctataagcgaatatttagttcagacactcattttagatatgaagatatggaggtgcagtgacttacctacctatggttacagagttggatgatgagaaagctgggtgtaaaatgccagccttctaatttatcagatttcaacacatgcagaaaatacatagtgttctgttttagctggaatctcaggaaaatggggactgaggtcctgaatgaatgatgaagaaggagagggtgaatcaatttccaatcggtggtcttaaaggtgaaatattgttagcctaagtaatctctactcttttgtgtcccttctattaaactctctttacaggttctctctctctctctctctctctctctctctctctctctctctctctcccacacacacacaccccaagataaaatccaaagcttctgattcaatagccaacctcttcagcaagaagagcaaaggttctgcagccagattgcctgggttcaaatcctgatcctatcactgaatagcagactttaggcaaattatttatctatgactcagtttcctcatccgttgaaattggggataaaaaagttccataggggttgatgtgagcattaaatgacacctgtaaagcactcggctcactgcctgatcccacgctaatggccctttatatgttagctatttttattattttattctaattcttcctaaaagcttaaagcacagtccttcatatcactgcatcgcatttcattttgtaacatgttcttgtgctacatgtttcaccatgtgctacatggtgaaaggcattttcctacccgctttacaaaaacagacaccgaggcccatgtttagggccaaaatcagtgctgaatgccaggacagactcccaattcagtgtctcgtatcaaactgcatttcctttcaagatgaaaattgttactcaaaaccctatgcagctgggcgggaacacagattccatggtttcctttttcttcctgtttccccaaagcaaagcatctcctctctttgcatgggggatctatccctccagaagtctacccagcctgaggataatggcagctgcagggttacaggggtaactgtccatctgtctgaattctcagttgtgtgagagcctgtgttacaaccttagtagcttctgcacctcactagcttttcccactcccttggagtgcttccattttctccagctttcggtatcagggagtgttattaaatgataaggagctggctggctggttgtgtattgtgagaggctgagaaacaatgagtgttacaacacattagattgcatgttagctctgattttgggaactttgtatcacagagctcatcatgcaacaggactgcatctgggatactgcctcccttccccagagggttattaatgggccttcatacctgggaggacagattacaggagagatgtgataattagagatacttcactgatcataagcaggcccccgagcaccaagggctagcagctgtgttacacatatgaggcaagctccatgctccagagacaaaagtgaagtagaatttgctgcagtgaccttacctaaaagaggtcatctcaaaaatggtcacccatggacattgattggcaattggtttgaatagagaaagagtgttctgagctgaggatcagaagacctgagtttcatttctagttctgccatcatagagctatagggtcttgatgaagagtcacttaacttgtgacagtttttttatataagaaaaatgggagctacatatgtcttacttatcacaagagattgcaactcaaatacttcttcttccaaggtagtagggtggcaacaagagtgtgtgtgtgttctgacgataaaggaaatataagaatattttgaagcaaaagaaggagccagtacaaaggcagaaattgacaacgcatgggagcagaagtggataaaattaaccaagctggggcagaagaaggcagggaagggtgagagaaaaacagtagacggcttaatgtcatcaccaccacaacaaatgatggtgataacttgatgctggtgatgatttggagctcttcctatggagtaagaaagaatgcaagaattgggtcattgaccagaaactctgaggaggaaattaaagaaaattcatatctaggtgtcttaaacttctcagtaaagaaagttttaagctcatcaatcaacaggggcaggggtagatttagggacttgaagaaagtataagatttttagaatgatctctttgggggatcccaaaataagtcaacaaggcatcttttcaatgttgtcttgatctcggagtcagaacaacttgggtttcaacctagctctatcttttttcctcctagagcacccttaagcagatagatgcccataccttacccatcagtactttagggttataatctatatcttgcaggcatgttatgaaaattaaatatgatcacatatgcagtgtgcataacatcatgtttggcacatagtagcctgtcattattttggaaaagtgaccataatgaaagagaatgcatcaaatatataggattgttaaataacaatgtccaatttagaagctgagttgtgttggcctatctgcttgcaccaagattaaataatattctttacaggtgtctacacctttttctctccaaggcatgtcttcagcctcagtgctttcatggctcatattttctcctctcatgctttcctacctgctcatatgatgaaccacatagaggaggtgattctccgaggatttataatgtgtttcctgtgctcctgaattggtgccaatggcacaccaatccagtcgggtgggcctcaaggcacaccttgctcctgactgagaaggaaaaaatctttgtggagtttgcacaggtataccaagtaattgagcatttgcattagtatggaaccacctactacagacaccgggctcgtttcactcaaaggatagcctagaataagcatgaaggacctcctttcagaatcttgtttatgtaaagcccttcttggatttcctctttattatattttacataattgatcacaaatgtgaacatctatggaaatgagttggagtataggcgataattaacctggaagggaagaaaacccttcaccagaagcaaatagatacccctgcaaatatctggtaatttcggccgggcgtggtggctcacacctgtagtcccagcactttgggaggctgagatgggcggatcacgagctcaggagatcaagaccatcctggctaacacgttgaaactccacctctactaaaaatacaaaaaattagccgggcatggtggcaggcacctgtagtcccagctactcgggaggctgaggcaggagaatggcgtgaacctgggaggcagagcttgcagtgagccgagatcacgccactgcactccagcgtgggggacagagcaatactccatctcaaaaaaaaaaaaaaaaaaaaaatctggtaatttctctttcattagaaagctccaagtgaggtacaaactcaattcaaatattctatgagaataaaaacaggcttatacccaaagataggcaataacaaatgctggtgataacatggagaaaagggaaccactgaacactgttggttggaatgtaaattagtacaatcactatagagaacagtttggaggttcctcaaaaactaaaaaattgagctaccatatgatctatcaatcccactgctgggtaaatacccaaaagaaagaaaatcagtatatcaaagagatatctgcagtcctatgtttgttgcagcacttttcacaatagctaatgaatggaagcaacctaagtgtccattaacagatgaatggatagaaaaaatgtggtacatatacacaatggagtactattcagtcataaaaaaagaataagatccagtcatttgcaatcatatggctggaactagagaacattatgttaagtgaaataagccaagcacagagagacaaatatcatacgttcttacatatttgtgggatctgaaaatcaaaacaattgaactcatgggcatagagaatagaaggatggttaccagaggctgggaagggaagtgggggttgggggaggtgggggtggttaatgagtattaaaaaaaaaatagaaggaatgaataaaacttatctggtagcacaacagggtgactgtagtcgataataactcatctgtacattttaaagtaaagagtataattggattgtttgcaactcaatggataaatgtttgaggggatggatactgcattcttcatgatgtgattattgcacattgcatgcctgtatcaaaacatctcacatacttcataaatatatacacctactatgtacccacaaatttaaaaaaaatgaataaaaacatccttcaaacgaagtggctattttgttgcaaaaaataactattacttctcaagcactgactgagtgccagggtgtatatgtatgtgagtatgtgcgtgtgtgtgttttgttctgttttttctcttgtaaatccgtcaaagattgcaaaggtaggaactattatcctgatttttcaagtcagaatccaaaatttagtgaggttaagtgacttgccaccatgcttgctgctcacaagtagctgaggcaaaatttgaatccattttgcctggagcccaagcccaggttctttctcctaactgggatgtcctgatgcctacacaatctgctcagtgaattactcagcctccatgtttttctattctatggcacccctacgtcatactagccactagagtgaaaagtgataagatgaaaccaagagattgtcttatcagcttctccattcacatgtcttaaatgatttctacctttactaacaagagaaaaatccaggtacattctggggaaaccattagtgcttagttggtaaaatcttgagacttttatcttactagtagaccctcaacatttttccaaagaggcactaatgtaccctgtaaagaaatgacatttttcgtctcaaaaaaaagcaaaaacaaaaaagaaatggctacttttcaccctaaaataaaaaagtgtgtgtgtgtgtgtgagagaaagagagagagagagagagaatgaatctatctccaaatgccaatgagcatgatggactagtggcaagactttctacagaatatgtaatttggtttaggcagggcaatctcctttgtatgaagtaaatagtaaattcagttacagtatatataaacattaagaagaatcttcttctgtttaaatattgcttcttaaaatttgttttgctatttaaaaaattcattttgaagttacaagtgtctctcctaaggagacaattctctgacaaacataaccaactggcaattacaaatcataattgtgactcagaccaatattaagtgagcaccttcctgctttctcgtagatgaatgtctataagttgttagtgcacatactgaactagaaagcccacatcaggaaggtactgctctttttttgttactgttaaatttgcttggccaactcagaatgaatatccagatttctcaactcttgagttagtggatatataaactccaaaaaaattaattaaaattgaagtttaaattttaatactgagaaaaatagttgattagctagaaaaatcaccctaaacataattatatgtatcagtaagtcaaggaaaaaattaaatttgtcaataggtccctattctccagtgctgtcttttcaaagttactttgcaaggtattcagttttagtgctaacgtatcaatcttttttttttggtgggcgggggatgggggcagggtctcactctgttgcccaggctggagtgcagtggcgccatctcgccttaccacaacccctgtcacccaggttcaagtgattctcctgccttagcctcttgagtagctgggattacaggcacgtgctaccatgcccagctaacttttgtacctttagtaaagatgggttttcgccgtgttggccaggatggtctcgaactccagacctcaatgatccacctgccttgtcctcccaaagtgctgggattacaggggttagccaccatgcctggctaatgtatcattttctagaatacatttatcaatgaaattttcaaagaaccttattggtatggtgaattatgtaaagtctcagaagattacttttgactttccacggccagatactcttgactcacttctatcaatcatgcattggaaatactctgacatcgtcaattctaccgtgatctactcaagcatctcacctgtttccttccagaaagcatgttttaatgttggagattcattggctagtaaatgtatagtgtcttaaatgatgtcaaatgaagaaatgccaaaaacatgcccaacaggaacagcaaagtatttaccttcatgtgtaaaatgccagtgtgagatagcccaatgtgatattgaactggatcaatggtggggtgccagcacatgaggaatcgacattaattcaagttgggacacagaagttggcattgtgaagatttttaaattctaggactaaatggatgatccactgggaggcaatgtccagacagatcaataccacacaaaacgttaattgcttttcttggtgaatcctaagaaagtgctggggctttagggaaattgagagagatttcttttcttccccctccacaaaaggtaattaatgagtacaacagacaattcaaagcaagaaaatagaatctgaaagcttgaaagccatacattcagaatccatttagagatttacagaagggctttagcccagaacagtgcctacaggagctacagtggtgacagtgtctccttgatagatgcatcctggaatcttctactgggcaagcatccaaaaatatttgaacaaatgaggtatgccttccagcatagctgggtagttagaaaagagtcaaacatatagaaaaaaagcatagtgactgaagtcatcttaaagctagtttacaaatgtagtctgaaatacactctatcacgggatgaataggtatggattttattccaactatgatctactgtgctttctgggactgtaaaaagtgactacaccatccattaataatatataggaaggcagtttgggaatgtcaacccaaagcctcttcgtaccttgaaattcccatgcaatttggttacacagagtatatcattactcaggttaatattataagacaagtattagcattatgtttgaacaaaggttttcacaaggtctatattaactttacaaaggttctgctgtatactgaatgacaaaggctgtcacagtagcgaccaatttgttccaatttgcttacttctccagatctctctgtcagactttaagttccttgaatatagggtcctagtcttcttgcccatccttgtatacatggtaggtgttccatcaatgtttcttgaatgaatgtataaaaagtgtattttaattgaaatcttaacaagtatgcattaaatgtatagttggtgcttggtactaattctctcaccagtttattgaaatttgactatatttgagcttgaaatggtatacctacagatatagatcattaaaaccaaacaaaaccctttctttatgatatcaagagatttgcctcctaacataaaaatgaataatcactgtctaccctaatggattagactttcttcattagcctcctgtttcttctgagaaatggctacattttcagaaactctgactcctaaagggggtcagtaactctgggaagactatttctattacgtgaaaatttcaaataatctcctagaaacttgaaaactggttatacacagaaagcaaaagaggtgaaaagtgagttgcagtttcattaaacatggtcatcctccaacaccgtctttcttaccagccttgcatgaaacgtcattaagatgcatcttttatgcaagggaccaaaaagggtactacttttaaaatatagcaaaaacaggggttgcagttgcccttttattgagggtcagtttatatatgtagtctgatatatatttcatccagaaatatagttttttaaactttttatcgtgaaataattttagatttgcagaaaagttgtaaagattatatagtttctttaaacccttcactgagcttccactaacgttaaaatattatgtaaccgtgatacatggtttgaaactaagaaattaacatctgtacaatacaatttgctcagataatcccagtttttccactactgtcctttgtatgtgtcagaatccaatccaggataccacattttatgtagctgtcctgtctccttagtttcttctaatttgtgataatctacaaatactttttaattgaaagaattatctaaacgtatatttgtcagatcaataccgtcctttctatctttcctttctccactgaacttgggcgtcagtctctttcttggctactaactctaatttatgcattggatattttactactttgggctcattattttaaaaatctgcaagcagacacagtagtctaggactgttcctgaggctggagggccagggtatagcatgtgcgcaggccaccaaggccagccttgtcattgattctgctttgttaccaagcaactgagatcgctcccactaaagaaaaagaagcaccacttccacttcaaaggtaaatgtgttgaaaaaagaacagaattgacacagcttcctttatcccttaggtacaaggatgccatgcctagtcagagttctgaattcaggttctcaaagcaggaacagggagatgcagcagctgcagttgggaactcttctttctttctacattttttttttctttttgaaagtccacatctctatcaatccagaatcctaattacatatgatataaagggccctcaaaagacccattacccctgttaaagtatgtaaattcaggggcaaattatatgaataatggctaacatttattgagcgcttattacatgtcaggcactgttcttctaagcattttacatttaatccttacaacaaccctgtgatgtaggactgattattaatactattttacagataagaaaactgaaatacacaatagataggaaaattgctcaaagttgcacagctagtaattgaataatcttccaaaatcttttttatttaggtaatagtatttttgataaataatttatatattttatgaagacctttacaatgatggtgttattccatttccaccctagattaaattagcatcttgagaaaaagccataaacccagtgatcaaagtcgatggtatttattttatgtttaaaaggtgtcatctctatcgagtagtcaagtgctaaaaaaaaaaaacaaaaaacaaaaaaacaaaaaatccagtcaacagaaacttaaacacttgagggcaaacattgagcaatgttggggttttgttaccttgcactaattttgggtttaagaagggaaggaaatgatgttcgtaatccagtgttctggaaggaggagtgcttttggtagattaatttacaaagttttctgctgacaaaagaaagggaaaggaaaaaaatcagataataattccctttacaggcctaatttgaacttaattctctctctctctctctctctctcacacacacacacacacagacacacacacacacacacacgacaactgtgagctgtaaatccatggtcatctagttactagcgcagtaagagcagttgtctgatctgatcaaagagtgtcatgctccaaaaaatctgatctgtggtgaaaatagattccccctggatactatccagggattagatattttcagagaccaaaaatacagtgaagtgccctcagcaagatagaacacagtgtagtcattcttggtgaattggaaggattttgccgcagggctgtcattatgaacatcagtgatcattgtaagaatatggaaaagtgctagtgaataggagtcccaattacagaacactgggtgatacagcctttgctataattatagtgtgtttagattgatgggcctaatgagcagtgttccttaatctaaatgttgattttggagcgagttaaaattagaggtaaaactgtgatagtaagtttgtttactagattgactatgtggctccacgtagaattcagattagttcaactaacacttcctcagcaccaaacccttgtcaggccttgggctaggtcctggagacccaaaagcagatgaagtcctcagggagttacagcccagcatgggagagggcatttcaacggcattagtaatagcagtggatatgaattgagcctttgccagatgctaaacacttgttctaaaccctctgcgggtattaatccatttactcactccaccataaccccacaaagttgggactaggtgagaggggagccaacaggcctggaagactacagtaacttttccaagcttatatgtgtgataagtggcagagcagagcttaaacctggtccggaccttgggttcttaactctaaccttagtattccagagaagatttcaatatacagtagttcactgtcctgggaccaagaagaggtacaattaaccatgttgcctatgctgctggtgatgaagccagaacgtaaacagaatgatttatcctcactcctttgttcgtgaacaaaggaaccataatcccccatgaaccattctggcctctttactatcctccagacaggttgatcttgtttctacctcagagcctttgctcttgttgacctgagtgtcccatcccagataccgttgtatggcccttccactcaatcctttcccacctccctccaaatgttaccttattaatgaagacttccctagctcattctattttatctgcctttcttccttatcccacctccctgcagttccttctcccttaccctgccttactttttcccacagattttaccattagcaatactattaatttctttttacttgggtttttgttggtttgtgtgtctgcctccccacactagaacacaggctcccaggggttagtgactttttaaatattgtttgtcactgaatttccaatgcctaaaataggacctgaccacatctgagtttaatatatacttttagatttagtgaattaaaaagccagaatgaggctgggcacggtggctcacgcctgtaatcccagcactttgggaggccgaggtgggtggatcacgaggtcaggagctcgagaccagcctggccaacatagtgaaaccccgtctctactaaaatacaaaaattaactgggcatagtggtgcgcccctgtagtcccagctacttggaaggctgaggcaagagaatcacttgaacccaggatgcagaggttgtggtgagccgagatcatgccactgcactccagcctaggcaacagagcgagattctgtctcagaaaacaaacaaacaaacaaacaaaaaaaaccaggaagaacatattccaaagtgtttaaaatagttatatctgagcgtcggaattatactattttaaatacacttttaccaagtttcctataatgagcatgcgttctatgagaaaagggctaaaaatagatgaaagttaaacattagtcactaattcatctcataaacctacttactcctgggaactattaacttctgtgttattattgcacattgggtttttatacatggtagatgctattatcgaggatcccttggggaaggtttgtgtatgaaatgatcatttctttcctgcttactccagattgagattgccagccttgactcacctgagcgggagactcacatgtgagactgcccgtgtgaagagcttccactgtgatacccagtaggcatctgaaaagcatcaggtccaaaatggaattcttgatcccccaacctgctccttacagagtgatccttgtctcagtaattccaacatccatcagttgtgtgatccaaaaacttagaactcatacctccctttcctcatgcccacagtttgttcatacaaagttctatagaatctacctcccgaatacattcaaaattagaccacttctcactgcaactcaataccatgctcctcacttccatctctactactcgaagccactcgagtcatctcttacctgaattgctgcaagcactttccagctggtatgtttgtttccaatcttttatttcattattttttaagagacagggtcttgctctgtgtcccatgctggagtgcagtggcacaatcatagctcactacagcctcaaactcctagagtcaagtgatgctcctgtctcagcctcttgagtagttgggactacaggcacacaccattatgcccagttaacttttttctttctatagaaatggaggtctcactatgttgctcagggtggtcttgaattcctctttctagttttctctgacactctcactccctgccaatcttttctcctcaaagaagccagaatggtattttttaaaaaatataatcagcctttattaccaaccacccccaattaaaatcctcatgtagctttatattatattaccaatccaatctaagtgcattaccaaagctttgaagaccctgtttgatcctacctctcaataccctccagaacatcctcctcgtctaccactttcctccacatctaccacaccctgggctgtttgtcaaacatgcctggtttgttctagctttgagcttttctctgtctgggagacttcttccttcagcaccagagctgacttttccttgttttatacatagtgagatgtcagctcagatgttacctcctcaaaatgatctttttgatcatcataacttagtaagctctctccctccaccagtcacactgtcccacatctcttcattctgtccagtattagtctgtaattaccatgtgcttacatgtttaatatctgcctcacttttgaatgaaagtatcaaggggaaaaggaatgtgactgtttaaatcactgctataacttcagtatccaaaacagtgcctggctcatagtgaacccttcataaatagtcactgaatgaaggaataaaggattggagcaatgaatgtttttgtgacatctagatgaaaattagagatgataaccggtgcaattttgatcatctatctcccttcataccagccaccctaatctaggggactagaataccgaaagaaaatttgcttctacgaacaaggtaatgtcatgatatggactgactcatttatttgttcatttgttcattcattccttcatcattcttcactcatcagacatgtagtgaggactttctttatattaggccccctgtgtttggttttctgtcagttatcttagggtcgtgtgtgtgtgtgtgtgtgtgtgtgtgtgtgtgtgttaaaggacgaataaagtaaataaactaatgcaatgtaagaagtgttgtggttttttagtaaaggttataaatctagacttatgtgcgtattgttttgagaatacaaagaaaggtgcttctgtttctgtttatgggaagtcactttacagacatttatctttaagtcatgatagatgaatttctcatatgggcagttttcctaaatctgagttttagcataatgagatctggagaaaaagaaggcaaaaaaaaaaaaaaaaaaaacccataggaaatgatacagagactaatgatcatttacccaaataaaacagataccattcaaagttagacactgagcctctggtaatccctgttcttctccttcatcttgagcgagggatactgaaaaagactgggctggctactgtttaatcagggaatgatgaatacttttcattagcccaagaaaagttagtttctattccagaaatattttgtaaagaccagttaaaattattaactattatgcatcacttgtcaactataggaagcattactgcaacctctccatagatgattagaataattgctgtcctttcatctttcccatctaacaatactcacccagtacctcccactttcgtttgtgtcttagtatgctgcatgtatctgctttgctaagagaacatcaaggcttggcataattgggctatttccctgtcatactggtttgcttctaaatctgcctcctctgtgggttgcagtgaggtcaatcagatgcagtcaaatggcagagaagatattaaaagtacatatatcctagaactaaatatacaccatctgtgaacttcagttacaaagggaaacttctcttaatatgaccttaggtaaagccattggcagttttattgtatctgtcagcaatcaccaatagctttgattaacaacatgactaatacataagttatgttggtctctttttttcataaataataagagatagggtttctaccaacacaacatttctcatacttgcctgatcattagaccaactgtggcacctgagaaaaatatgccacagacctactaaatcaaaagttccaacaggcctagggatctgtatagttcataaaaactccaggggatttgattatcaggcgaagtttggggagctttgtatgaataatattcaatgaattgtttgtatgtctgtccgatgctttccagactgggttaatgcctgggtctctttctttaattaagctttgattaagatgctcccagcaaatcccacactgaacatttccattgccccctccctcccccgcttctactatgagagaccgagatccatgtgaggtattctgtgatgaagatcttgttctgtttttattattaagcgtacatcttccccttttctgatattaccactatgcatcatcagttaagctgtcaccaacctgacctctgaggcattggaatcattcacttgatgaagcttactttggcataagctaagggttaggaaaaccaacagatttctaaaatattgtgcatggaagggccactggaagtcctccatcacagcctgatagctacaaaaatgagggaacaaaggcccttgagggacttgccaaagtcaaatagtcaattacagtgagagtttggactaaatctcctggttccaattattacattcttcctatgacaccattccctgattcctacaaccaaattagcctcctctttgagctttagttttccctctaggaaaaaaaaaaaaagcatgttagacgaggtcagggactctaaaactgagaccctaggttcagttaaaatgctgggaaggctactgtgataggggtggatgtcggagaggaaggacagaggtggggcttcccctagttatatttttatctgattgggatattgaaattatattaagaatttatttggaaaagccacttctgttactttttaaaaaaagatgtagaggcacaaggctagatgttgatccttgagtgcagatctgattcttacatttggagatccttagaaaagaagtctgtgaaggcaagcatttgtccttttttgtcataaaacctgattcttgggtattcagtgaatgacactcattgaccaactgcaggtctggcatgatcatcacaaagaattggcactttgaaagtgagagaacagtgggaagagaaattcttaggaagcaagctatcttttctaatcctctttaaaaggccaaaatgttcacaactttcccctaaaacagaaaggtgacattgctccttaagcagcagtatcatgcatgctgtcctctgccttcctaagaagtgcagacagagggcagaccctccgagtgaagtacctttttttcttatttgagcctgctctgcattgagggagagtttgacacacctctttagggttctgagaatagttaacagctctaagaaagagatttttgttcataagaaaaaacaagagaaactggaagcagttctcattcatattctctctctcgccacaccccccaccccacctcctcccgcctctccctctccctcttcctctctctccctctcttcagtatctaatgtaaacccaggctttctttatgttctgtgcagttggcctgagttctcttctgttttggtcaagattcaagtggaaaagacctgagcctgtgtctgcctcctttctcctaattttggtttctaatgttttacccaagaagggactagacctttgtttccctactcctttatcatagcatgctggttctcagaccttttctgcacactgctaacatccttctcacctttctttgcttggctttttttttcactgcaagctctcccatgttcatttctcatttgccatcagatttagagtaactggcttatggcatcaaagaatgaatcagatgggagcagctaagtaaactgaatgaagctgcttcctttctcttttcccatccacaaatgataaaatagcctgcccagccaagtgacgtggcattcaggggttatggtggcttggccatttgtttaagtttgcttatttgcagtcacagttctttagtatttcagtgatttggttatcactcaacagtgcacacatttcttctataaaatttgatagttacttatctatctctgatttttccctctgtgttttattatatctagtttaatttttcccctttgttgatttctgttttgtatatcttgttgcgggatatacatggaagggagacgagtttccaaagataatatagatcccagtttgcctgtaaattgataacaccatttggaaacaaatcttaaaacctcactgacacagcataaatagaatttacagatcttcttgaagcaaatccaaatctccagactctactttctccattctcccccactcatcctaaccttcacgtacagggaccgcgttaccaagtgagccaactagactctttcacacctctctgcctctgcacatgctgttccttggccagaaatgccttttttttctgctttacctgacacatttagattagtcttttaagacctaatagaaatgtcaagtgctctgatatgccttcccagatgcccatgagcaaagtcagatgttctgccttctgttcccctatggtactttactgatgtccctgtgacagcttcctgccactccagcccactcagttgggagaacttcaagaggtgaacaaagttttattcctttttggattcccagtgtctcatagaccttctgggacatatggcacattcagtctagctgaatgaggtgatgaatcaatccacttactctctccagtgcctgaaacttctcaaggagcttgtgctctcctttgctcctctcttttcaaccaatctgaaaatgcttttaaaagataatgtctgttttccagtgcagtcttctcacttggcatgtaatttctccatttttatttcctttgtgaatatcaaggtacaatttccatagctaccagtctaacctggaatcttttcatctcagttttggagttccacaacagtgtcctggtggatctatcttctatatattcctactataatgtacactcttaccaggtaccaatcagttgtttcaaaccacatttctactaaatgacctctctgaagtgattctgaactggcttccctattagatgaagaccaaacctctactctaagcacttaagacaaatggttgcattcatctcaatgctccttactcctcaatattatccattacatttttttgagacagattgttattctctgacagattgttattccttcatcgtccaaaaggagtcctcactttgcttagactggaacacaaaattttatctattttaatgttccgtcatataattataattatattctgttatctattccaaattttcagaattttatctattgcaaattttaagtattccaagttataaacttacgtcttccaaaaagactaccaggattaaaccaaccactgaatcatcatttcattacttcatattactacaagttagatttgggacactgtaatattttagccctgattttgccctttttatagtgtccatagataatttaacttctttgtataaacttccattataaaatgaagttttttatatatatatatgtatatatatatatatatataaaacattacacatttaggacatttcatgatgaaataaaagtgtttcaaatagaaaatgatggtttatttgggtttataaatcaagaattctcaagagggtatgaaacccacttctcccttatcaactctagggattttctgtagttttgaaatttgaaaagcataaagtaaaattattatcattttgatttgcttgtagtcataatatttaattcacttagaaatatcaaataacattaaaagaaaggtgtgaaaatggctgcgctcagtggctcacacttgtaatcccagcactttgggaggcccaggtgggcagatcacctgaggtcaggagtttgagaccagcctgaacaacatggcgaaagcccatctctactaaaaatacaaaaattagccaggtgtggtggtgcatgcctgtaatcccagctactggggaggccgaggcaggagaatcgcttgaacttaggaggtgaaggttgcagtgagccaagatcatgccgttgctctccagcctgggcaacaagagtgaaactccatctcaaaaaaaaaaaaaaaaggtgtgaaaaatagggtagaccacgtgtgctgttacagtagaccccaaacataaaagatgtttatctcactcatatacacagtccaatatggttccagttggtgagggttagggttgtcattctgggagttggccagtagagatgctaccatcttcagcatgtcttccaaaagcttcctggtatcaaaatccaattgttgaaagcagagagaacatgaataagttcatatggaaggattttatggactaagactaaaagtagtccacattaattcagttcacattccactaaccacatggacacccctaacttcattggtgactaagaaatgtagtctagactattcccaggaataagaggaaatggttatactggagaactagatgtctaatatatattaccttacatagttatcaaagtcatttttagtttggacatggtctttactaatgggttgcaaatgctctttatgcagatgttttatgttttatattactttcctatgcccaacagcataaaatatagaagtctggatggattaggcacttgatgtgtgtattagcttttgattgctatgtaacaaatgaccacaatgttagtggcataaaacaacatatgtttattgtgtcacagtttctgtgggtcaggagtctaggcacagtgtgactaggtccccagcaaggctgtaatccagtcgttgatcaagactgtatttctcatctaaagactcaacaggggaagggtctgcttccaagctagctcaggttgttgtcagattttactttcttgtggcagcatgattctttgaagaatcaagaattcatggttgcttgcttcttcaaagccagcaacagagactaaatcaaatctagccagatggtcttatataatgtaagataactacaggagtgacatcccaacacctttgtaatattggttaagcaaattacaggtctcatatacattcaaggggaggggattttacaaaagaatgactaccaagaagcaggatcactggagcctgtccaccacagtaaatgactgaaaaaatctgggtattccagagaactaccactttacctgaacatagctctttacacaaaactacacagaattatgaaagatctcaagagaaaagtgttccttattgccaagagctggttattatgctagtaaaatcagcagtgctcaggaacaatatttgctaagtttcacagttatcaaccttaacccacacaatcatctttagaattggatccagaacaagatgggaccatcttaaacctggtacattctcataaggttcattctcataagaccctaaagccttcattatatggcatttttgaaactcctttgtcattttaaatttttgtctttcctagctcccttttcctctactattctatctaacttaggcagcattgaatttcatttttttttctccttagtctttctgtttgacattttcccttctagcttcatttgtcctttaagacaaccccataacctttcatctaggggaaagaaatctaaaagaaagctctagaatgagattttagttgacatattcaatttgctttagaggggcatcacccatacctcttcttccactagtgagatctcctgagaggtgaaaatatgagagaatcagagctgcttatttatatatcaactatggaaagatctttcctgcctaatctgacctcttctttgaaactccaaaagtgactttttgtggttaattcttccaggatatctatgatgcagtcccacagatattaaaggttcagggcatcaaactgaaagatataacagctctaatagacagagtcacatttctaaaaaggaaaaccaaattctgaagatattttctggctctgtgaacagctaaaaatacaaggataatcgttcctatagtcctggacttttaacacggaagctaacttggaaggaaaaatgacactgagctataggaagagaagaatagaacagacttcagtgaaatcggccgcttttcttttcaaggcacttattcctagattagctcatctatctttaagtttcatatgatttttactatttggcatgacttaaaactaccaagttggtgaaaggtacataggaactctctgtactattttgcaacttctatgtgtctaaaattattttaaaataaaaggtagcaaacatacaaacaaaacaaattattgagctgggaagtgttccccttgcaaaagtctagcaactggggtaaaattgtttctttgaatacaaatgcctagtctctgattaataaaataccaggaagaggaaaagaaggagctgaagaaagagagaaagaaatagagaaatggggatttccagttgctgtagatcttgagtaggcaggaccttagcacatggtatctaggtgcatattgcctgtcacttttcaattatctttgctggccctgcctcaatcaaagcccaaaccataccccaagggcactctgcatcgttgaatttatagatgagatctttcttttgggataaagagctattctcaacttgactattataccttggccttcattccctaaagaaaatgggcagggaggcttgcagacagaagtatatagtgtggaaaatgaaccacctcttttgactctttgcaagatttgtgatgtcctactgggatgcctgggcccaggcacattcaccttgattctacatcagagacttctgtgtcttctttctcatagtatgggttattgggttgagcaaatactttgtcatcagtgtgtcttatggagtaattgagagccttggatttgaactcatatctatttgggctctattttgggctgtgtcacttatgaactgcatgaccttgagcaaatcactgaaactctctacagtccagattcgtaatctattaaatggggctaataatacctcatgcatatggctgccaacgggagttagtgaaataatgtacatgaaatatttaacactaaacttggtgcctaatgtatcttcagtaaatgataactattgtcatagtcatcattgcttttatacttttcggcttccagtgatttccagtgactacagccctaaggccattgggggatatcttttttataactgaattttctttataaaacaataactgattttttttttttttttaagacagagtctcgctcttcttgcccaggttggagtgcagtggcacgatcttggctcactgcaaccttcatctcccgggtacaagtgattctcctgcctcagcctcccaagtaactgggattacaggtgcctgctaccacgcccggctagtttttttgtatttttagtagagatggggtttcaccatgttggccaggctggtcttgaactcctgacctcaggtgatccgcccgcctcggccttccaaagtgctgggattacaggtgtgagccaccgcgcctggcctaaaacaataactgattttttaaagaaacatactcatgactatttgtcattttagtcaaagaggatggagaaaaacagggttcagttttattttcagttcaatgtttcgaccatgacatccagtgctggcttgattacattttaggaaactgaattccttctctaaagaaatagtccaaaattaaacacatatggttactgtaatcaataataatgctaaccaagcatgctggctcatgcctataatcacagcactttgggaggcagaggcgggtggatcatttgaggatcacaggagtttgagatcagcctggccaacatggtgaaaccccgtctctactaaaaatacaaaaattagccggttctggtggcacggacctgtaatctcagctagtcagatggctgaggcacaagacttgcttgaacctgggaggcggagttggagtgagccaaaatcgtgccactgcactcaagtctgggtgacagagcaagactctgtctcaaaaataataataataataataatgctttgtgcatttcaaaattactaaaagagtgtaatcccaggacttttggaggccaaagcgagcagatcacttgagatcaggagtttgagaccagcttgccaatatggtgaaaccatgtctctactaaaaatacacacacgcaaaaatattagccaggcatcatggcgtgtgcctgtagtcccagctacttgggaggctgaggcaggagaatggcttgaactcaggaggcggaggctgcagtgagccaagatcccaccactgctctacagcctggccaatagaggaaggctctgtctcaaaaaaatatatatatattatatatatgtgtgtgtgtgtgtgcatgtatgtatatatatatgtgtgtatatatgtatatatgtgtatatatgtatatatgaaaagagcagaatttaaatgtttttaccactaaaaaagatatgtgaagtgatagatgtattaattagcttgatttaatcatttcacaatgtcaacatatataaaaaatcacatcatactccgtaaatatataaaattgtaagtcaactaaaaataaaattttaaaaagggaaacataataacttttattattttgtatttttaaaaatcaaagttaggacacatattgagtttctctgctactcaatgaactgaaggttttggaaaacaagaccaaaaaacaacaacctccaaaaaagaaataaaagaagatcatagttaaggcctttcatgcagtcagctcagggatcaagggtagatctcaacccgcctgtcactgagtatgcagtgctcacagatgtggggaatacctatgtacatcacagtcctcagggaactgtaaaaccagttgcattgaccaaaccaaaacacgtgccattagaaagcatataattgtaaaccaagagcttcttttccgtttacctaagataattgcagaggctttagtctaagagaatcaaagttaagtgatagcactgtcaaaaaggtttcttaaggaagaagatctaggggttctcgggattcgttgaatttgatgccatggctgaaaaattaagtggagatacactgtatgccattggagtcaggcactcatgtgaaagatcagcactcacatttaggaattggatacagctaacagcaggggaattgataggctcatgaaaagagcatgggtagaggatgacatagaaaattaagcacagttagggaagacttaccagccaggttacaagaagcaaacacctatcccaccgattcagaataccttgcctcactcctgcatgacaggacatgtgtgttctttacgttaactgagaaactgaggccagataggaagacagatgtggccagaagaagttgacattagtaatgagagaaataaacgaagtgattttggggctggcgttaactatctagaactacccaggagggtagatttagagacacttccatctttgaaatacccagaagtctgtttctccaatgccttgactctgcctaaagcagtctaccattaatctctgaggaatctcttcaaacagctttctgccaatgtatcactgaagccttttgagaaataagtgctgttccagcttagtcatatctcaaggcagcgtggcatgggaggtggagactacgagtaattaaaaataactcccagctcaagcagggagagggctgtccctgcctcatctgtattcccatcacaggctccccagtgagaccccagctgttgagcaagagactctgtagtgtctgatgcactcaatcttgagttgatcacaaaagaatgttaacaacgttaagggcatggagttctaggttttggaagaattcttaatgattctgttaaagaggaagaaataggaaaaagaccaaaaagacagggacaaacaggaaaaacggacccagctctactgcagtaatagccattgatcactttacctcccttggcagtctgatcagtttcactggaaagatagcaagtggaaaaagtgtgcagagatatgatgtgaaaattatattcaagctttagctccccagcacgtctctaaggaaagcactataggaacagctgctggagatataaacaaaggcccaggaacatctctgccattcatgtcaggatctgagagagccaagggaaggacaagaggggaattagctcccagacatgcttgagtctctaagctgttactccgtgatccccatgttctaggtgcagaagcattgcgtctctaagcaattcccttaccaccagctatctaatgctgtcagaggaccaactatttgctgttaacagtaatgctcatttgaagctattcagcctagattttctttgtattaggtaactgtttaataaattaattccaaacagtacctcccatctctctcagtctgaccattgagcgctcttagtcaatctttgcaaacttgtccccatttagttgttaaacctgctccatcaacccaataatgaatcaacctatatttgaggactatggtttgtgcctgctccaaatcctatgttttctctgatttcagaccccttgcctcaactggatgaacttttcaagctcagaacaaataagtgttaaaaaacattattaaacaaacatattcacctttctacaagtttggaaaataacagctaaggaaaaagcttgtaatcaatattttttgttgttgttcttgttgttgtttgagacagttttgctcttgttgcccaggctggagtgcaatggtgcgatctcagctcactgcaacctctgcctcccgggttcaagtgattctcctgtctcagcctcccaagtagctgggattacaggtgtgtgccaccatgcccggctaattttgtatttttagtagagatggggtttcaccatgttggtcaggctgatcttgaactcctgacctcaggtgatctgcctgactcggcctcccaaagggctgaaattacaggcgagagccactgtgcccggccttataataaatagatgtatcaattgtagcttaccagcaccaaaaacaatagttagtaagagtgtggagtctagaatttgactgtttagagaaattatgcctcatcttggggaaaatttcctaatgtgtccaatctcctgtttccttatccataaaatggagataattgtaggacctcctccagatgactattaggaagagatgatacatataaaactcacagcactgtgtcaggcataaaataagtaatctataaacaatgttatttaacacttttatgataaaaatatagaaatagaaaataatagtttcagtgacagatcaatgttgaagcctcaattcaaaacataataaaattgctctttatggttcttacgatgtacatttatttcaaatagtaacaatgctgttcatggtgaaacgtattgattttaagattgagaaattggacaaacaaggctagtccacaatagtgggattgcagtagaccctagaatatgtataccactttggaaggtataattaatatgtttatatgtgtcgtccccaatctttccattctttattaccaccattatacctccatttactccacagtccgtctcttctagaatgaaagctcccacaaatcagcaattgcatctgtataacctattctgtatggcataacacctatatacttttccaaaaagaggtggagagaatatttattgacttaggtatgtctgtgatgatctaatgaaatgtcatggaacaacttaaagtcatagccaaaggaagaggaatgttaatatgtaagaatttgcagatagattattaacatggaatgatgccaaaatagcacagtagaaaaactaaaataaattaaataggcctggatttgctgggtaacctggggtataaccccataaggatggtgtatgtagaagaaaagtcagtgaatcattagtaattcataaactgtgttttttctcaggtgttcaaacattggaaagctatcttttgcaacctgatgctttccctggaatatgcagtgtttcttgactcgtgcagtaatggctgatggagtaggtgttcagacattttatttgttggttttatgtatccaggtagagaactcctgtctaaaattatcaagagttggtggtgcattcaggacaggaatttagattttctgactccaaggacatttcaccacccactaaaccaccctttgccatgagctcccaggaagagcaattgttcagtctggtacagtgagggaataatctgtccctagcacaggaggctgaacacagcagtgaataaaagaagacaaaaccagttctacaatataaatgacacattccattaatacaagtggatccaaatgaactaatttcattcaatagtactttcacattctgtagctatatgggcttggatacaaattgtaatgtcagtctgtcaggagagtggatggcagtgcataattacaagttcttgttcagcacttcaggagctaatcagagcaaggatgtgaatctgtaatttgcaaatgtgcaaagacagaggttactatggcactaacgactctgctgataacattcttgccaccacatcataggactgtgagcacaaattctacaaaatcatttgacctcctgtttagtcgtttgcaagaaacagcctgctggcagtacctagggacatttataagtttaatgttgttcaaaaatctaaaatgtcactatacaataaattaatacttacattctaagggactatacacaatcgtaaagcaatatatagagcaaattaatacataaaatacagagaaatatagaaaattaatatactacatcatgcaacctgcttctaaacaagtgtttctttcataggactgaatcaggaaagattaaataaggagttgagtagaaacatatatagatatgtagagatagagatataggcaatgttttctttttttttatttttatccaccaccccctccccccgctccccaccatagcatttctgctttaaacacttattctctttctctaacaattttattcattttcgttcttggggcagtagaaaaacaaagcagcattttagagttcagtactggcctaaaattcaagcctctctctaaaagattatagaatttcgctgtcctctcagttcacagcagcaagcagaataatttctgcttgccattttcctcaacttagtcctgcaaaagtaacatcattggtctctgcttctttcctcccattattacctgatcctgctctacagcagatgcttcctcagagaaagaaatacctcgaacatctccatcaacttcttcatggtagtaacccttaaccctaaacttttcttgtgtagagatgggtgcatcatgttgaggattcattgaccattctgttaatatatgaatttaatcaattttaattttaaagaatcaggagtgattacgtgcatcacaactttcaggttaaataattttatcatgggtgctaagctagaaccatggctcacctggtcagatggctataggagagtcagcacaatagaagcttcaggcaatgtgaatcctgctgctccctaccagggatcaaaactgaggtcactgtgtggtatgtggaagtcaaatgactgcttctctttaaaaagtgttggaatgatgcgttttctctcaccgattctgtctagggggtaatgtgctagggtgcagtaagttaagtgttagtcacatatttgcagggttaaatcttagttccacagctgactcactgcacactctaggcagaattatttaactccttcagtctttgtttcctcattcaaaaaagaaagagagatactatctgtggcagagcctcagaggattgagggagttaaatgtaaaaatgacacactggtgcctgttacagggagggctccctgagaagcagacctgtgggctaagtttagcatgcaggatgtttattaaggtgtgcctttgagatcaatacctgtgaaaagtagggaaagaaagcagatgaggcatagggaaaaggtggactgccacaggcaacccagcgaacctcaccagcagctctggagctaaaatagctcttcagaattgtccagagttgggctgaggaggccagaattttatttgtgttcccacgatgatgactcagtggatggggtcatttcaggaagagagcagggcatcaaccttgagcaagaaaggtcactgcagcttagtctaaccctgaagaggctggcagctcagggcatctgttgacagtattccaaggaggcagggcgactagaactttagcaaaggaagatggcacatcacagtgatcatcacagtccccagtcataaagagtagtttcttacatgtgcataccccttagccttgttttcatttctcctcctcccgccttcctgtcttcctcttcctctcccttccttttcttctttttcttcttattttgattttgttttactttatggaattaaacctccataattctgtagtgtgccaagtatgagggggaaaaagtctctttcccccattaatagataatgacaccttgacagataagtgagcaattctgcattgattcattggggaaaactatggcaggaagtgggtagcagtgtttagcgtggcataaaatacatatgctatctaaagaggtggcttctttcccttctgggggatttatgtgcttaaatcagggcccacaaactcaaagcacgcatttgggctaaaggaagcttggctaagagtaaaaggagagccaacagggaaagggccttgtaggctgtgacctttcaagctaaactgcccctagagaaagagagacttatttgaatttacagatgccttaggactccagtgagccacagctctggctcttttcctctggggcactacaaagcttaggtctttgcagatcaattaaagtcattagcgctccatctaatgaatgttgatttccatgaggaggctgagccagctggcctgccctaaacagcgcaaaggcaagcagggtaccagagttagagcaaatggcaataagccacttgaattagaaggcccccagcttgcagcagagttaatgctgcctgttttccaggtgacctcaatcactgcctggggcagacactggactcagatgctctccagtcacaagagagtttgtaaatatgatttaaaaattgtcactggctgctcaactagcaggagtgttcagaaagctgcaaggtatgagacactggatgcacagatgtgttttcatctggggaatgttgcatttttacaattttctctcctggctattatgatgggagatttctagtttttaaattcagtgtgctttttaaatttttgaatagataataagatgattgcaaaaaaaattaatgctgcctctcatttctgttcttcatctactcaagaaaccagttattctttttgtgtgattctagagttttctgatatatgtacaagcaaaggaaagtgtatagtctcatattctcatagtcccacctactaaacaaataacaacatactgtatatataattctgcatctcgcttttcttctcttttaatatatcacagctgccttaccgtatcagaacaaagagaaattctttttttttacagctctgtcatatttcattgaatgaacatgccttatttacttaactgttcctttactgtttgcagttacaaataatactgcaggtaacctcaaatatgtttcattttttacgcatgtttgagagtatgtgttgaatacaatctcagaagtagaatgacttctaggaggtatatgcatttgtaatttcaatagatagaaggattgccaaattgtccttgagaagtattacacaaatgtacagccccccccccctcaacgaatgggagcgcttccccacacctcaccaatagagactgtggtcacacttttagaaatttgtccatctggtatgtgaaaatggaatttcagtgtagttttattttctttttcttatgatgagtgagattgtacatctgtttatatgtttaggaactttttagaaatcgtttgtatgaactttctattgatattttttgaccacttttgtagtagtttgctgcttttgtttttaattgatttctactagagagactaatctccatgatatgggatgcaaatatccttttcctcccctagttttttgtttgccttttgattttccttacagcttttgcccctgagcttttagattttataatgttgaagttatcagacttttcttttatggcatccttatttcgacacttaattagaagggaggacttcatattctagagtggtaaagtaattcttcatggttttctcttagcactaccatgttttgctttatattattcattttcataatttttaatgtattcctgtagaggacgtgaggtattgatacaaatttaatattttttttcaggtggctacccaattatttcaataactatgtttctataagtcatcatttcccatttaagcctctgttatgatattttaaattcatttctgcacttttattctgctgtattggtctgtcagtgcacatttttcaattctgaaacctgtacaatagatttcagaatctaaaagggctaattctcccttattactttttctttcagagttttcctgactttcctttttttttttttttttttttttttttgagacagtgtctcagtttgtcatccaggctggagtacagtggtgcgatctcggttcactgcaacctccacctcctgggttcaagcaattttcctgcctcagcctgctgagtagctgggattacaggcaagcgccaccacacctggctaatttttgcattttagcagagacagggtttcatcatgttggtcaggcaggtctcaaactcctgacctcatgtgatccacccgcttcagcctcccaaagtgttgggattacaggcgtgagccacggcacccagcccacttttcttttatatttttttatagaagcattagagtatataagcagtttcttttaataatttgtatatgttagcatatgtatatataaattagataatgttaatttacaaattaaggagagctataacttctatgacctatatgtgtctttctatttagtgacatgatctgtctctccttttgcttaaattttattttatataatttcatatgtctcatattttgttaggtttatctctaaaagttttttcttctctgtacctaattatgaatggttcttttctgttattacttctactaatgagctgtgtgtgtatatatacatgaagatcatgaattaaggcatactaattctgcatcctgcttccttacagaatcttcttgttaatagtaatcattttcagttgtttcttctgagaactccaggtgctcagtcatatcatctaaacataattttatcactctctttccagttttatatctccaatttctcttgtttaattgcattagataataatcctatctaataatatagtaatgatattgtggatactttagcctcgttactgactttagtaagagtgattctgatgtttccacaatcattatgagcctggcttttgcaaacatatacatccctatggtttcttaacactgaatggtctggtccttacattctcaagttaaatcccgttagcattgagtattctttataatatagaactagatccttgtaaacaatttaattattttctttttctatgccacagaacaattaacttggcattaaaattctctactctttaaaagcttggaatgatttatctgtgaccttttctgggcctcgtgctttctttttctaagggtggctcaggtgacagacaacttcctccatttcatcaatggaaatgaataggttttgaatatgtatcccctttagaattatttttaggcaattacacttttctaggatattctctatctcccaagttttcatatatatttgcacagagttagccaagactatttttgtcatttttctgtgcttattttccacttactatttttaaattttatgtatctgcaattttcttcctctttttcatgatgagataatctaatgtttaccctttttaatttttttgtaacagaaactttaaatatattaattttaccacttttgcatttcctagaatattaaattctccttttccctatatgaattggccctttatgtttttcttaaacatattttatgtttgtttaaaaattttgtattaaaaatattgaattgattttgttattttctcctgtcaatataaatatgtaagaccaaagatttcctctaagcatggcttttcctgtttcccatagattatagaatatgagtgcttttacatttttattgttctaggaaacctgcaaaatgggctgtattacattcgacccaagaattaagagagagttttaaaatttctgattggaatgggattctgtttccgatcttgttgttaacatctagttattacactgtgatcagaaaatgtgtacaatagtatttcttttttttttttttttttgaaaaagttgcagttttctttttggactgcatacagttacatttgtgattatcatgtggattcttaaaaagatttttttaattttcaatgcataagtctttaagtgtactgtttgatataccttataaattatgctatttaggtcaattatagtcttacttttgactacttcatctatcattgaataagcaagatgatttaaagtgtcttatttctgttttttggctgaatgtttcttcagataactcttaagttttctgttttttgaatgttatttttatttcatttggttcataactagttataattctgacaccttcattgcgaatttcatcttttaacattttaaacaaaaaggtcttttctcaattatttaaaacctgaataccactttctctgattttaagatccctatcgctgatttatttttgtttgcattcttccggcatgccttggttgaacctcttattttcaacgtgattaacaaatttaattgttttatttatttacttatttattttaattatactttaagttctgggatacttgtgcagaacatacaggtttgttacataggtatacacctgccatggtggtttgctgcacccatcaacctgtcatctacattaggtatttcacctaatgctgtccctcccctagccctctaccctctgacagtccccagtgtatgatgttcccctccctgttccatgtgttctcattgttcaactcccacttatgagaacatgcagtgtttagtttctgttcctgtgttagtttgctgagaatgatggtttccagcttcatccatgtccctgcaaaggacatgaactcatccttttttatgcctgcatagtattccatgttgtatatgtgccacattttctttatcactggtcattagagaaatgcaaatcaaaaccacaatgagataccatctcatgcaagttagaatgacagtcatcgaaaagtcaggaaacagcagatgctggagaggatgtggagaagtaggaatgcttttacactttggtgggagtgtaaattagttcaaccattgtggaaaacagtgtggcgattcctcaaggatctagaacaagaaataccatttgacccagcaatgccattactgggtatatacccaaaggattataaattattctactataaagacacatgcacatgtatgtttattgcagcactgtttacaatagcaaagacttggaaccaacccaaatgcccatcaatgatagactggataatgagttgttttttaaagcaagtctcttgttcatagcacaaagttggttctgctttgtgatctattgtaaaagttgaaagtctttgtcttttaataggtatattaagccagtttatatctaattatgtgatagatatatttgttcctggtcctctcctgttactttatcatatagtttctctttttcttattttgtttgtttgcttgtttgtaatgtgttctatgcatgtctatatgtatgttttgctatttaagagtttgcattttctcccttgtcatttttacagttataatgtattatatttttagtgctcaatatatttaaaccagagcttctcatccaatataccacactcagggcttttggatagaccctctggccatgaacaatcttgtcttctcctctcagtctcgacaaatatattatttgctttttgacctatcatttgaaaaatattgggaaatgtcactttaaggaatatgcactagctctttactatgagcagtgaatcatctttcttaatatttaatacagaaaaaaacatgcatgtattaaaattaattgagttgatactttatatattatcctttgactcctagcaatcagataatttacttcctactttctgtcctcttctaactatttttagttgtattacttctgtattgtcagggtttattccattttcattctggtcttcagcatattattcccattaggttagacatagttcttctttaaaaactatactctgtgcttaccttcaatttcattgtcatagttattctaattatgttttggttgatcaaagtcatttcctagtagtttcctcaatattcccagtgttcctgaaggtaaataccatttgtaaactatcattgagtatagtttggctggatataaaatgttgggtcatattttgctttttgttgggaggatgtttctataaacttattaatacagtcctggtgagtcagagaagcctttcttgaagaggcattgtctatgtttaatctctaatggatgatcgtcacagaaacatagacagaggaaatggttccaggcagaatcaatggaattgaaaaaaatcatggtacttctgtggaacaggtagttggatgactgtaatgcacaggggaaaaggtagacacaagttgacactggagaagtaggaggggatagagcaagaagaacttgacagaccgaggagtctggattgcttccaggacaataatctaaactgcagagtggtatgaagcaagaaagggatatccggttgtaactgttcatattaagaggggtgcacaggggtatatgagctttctcttccaaggagcctttgagtcctcatctctgctgttacagtacagacccagaatttcttatgtaggagagtaaatacatttatgaaataataatggaattcattttatgctagggccatatttctaactaccttccaatgtagcaggagatagcaagacttaaggatatcttagtctgactcttttaaaaaagaaaaaataaagaattacagttcttgggtatatagtcttgtacctctgtaatctgtgaactgtctttcttccaaggatcccatggaaacctttacaaatctagctgatattcactatagttctaaaacatttccttccttagctgttccatggggagttttctgtgatctcgcagtttcaagctactttttggggaccttccatacttcattcaggtgggagctgccatagttaactagtttcggagcacaactctttatcaaacactatatatgtaaaaaactgccatgttaaataccacttgttgctctttcatcttcagtcagctatatgcaaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggttgtggaatttccactgaaggctggagatgaaaaacatactcatttacactgtgtgcgaacttggtggactaacattggttaaactttgaaattaagagatttttttttcctgatttttggccatctctttaatgcaatttcaggtagccacatggttcttaaaaccccaaatgcagctatcttcagtaagtacaaaatgaaaatatgttgcatcctaacagataagaatttcttctttctcatgatgagagctgttacctaaaggagcaaagctttaatggggtctcagcttgattttgccatgtttatatacaaaagagatgaggcaagctttgttttgaagatgttaattgattctgtccaccatgctgtctaacagccaattccctgaaaatgtagtgatggaaaaaaaatctgttccaattactgtataagtaaaatgcttcccttccacctccactaaagaaaaaaatggcactcactgctcaggatctgagatcgacagctgattctgcacatgcaaagccctgctgccatttgtcatttcaggaactgctttatttttgtcaaaatggaaggaaaaaaaaggagagagacattatacagacatcagaattcaaatcatttgcaacctgatttgggtaatgaaggctcaaggcggagttgagatttagggactaaggtggttgtataagtatgtaacttcacaagaatctgttttagacccagagcagattaatagccagattacaatggcatttcctgggcttaggaatctcattatcctcttctttcatatttctttaaagtggaagacccttccactacggtggtgtcatttgaactcaagtgtcaggttcacatccttgtgccctgaagtttcaaagtgtccagttgctgtaggagctttttctattctgatattactgatactgagactggataggaagcataccctgtttagctgcacatctaaataatcggtaatgagaacatccttgacaaaactatcttgcggaggagaggtcaggtcttacctgcatgcctgcgaccttcagcaaacaaaggcagagatctaaggagaaaacaggatgtgggatgtttccagtggaccttggcagtggacttgctttgtgtttgcaatggaagaaggaactagaggggggataacctcatggttgtcttttcttctaaatttctaagacaaccagtgaagcttgaggccttttctccagaactatacaatctttgcctccagcaagctctgtttttactaataaccagattgtcaggtggaaaactttttctaagtggaccttacttctctaagtaaaaaaacaaatcccctgaggcatgaagacctccattttacacttttgttatatacttcacaggtacctgaaatggttctggacaaaggatatgatgatcgacaataaagaaatcaaagatcatattcataattataaccaacaaaaaataattctggggataatattgtcaaaatggattccactgcaaacaggcagtaggatttactttgacaatattctccccagaattattctggatatcactgtagggaccaaaggagagtttttcccttggccttccaaagattctctgaaaaatcaacttgcaaaatgcaaattgatcagagaaaaagtgtacacatttatttaatgtgtatacacaggagccttcaaaatgaagacccaaagatacaggagaaattgttcatttttatgcttaggttcaaccaagtgtggacatctgtgtagaaatatgattggacaaaaagggtatgatctaatggtaatggactgaggcagaaaacccagcgaggcctggccgtgtagactcttcttggcctctctgagcccacattcctttttttctgggtagggggcaaaactttttctgaaatgggggtcttatgacctataatcaaacaaggtagtcaggcagtttctgcgtggtcagtttttacacagaaaggcagagggaaattggagtaatatttttaggtcttatgactagctttgaggaagagggatcctagtttctatggctagcattggggaagaatgggactgagaaacaggagggcaggggaaggtcagaaaaacttttgcttctgaggccttcattttggggtattgtttactgagccccaacaccacctcgagggtttccaggtatattttttaaagaccttctaacaaatgttccttttatttatacatccatttaattattggtgctagttccaatgcaagacttaaaaaattccacttctaattccccacctgcatggagggcacaaatctccaactcatgatcagaatttcctgcaatccgtatgtcatttaatgaattccactctattcttctggaaatcgaacactctagaaacatagttttccttttagctgcaaacctattaatgctggcagccataaaataaatgcagtcacaactattccccacaaatgaatcagtcagctcagattaaaatatactctttgcatatcactgaagggctcttcctggtcagcttgtaagtgttctgttttcattgcgtggtattcattttccttttagcattgcacttgatttgtgaagtagtgttgactgctagattcccatcattaacattaagttttattgccttaaatctctgtcttatgttcactataaatgttttaagtcaacataatgctagcaagaggtgctgggttaacagactacagttggcatatgattctcatttggggcagggaattgtgcagggttattaggagctttctacctttttatttatttatttagggacagggtctcactctgttgctcaggctggagtgcagtggcacaatcatagctcactgcagcttctgacccctgggctcaagggatcctctcaactccgcctccagagtagttaggaccacaggcacatgccaccatacccacctaattttttttctttttttgagacggagttttgcttttgttgcccaggctggagtgcaatggcgtgatctcggctcactgcaacctccacctcctgggttcaagcaattctcctgcctcagcctcccgagtagctgggattacaggcatgtgccaccacgcccagctaattttgtatttttagtagagacggggtttcttcatgttggtcaggctggtctcaacctcgcaacctcaggtgatctgcctgccttggcctcccaaagtgctgcgattacaagtgtgagctgccacctggccccatatccacctaatttaaaaaaatttttttgcagagatgtgatcttgatatattgcccagcctggtctcaagctcctggcctcaagtgattctcctgtgtaggtttcccaaagcatgtggctaacattttttaatcctatacaatgttagcactggcctcatctagtcctaagaagtttgctcctaatcatgtattcattagaattgaggaggagaatatttcccatggtgaatttatatgttccgccaattcaaccaacatcaaatatttattagctgcataccgtgtgccagatacagagccagacactcaattttgcagacacagtatacctgctgtcctagagtttagactctaatgagggagagagataataaacaaggaaataagtgtatgtaacaatgtacagctagaaacgctgggaaagaaacgaacgtgagagacacttattggaatttaaatgcaagccactccactatatctactaggtgtgtgtgttacaaaatacaaaaaaagaaaagcctcctgggagggtagcaggagttaaattactcaaaattaagccacagtttaagacagcaaaacataacagaacccagagatgccccaaggcaatacaaagttaattatctaagtagtagtaacaagaataactgctggccaggcacagtggctcacgcctgtaatcccagcagtttgggaggctgaggcaggtggatcaccctgtcaaaactctcaggagttcgagaccagcctggcaaacatggtgaaaccccgtctctactaaaaatacaaaaattagccgggcatggtggcagaagcctgtaatcctagctactcgggaggctgaggcaggagaatcatttgaaccggggtggcagaggttgcagtgagctgagatggagccactgcactccagcctgggcgacagagtgagactctgtctcaaaaaaaaaaaaaaaaaaaaaaagactgctttaggatttaaggaagagtagtgtggcgggttagagatggtggttagaagaggctttctagaggatcccaaaatgatgaggagattgtggatggaaagtggtctcttaagcagaagaaaaagcatggaagaaatactagggtcagggaagataaaaaatattacgctgttatgaacaatcaattatatagggaaagtaaataatgttagaaaggtagtttaaaattttccttttttgcttatcatgttagaaagaatttaaaatagtggccaggcatggtggctcatgcctgtaatcccagcactttggggggccaaggtgggaggatcacttgagttcaggagttcaagcccagcctggccaacatggtgaaaccccgtctctactaaaaatacaaaaattagctgggcgtggtggtgcacctgtagtcccagctacttgggaggttgaggcaggagaatcgcttcaacccgggaggcagaggttgcagtgagccgagtttgtgccactgtactccagcctgggcgacagaatgagactccttcgccaaaaaaaaaaaaaaaaaaagaaagaaaaaagtaatggcagtagtagcaggagtagtagtagtaacagataaaacctatcattggcagcaacccaggcaagcatttatttctatatcttgctgatggggttgatggggttagcaattgctatagtctccctagtaggggatttaggagacagatgaaaaactgttagactatttacgtatttaaccaaaaggttccattttggggtattcatcctatggaaatagtcatgaaagtaggtaaagatttagttccagagatgtttattatagtttcttgtgaacattcttatttgaaaagaagataagtgcccaataatatcagattgattacagtacactcaagcggttagcacagatattcatcatagctgtacttgataacagttgttactattatcatgttcttgtgtgagaggtaaagggagataagattaaactttttgatgttataaacaccatcacatacttcaatctaatattttagaagaatatttaatactattttaggtttactgttgaattacatcaacagatgtttgtaaaacacagagcaaaaagtagagtaagttatacaagatcaatttagtcacatctctatgtgagtatgtttgcatcaaataaatactggaatgatatatgtgtgtgtatatatatgtatatacagtatattcaaatgtgaacagtgagtagtgagattacaggtaattttgattctttttgtttgtttgtttaacattatgttctaaaatgtgtatggtaaaaaaaaaaagtagtttttttttatttctaagactagaaaattatttagcaaacaagtggaccaaagatattacagatagcatttcctaaacatgatgtgccttttgtcatggaaaaaatggatgattttgttttcttcttcagcttaatatgcgatataataagctcagtcatcgaagagtgaagtgcagcatactgaaaaagtatgatttggtttcacacagatcttggtttaaatcccagcttcatctctcattaatgatcacatcctgaacaagttaatatgtatgtctcggtcttctctttagaaagctgacaatggggacatgtatgttaagtgactagcacagcgcttaccagaggaccattctcccgctgtagcaggacgagccgcagacgaaacctctcagacaccaaattgtaaaaggaagggctttattcagctgggagtatgggccagctactctctcaaaatccgagctctctgagtgcacaatttctgtcccttttaatggctcacaacactaaagatttcacgtgaaagggtggtgattgatttgagcaagcaggcggtacgtgacaggggctgcatgcaccggtggtcagagagaaacagaacagggcagggagtttcaaaatgttcttctatacaatgtctggaatctatgagtaacatcggtttctaagttatgagttgatttttagctactgggtttaggccaggcaggcccaggcctggtttcgggcctggcgccgggctgcctgtctttgattttacttccttgttgttttttcttaaaacaggtactgagtataaaacaatataaaacaatatgagagggtctctctcttccctcaccacatatgtgagaaaagagaaaatatggctaagtcatgtacttaactgagtattaaaacacatgtcttaccagaaatagcaatttttcaagtgtgtgaaacacattaaaaataaactttgaaactccaaaaatctttaaaatatgtaaattcatttagactttactagaaaaataaagttatctctctgaaattttgttgttaaatatttgtagaaaaggatgtaaagtggaatgaggtctagagagagaattttgatggatgtgtgtatttgagtcagttttcatcccactgaatctttagtcaaatcaaataaaaatgaaggtaatttgtcagcttgcagaatcatgccaagcaaagtcgaaaactgccagcctatgttcattctcatggtttgaacaaaccgaactccaagtaattcattgtttggttttgaattacttatattcactctgttgatcccattttgctttgaaattgtactttcatgtttattttctgtagtccagaatggaggtaggaggaggaaatatctggaaatacctaaaaacatcttgaacataccttaaaagtaacatgtttaggaggtccctgagttagttttattagcacctctgagtgttacagaaatgattgcaaatctccaaactcacagacatttgcccagagtccccacctataatcatgtgctgggagagctttagtataattattaggccagtgtaggacaagcagcagcgtgcacatagtcacatttaaagtgaggatttaaatgacaacaaaaagcaaagcaaaatgacactctatataacttgggattgtttttatttaaatcaaaatttaaaaaattttaattatacatatgtcctggggtatgagtggaggggtggctatggggatgggtacacaggcatgaatgaacacaggagactatgaaagatgcttcagatgccccccggacaaagatggagaaggaaatgttttctgtaccatctctatatgggcagttcagctttctctctgtgcttgttttctctgctctctctgtttggatttgaagaaaaagaggttttttgttttttttttttcctttttcttttgtctctatcttatttattttttaagtagactgtcaaaattttagctgtgattgaagaaaagaaataagacaaataaaattagtgggaaaccaaggagggggaaatgggattgccacttcctcttgtacagagtcagcagttttaatacctgtaaacaaaaagttctttgctggaactctttttagaatggaaaatgggatgaataggtacagcattatcaaaccatttgttgtgctccctttttcttgaattgatggaaaatatagaaataacacaaaccaaagttgacactcttgaaatgacttgtccttagaatttattgtttatctcacggaaacatgaagaaatgtcttcattaatgtttttgatctcagagccccatttccttttatctcccagcagaagtgttgcagtgtcctcacatttggattgagaatttagatagataagaattcaaccctctagtcccatttactgcaattgtatttaaataccagcttaattagctgtactcatcctccttcccaatcctctttgaagtaggaaagtcccattgcttccgtttagctaatgctatgctcataccctagtttttaagctttgtagaaagtacagatatgactgccccatgtgatctctaagaagtctagatatttgatccacagaagcattttgttccatggaggacgtggagtttgttgctttggatttgagcttcatttaaagcatttgcttatttttcatcttgcaaaattaatctaaatcaacttaatgaagggtagaacattgagatatatacctgttaatagtagaataatatgacatggcacagtatccaggtatggaaaaggtgaatagggatagtgttatgagatttttagagtacgttaattttataaagcatgcttatgggaaaagccaaacattgatgacatttcgcagaaaatgttatgttcaggtttggcaaataccaataaggtcagagaaaaagcaatatgaatcagtattaagaaaattataagatagtgtatgtctaggtcatgatctttagtatcatcaataaaaccactaaggatgcctcactatagctgtgagatgggttcggaccatgatatccagtttaatactatttgggagcagaagtaactagatatatttatcctatgatattttacacttattggacacctgttgaatctctgttggcttgagatttaatttgctaagagaaaagcaactgaagttactaaggtaatagacataacatatgatctaaaaattgagagtacgttaatcaaggggagtgagcagaaattattctcgtcaatcatccatgtgtccctctatatccttcacctttattgctgttagatttggaggaaattctgagcaatgttccgtgatcaggggtgaaaagtgtcatttctgggctgaggcagtttatagtcatttgcaccttttctataccactctctttccctgccttctcttctcaatgttctgaaaatcttgtgttctaaagggacttgaataagatggagatagagtgccaacccacattagcatttatagcatatatggagcaagaaatgaacacgtgtgtatgtctttatgtaagttacagatacttatctatgatacctatcctgactattgcaacatgttaagctttccactgataattaaatttcatatataaatagataattaattttgatatttaaaaaatgtaagttacaaaagcactatgctactctgagaggaaattgagaaatactaaagttttctttcatggagccccatagttggaccttcacaaaggcttcaaaagctagtttcctaaccagtaaaagtcagcatgagacacagtgggctgagataacaggcccctcagcctaggggtggtttgctgaagtaggaggccagagcctctggatgagtcatcttcagttgttacgacggcttactctgtggaccatgcaaataatatcattttcgatgtgttccatgatgcgaaaaagttagagaagtaccataggtctttgtatcaggcaccaatataaccacccctacactccagatcttctttccccatactcatttctccactctcctccaagtcctgcctcaaacgagttattattttcacataaaactgagaaggaactgttgaaatgactgacatcttcagcaaataaaatagttgtcaaattaataaataaatgtcacttgaggcacttctgagcttctcaatatgtcttcttttggaggactatttgttggcataggagaagatttcctagcaaccctcaaaatctttccaattaggaacctaaattctattcccaaaggttatgatataaagaggaaacttgaaaatttgtaactgaactctattgaagtatggggtatttcaattgagtaagcccaatatttacctgcatcacaaaaaaactagattttaataatttcttatcaagtgtttatgccatgtaccatatttaacatatatttactcattagtttttcaaaattcttatgaaatgatattgtttttatacccattttacagatgagaaaactgagagagaccttaaggagctttctcatgatgcatggctagttaatggcagaactcatgttaaagcaagcagtccaaccctgcctgggctcttaaacagtggagtctgctgtctccttttaataggatgaaggtgaagttctcagcttgatatttttgtttcattcagtgcaaagtgtcatcttctaccccagtgccaaaaattacttcaaagaaaacagctttttgactaccgacagttatgtacaagaggtgtgatttggggttttaagagcttactttgacacagctcagatcccttttttggtagtgaaaattatgctgttatctcctaaaaaacatcatctgctctgtccccacctctttaatttgacaggtgattccatatccatgtaagagcattttggtgtctgaaaaacaataaaaatcgtcccagtaaacccatgttctattcaaaaaattttggcatattgattgtctggggtaaggttcaaaattgcataaacttccttgccccacaaatcactttgttgcatcgacaataataatcacaattattgatagtaaaataatttggccattctatgaatagtaaggactgcacatgttaaaaagaggcaaaagaatggatagatgatcagaatccattctcagtaaccagagctaaggaaacagctcaagtaaaaacgctcagcttacttaatgctctatagtaattaatagtaattgataacaacttgtagcaattaagatctaatgcacttaatttgcaaatgtactccttaactttgaatacacttttttctctaaggcgaaagtctagaattggagactcttggattcttcttcccattcttttccttcttccttggaaaaaatcagaaacaatctcgaaatgtggcctgttggagctggaaaagagcttagagattgttctagtacagttgtgtcaaactacaggtgaaaactttgaatcttggagaagaccactggtttattccacctctctagccatcggcatgaatgtctattggtatacttggtttagctgcccaatttatggccaagactgggacatgatatggtacaaaatatggtgtttttgtataaagagctatctcttgttccttcgttgtaaggggactgagggcacaagagttctaagactgataatcccatcaacttaatatattaaaagaggttttatatctaaagcatccaacacagtgtctggcctagaggaggcactatatctatagaacaaataaacgaatgttcgaacatagcctctctaaattctatttgaatgacttaacacaaagatcagaaatttgcatagctgtttgtgttagccctttaaaacaaaactctcctaggggaacatatgtgaattctattcagagtttaaaaacagattcatgggagagccccaaaccaatcaaaaacatggcaaggtttaaaaaacaaaaaagacaaaaaacaaaccagaaaaaaaaaattatgaaaagaccctgcctgccaagagtgacttgtttgcaattgaaaacctggagatatgagtacataatagaaacgtggcaatgatcatctgggcaaaaacacaatttgtatgacaatgaatcaggaaatgtcctggaacaccagaagatgaaaaacctgggattttataaggcacattcaagttgctgcgcatgcgtcacaccatgaattttcctgtggtctgacatcctgttaaaagcattggtctctttctaaacattggtagtagaagtgtaccacaacaggcaaccttacatttaaagaaagaatgtaatagatacctgtggaaactgtcaaaagtgtcttctagagctatttttgaggtctcttttattccttcattcctgatctgaaattcattaaggctaagagtgccccttaaattacgttctgctgtatcctggaggaacacctgaagaagttaataataaaccctagagattaggcaagtggaaagaattatgaaataaaacaaagcaaagaaattgtgtaaacaaattaattaattgtctgaaagtgaaagcatgtttgtaattttgcccttgtcaaagaaaaattggagttcattatgctcgctgactgatttaaaagcttcttcccgcgtagcatcaccgggagaatgagtgtgttgtgagtgcaaagcatggatcggttgcagcatcaattaaaatagaaattcattattgaaacctccagagtaaaaggtttgtgctttctgctttgaggatgggaggaagcttttcttttcttatttttaagttttgtttattttttttctctcctctctccaattggtataggaacatttattttggatttccagtagcaggcattctacctttttgtaataaattatattaatacctgttatacattgagcacatgctatataccaggcattctatatactttatcatctttaaccctcagagcaatcatgtggtgaaaggtatccatcagtatcacttgaggaaactgaagctcacggaggtaaaattgaacagctactaagtgatgatgccaaggatttaacacaccctaggtttgtctgactaggaacttctggtctctccaggacacaacagagccttctaaggcaggtttactgtgttgagttgggtttgcccctataacaaggctatcaaagatatatgtgtgtatccaggataggcattctgtattcagttacgtgttggagtgctatcgagagcccagtgggattataggtggaataagataccttcaacacagccatctgctgcatatggtgacccttgtgctctccaaatgagcagaagctcaaccagctttgctgaaatgtgtttgatgagaggatggtgtgttttacttttgtgacatctttccccagaggtggttgcctgaagagttgaactttagagaacaaaaagaaagaaatgtaggatccatttatggtctctcctagaatcatgccatatgttggactctatatggaaagggaggaggaataaaatgaagaaagaggagtacacagagcatggaaaaccataagtacgtgtgatccatgattacatcattgcaccttgcaaaaacttgttgattttagctctggggaggatgagtgaaaatcatggagtcagagcagaatcatgaaaagagattggttttggagccaagggaactcagatttacatctggtcacaacattttttttttaatattccctttttttattaattattttttttttaatttaagttccaggatacatgtgcaggatgtgaaggtttatttcgtaggtaaatgcattccatggtggtttgcagtacctatcaacccatcacctaagtattaagccctgcatgcattaactatttatcctgatgctctctctccttctactccccagcaggccccagtgagttttgttcccctctctgtgtccatgtgttctcattgttcagctcccacttataagtgagaatatgcagtgtttggttttctattcctgcattagtttgctgaggataatggcttccagctccctccatgtccctgaaaaggacatgatcttattgcttttaatggctgcatagtattccatggtatctatataccacattgtctttgtccagtctatcattgatgggcatttaggttgattctgtgtctttgctgttgtgaatagtgctccaatgaacatatgtgtgcatgtatccttataacagaatgatttatgttcctttgggtatacatcttgtaataggattgctgggtctaatggtatttctggttctagatctttgaggaattgccacactgttttccataatgtttgaactaatttacattcccaccaacagtgtaaaagcattcctacttctccacagcctcactagcatctgttgtttcttgactttttaataatcaccattctgactgtcatgagatggagtctcattgtggttttgattttcatttctctaatgatcagtgatgttgttgagctttttttcatgtttgtcggctgcataaatgttttcttttgagaagtgtctgttcgtgtcctttgcccacttttttttttattatactttaagctttagggtacatgtgcccaacgtgcaggttagttacatatgtatacatgtgccatgttggtgtgctgcacccattaacttgtcatttaacattaggtatatctcctaatgctatccctccccctccctgcaccccacaacaggccccggtgtgtgatgttccccttcctgtgcccatgtgttctcattgttcaattcccacctatgagtgacaacatgcagtgtttggtttttttgtccttgcaatagtttgctgagaatgatggtttccagcttcatccatgtccctacaaaggacatgaactcatcattttctatggctgcatagtattccatggtgtatatgtgccacattttcttaatccagtctatcattgttggacatttgggttggttccaagtctttgctattgtgaatagtgccgcaataaacatatgtgtgcatgtgtctttatagcaccatgatttataatcctttgggtatatacccactaatgggattgctgggtcaaatggtatttctagttcaagatccctgaggaatcgccacactgacttccacaatggttgaactagtttacagtcccaccaacagtgtcaaagtgttcctatttctccacatcctctccagcacctgttgtttcctaactttttaatgattaccattctaactggtatgagatggtgtctcattgtggttttgatttgcatttctctgatggccggtgatgatgagcattttttcatgtgtctttcagctgcataaatgtcttcttttgagaagtgtctgttcatatcctttgcccactttttgatggggttgtttgtttttttcttgtaaatttgtttgagttcattgtagattctggatattagccctttgtcagatgagtagattacagaaattttctcccattttgtaggttgcttgttcactctgatggtagtttcttttgctgtgcagaagctctttagtttaattagatcccatttgttagttttggcttttgttgccattgctttttgtgttttagacatgaagtccttgcccatgcctatgtcctgaatggtattgcctaggttttcttctagggtttttatggtttcaggtctaacatttaagtctttaatccatcttgaatatcttgaattaatttttgtataaggtgtaaggaagggatccagtttcagctttctacatatggctagccagttttcccagcaccatttattaaatagggaatcgtttccccacttcttaatggggtggtttgtttttttcttgtgaatttgtttacgttccttgtagattctggatattagacctctgtcagatggatagtttgcaacatttttctcccattctctaggttgcctgttcactgtgatgatagtttagtttgccaatcgcagccacttttaacactgttactctgggtaggttatttggtctgagtgtcagtccctccttctgtaaaatggggggaattcctgaaggacagtgttaggatgaaatcacattacttataatgtcgaattcctctgtcaatgcttatatgcttctcattcattatttctaagtcaagcatttttaaagcatttaacatgcaattattcatttttgtttataaagtgaccctgtgaacttatccctattttacagttgatgaatctgagacactgagagattaaataacctacctaagatcatccagctataaagtgatcgagacaggttttgtttgttggttggttggttttgagatggagtcttgctctgtcacccagcctggagtgcagtggcacgatcttggctcactgcaacctccacctcccagtaatggtgcaattacaggcatgcaccaccacacctggctaattttttttttgtatttttagcagagactgggtttcaccacgttggccaggttggtcttgaactcctgacctcaaatcatccacccacctgggcctcccaaagtgctgggactacaggtgccccgctcaagacagattttaaacctagcattcttgctccagaattcatgctgttaatcactgctattctgcctctctgttgactctcagaacctctcttggtcaaagcaagaaggtatcgaacagacttcctgtgctgttttataagctgcctcaaatccttccaggacagggcaatgtctatataaatagatgttataaaaagtataatctaggccctatttatttttctctcagattcatgtctaattcataccagttgagccttgctatttgagtttcacttaaaagcattctgacatagctcacctcccctctttctcttatattgctacccataaggactagagaaaagatggataacataatcctgagtctatgagttgctagaaattcctcattataattgtgtgtcttctggcaaaaataaataaataactttctcttttaaagccacttataggagacaatgcacattctgtgttttttctctgtggctgtgcatggacacagactcttctgcccttctcttgcctgttccttgattcctcatgtttctgtctggtgcctacctgagatccaggtattcctctttacctcgtcgtcttgctattttttctagggacttttcttctcccaaagttatgttgaaacaggcaaaacacctagaaatgggtcatgtgggtgagtagaggggagtgagaaggagagggaaaaaattcccaaagctcatattaggcaattacagttctaatgaatagaagcagtctattcaggcttctggcaatattttatgctcacctagtgtagtctgtattcccttaaatgggtaaaagatgccttaaaaagattgctttgaaggatgaagagacttgaaacaactctctgaacaaaagaacttgtttattcattcatttattcagcttgcatttattatgtgctgggtattatgcatataaatattttcttaagttttgtttttaattaacacataatagtatatatttatggggcacagtgagatgtttgatacatgtagacattatgtaaaaatcaaaccagtgtgtttagcgtattcatcacctcatatatttacctttttcttctggtgagagcattcaaaatcttctcttctagctattttgaaatacaacaatacaatatttttatccctagtcaccctgctgtgcagtagaacaccggagcttattccctccatttaactgtaactttgtacctgttgaccaatcatggtccctattctaaaagtgtcacagcctaggtaggttgacaaacaggtaaatcaggattacaatacaaaagtaaaatagcctggatcaaggaaagcacaggttgttatggaaacacaagagaggacatgtaaataagattgagggaggttcaagaaggcttttcaggagagatgacttttgaactgagttttaaagaccactgggtagacaataggagaaaaaaacatttctggctaagaggttagtgtggatgagcaagtggctctgtatagctggaggagtgtctgaattttccaacatgaaaaggaccacaaacttggtggaatcaaacaaagattttttttttcttttgtcacagttctggaggttggaagtccaaaatcaaggtgtcagcaaggctggttccttctggaggttctgaaaatgaatcccttccatgcctctctcccagcttctggtgctggtggatgcatcactctgatctctggctgtctttacattgccttctctgtgtttctccttttctgcctgtatcttctcttcttctaaagacacttgccaggccaggagcggtggctcaaacctgtaatcccagcactttgggaggccaaggcaggcagaccacctgagtttgagaccagcctggccactgtggtgaaaccctgtctctactaaaaatacaaaaattagccgggtgtggtggcgcatgcctgtaatcccaacgattcaggaggccatggcaaaagaatcgcttgaaacccaggaggcggaggttgcagtgagccaagattgtgccattgcactccagcctgggcaacaagagcgaaactcatctcaaaaaaaaagatacttgccattggattcagagcccacctagataatccaggatgatctcatctagacagcctttactaattccatcttgcaaagactcttttttcaaataatgacacattcatacattccatatcttttggggagacactatttaacccactacaaggtataaagatgagctataggcctgatgaggtaggaaagaggcagggcaaggtctcccagacactcatgtacctgacaaggtgagtctcaagagacacaagaaaaccttggaactgtaattgtgaaattgacatctatctctggaaaatgactattactcctaatgcctctagccaaagactatcagaaacccacctgtagctgatggagttgcatttgttactcattgtttcgatgaggacacacatcatgaggaaccatcatgtctcagctagagggtgttggagaaaacctattgtaggaatttgactttggttgggtaatatgaggaagcgtccaagaaagcctagttcactttagattagatgctgtcagaaagcagaggcaattctaaaaatgtgtatcttgattaaatcttctctgtatggaacaagagtgaggataaagttgtaaatgataaagaagtagcaatcactagccaagagaggggactgtttgctattttgtgggtgaagcagtgactttgtttttctgtgcattgattaaattaagatgtagctttgttttgactcagtttatcatggtctcagagtgacttcttctgagattggtattctgtgacattgctcatgtgcaatagaagaataacaagatctagccatgagtgccaggttacgttccagatgtcacaggctgctcttttgttttgtttttctttttcaataccaagtgataagaatgagcatgcctaaaattccagcagttgtaataaaatacatcaaccaaaaggttcagactgtcctgtaagacccataataagagtctcaatgtgttcttaaaagaacattctttcttagcctacgtgaacatccttctctagacttaaattacttctgacccacatgttgggccgtatctattttaaagacaagaggagctaactgcaaagttccttgtctggtaagctgtttcatctgatagttgtaatagcattttctcccgtctcactgtagggcctaaccccacaagcatccttgtgaagaaagaccccacagtcctctttttaagctttctccctccctttcctggggtgccttatctatttaaatattagaggtgagtcaaatgtaattctctttaatgaaaaacaaacaagtgatagaaccctaaacgctcttttggcaaagatcccttcagaacaaacaatcttcttttaaaagaagtcagagctaggaaagggccacaggagagcagggatagccaactaaactatgcagcaggcttctctgaaaaaaagtgagtgacttttttggtgtggcaagaaaaaaaaaaagtaaagtttgatataactagtagtccttggaatgacaagtgacaagagaggtctcttccctccctatagtcccaaggagaaaagggctctgtaaaattaaaggcacaggtattcagttgaaaggacatatttttctcctctaacttataattagcctgcgatactggcttctgtaggctcttatgaaggcaaattgctcaggacagtgactctggcgatgtcagtcatacaggcaagcactgggatatctatcacaaacacatgccagttgtcatcttccaaggcatcacctgattgccaactcaggtcaggaagaaatcattcctctttcttcttctgtgatgttacttatctgttgcaacagaggagagggttagcacctttcatgacatattccagcatcctgttaaattgatcagaagaccaattgcacacagtgtcttctaccattgagattggaaacacagccaagggtggagatggtcagtgaggcttcccagtgtcttgcaagttccaggtcagttgtttatgcttagagtcccctgacagagagatggatgtgttagcaggttctagggcctgtggtttcccttgtggaaatgccagtggaccatgtgtgctccttgggtatcagggtgattgggcttgggttggttgtggccacagcatgaactggagagtcggctgtatttggcatgacaaggttggcacaggccagctgagaccttgaaaaatttggagctgatgcagaggtgaataaacacattgaaaacagaagctgcaacctcaaatttctacagggaccagacaggtaatatgcctgagtgaagcaggccaggtggcaaattgtacagtgcaggccccaatcaaagtgcacagtggccactcagctgccactggattataattgtgtagagatgtgagtttagagttgtcagcttttcaagagaagccaacagtctggtgtgtatgttaaatcccctgattctggcatctaattaatgcccttagcagtccaaaccaaacaatgtgtgagctgccatttttgcaaccttgagctaatggtgttaacgtccagtttctttgtttcataacatctatggaatggctttgtgaatgcaaatgttgaaacattgtgagtctcatccccaacagtgaaaataaatacaaaatttaggcaaaaaataaaaataaaaataaaaatacttcttaaatgtcacagcgcccccatggggctggctggggcaacaaattaagggacacagctgagctttcgattctgtcagtaactaagtagtaatggtgcctcagggggtctgagtcattgaacaagcgctacaggatagcacaatactaggtacacaaagtaggcgagcacaggctccctacctttgaaaagtttataagttcattaacagtattatgtttccatgcactggagcattagaggaaaaatgccacgataacatctaaacaagagtgcagtgggccctgagaagtatgatgattctgtttccttctttaaagcatctcttcttaataatgtgcagtagtagagagaatagaaaagcagcatgatggccatgtgacttgctggatggatgccatttctgttggatgagattggacatcaataggtaaaaccaataagaggttgtgtgcattttcagattctggaattctggaatctatgacatttttggaaaaatagctctcctaagacactggttctaaatatagcagtgggtttcaatagttctatgaattgaaatcaatagtactaaggagcgaagagcctagatcactctcccaagaatcattgcttagatgagtggttctcaaagtgtagtctctggccaccagcatcacctggcaacttgttacaaacgcatattgttgattctcattccacaactattgaatcagaaattctgggactgagtcctagcaatctgtgttttaaacaagccctccaagtgatttaatgcatgccaaatactaagaatcactgttatccttggaagaggggaaagctcagataacccacaattgaggtctagagatgttcatagtctcttctacaagtaagtcttaccagtgagctatagtagagataaccaagatagcatgtagctggaggagctgttgcttatttgactggattttttggtcattttttctttctcacttatgtgtttgttctccacttgttttcaagccccattgatttctgtattagctttctattgctgctatgataaattaccacacattttcatggcttaaagcaacacaaatttatgagagttctgaaggttagaagtccaatacaggtatctctggataaaatcaaggtgtcagaattagagcaaatcccttcttggggcctctcgggaacaatctacttccttgctttttccagcttctaaaggccacctgctttctttggctcatgggcccttttcttataaatgcagatgttgtttttaaaaatgaacaatgttaggctgccttcctcgaggggctgtctctcttgttctcactcttctgcctccccttccacctttaagtatcctgtgattacattgggtgcacctggatgataggcaagctccctattttaagatcaactgattagcaaatttattcccctgtgctatagaaggtaccatattcacatgcttcaagaattagaatatattgtatctttcatgggggaggtacattattctgcctaccataagagattgtattcggagggcttgtttttttttttgttgttgttgttttttcaccaggaaatggagcctggtgaaaaatgtaatatatagcctcttcctccacactactaaactacctttctgtgtcctacagagactgtgtaatattcactggtgaagacataagctttgtagtcacaaacctgagttgacgttcctactctggcacttactagattgatatggtttggctgtgtccccacccaaatctcatcttgaattcccatgtgttgtgggagggacccggtgggaggtaattgaatcatgggggtaggtatttcccagggtgttctcctgatagtgagtaagtctcatgaggtctgatggttattataagggggagcttctctgcacaagctctctttgcctgctgccatttcacgtaaggtgtgacttgctcctccttgccttctgccatgattgtgaggcctccccagccacatggaactgtaagtccaattaaacctctttcttttgtaaattgcccagtcttggatatgtctttatcagcaccatgaaaatggactaatatatagatgtaataactttttgcaagttatgcaattttgggccatagattcctttattctgaagtggagaaaatactttccttatacaattgttatgtttacataaaataaggtgccagatacatagtagaaataaaataaatgatgttactacttcctaaaatcctaaaagtttcatttcagattgctgagtaaacccagttaaagaaaccagcctctgtgttttggtgttgtcattaatgctaagttacatttccttagggtatctgcattaagcaaatgtaagatgtttgagtttcaaagatgaacaagtgacttgtaagtgtaaagtggtatggctgtttttaataaataggtaataccacccttttggcgggtagtagagaaaagaagatgagtttttagaaaaagactcagagttactcagaattaagaaaatgaatccttactgtcaatatgagtctcccaactgctagcgcaagtggtggatagattttcttttccactagatttacttcctgatatacacatttatcactcaagcatggactgttcatcaagtcattttccatctataaccccagctgaagcctgacaggttgtgtgtttattatgtactcttaaaaaactggagctcatttgcccctgctgcggggagagcagactcagacagatagagggataaggtcattcagtggaatgcccattcactgcagtcaagcctaaataatagagaggtgtaaaacaaccaggaaaagctctgattattgccagaaatcaaatattgatcagatagtcccctaacttaccaacttccctcttaatgatctgattcccatgtattcattcatcagttagttgagcccctcctatagaccaagccctgtgcatggctataaaaaacagtatgtccatgcccacttccccctctacactcaatctggagccatgagaaattaaataacctttaatttctgaagatcgggtgctcttataaaacatcagtacttataattgtatcctgcagtggaaaattgtgcaataatctttttctgaaggcatggccatgaattgtactatattactccatctatcttcttttaacactaaacaaaatgaagagaatacattgtgcatggcccctagaaatttaccttcaaatagaaacaaagctgctaactccacacacacatgatatgctgaaaactgaataaatattgaagaatctaaattcaattaattagcaagccaaatcttgcctcaaattatgttgacattatttattcctttgttgattaaatgagttgcctcttaagccaaaagagaagatcttaagctcttgtttcttcattccaggtctcttctctccaaggaatttgggaaggagcaagcacagcagaggccagttttactgcatgctggtgctcagagggaatagggttcatagagtagaagacagtgaggagagaaccagtaaggaggttggggagctggatagcatttacagcatgggttcattgattcattgggaggcttataaatttcctatgcatagaagcacctgtttttaaacagagacatgtattcaacacatgccttcgagaactaattggaaagagtctttgatggcctatcgttttgaatttgcatgaccagaactccactatccatgcaaacacagtggacttgctgcaattgtcctttgacttaggcaactttaacaatgcaggggaggaggggtgagaagaggctaggagaggaagtgtcagtgggagaagccaagaataattgaagtagtgtgttatttcttttttttttaactattaattttttttattattatactttaagttctgggatacatgtgcagaaggtgcaggtttgttacataggtatacatatgccatggtggtttgctgcactcatcaacccatcatctacattaggtatttctcctaatactatccctcccctagccctccacccacctgacaggtctcagtgtgtgatgttcccctccttgtgtccacgtattctcgttgttcaactcccacttatgagtgagaacatgcagtgtttggttttctgttcctgtgttagtttgctgagaatgatggtttccagcttcaccagtgtccctgcaaaggacatgaagtcattcttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaaaaaaaaaaaaacaaaaaaaatcatgttccctaaacacaaataacttcatctgctgcccaagcaaagaaacaaagagatgtctactaaaggcaaaaatgccaatgtcgtgcttcctgagcacagacattgcactgcacagaatggaccattttggagactttcaaagacagttttgactcagtaatctcctatgctgactttattacctaactgtgtcctgtggaggattaggtgatagtggcaggttaggtccatgggagattggattccactgtgatcagcaaacagaataaccagcatgtgtgaagtgacttttgtcagaggagtgatgaggagtgctctctgaattcagtgttttccctctttaatttttgctaatcatgggtcatttatctgtgagctactgcattgtttccactgcctgctttccaaccagggataggttttatctcaaaaaacagaagacaaaacctcttaacctaaaactaagactccctctgggagattccaaagagagacggctttgatgtaatgggaagggagctgatttagggtctaataaagtcttctaccagctgtgtgatctttggcagtttctagttccctaggtactatttgcctatctatagaaatggggttaacagcacctactgctgaagttggtatggacataatgagataccatacatgtaaggaaatgaaaagtattccacaaatactccttccctgagcttgttccttcctttcaccaaaacacacatattccatctttcaactctcctgctctacacgtgtatgcttgagtttagggccctggaataagcaatcctgggtcaacatctgctctgcaaacatcaaaaagtgtgagcaggggcagcctagccttggtattgatgtgtttcccatccacagccacattcaccattagacccagtattagtcactgggtccccggggccagcatttactgttgccttcaaaaatgcagactcattactaacaaaagtggtatgtccattattatgacctatttagtggcccagcaaatccccaaattctattgagccacatctgtctaccgaggggctctgcggttgattgtctgagacggatctgcttgcaaagaggctgatttgggaaagttcaacagccccacttagttgctctgtgacatcctgacttcctacaggttacttctcatattgttgggtgtttgtttgtttgttagtttgtttgtttgacagaggtctcactctgtcaccaggctggagtgcagtggcatgatctcggctcactgcaacctcctcctcccaggttcaagggattctcctgcctcagcctcccgaatagctgggactacatgcacaccccaccacaccaagctaatttttttattttttagtagagacgaggtttcaccatattggccaggatggtcttgatctcttgacctcatgatccacccgcctcagccttccaaagtgctgggattacaggcatgagccaccatgcctggcctcaatgttgtgttttaaagttcagctggaagatacccttattcctaagaaatccactaaagaaaactgttcttccaggagttccatttcattctctgggaagggtccatcccttgttcctgttccctttcctctgaattctataggacatatcacagcaccttcttgctgcctccttgtttgtgtctttcattaaactgtaagctccacacatgcagggactgtatttattttttcagagatgtgtcttcaacactgaatgcaacagtgacacttgacaaatatttttcaaacacattgaaatgagtttgatcaccacctgggcattcacagtagtccagaggtcccctgcactgtgagtgtgactaaagctcaggaaagtcagaaaggccagccaaggaaggaagatgctggcaagactcggaaagtgcaggagtgtatgagattgaatcacctggacaggggcacccaaacaaaggcgtctgctggctacgtgactttggttaagttgctgaacttctttgtccacagtttcctcaacactaaaacaaggagtaatcattatatctactttatagggctgttctggggattaaattagttaatatttataaagcatttaaaattatacatggtatgaaatgagcacaaataagtgggatgagggagacataaacaaaagttcctaaagtggaggttaattcagagccaaagacattgcctgggcattagaagtagtcagacatgaatttgagtcccagctaaggcatttatcaactgggtcggccttgaagaagccgcttgcattctgagtcttgctttccatagctatgaaatgttctcaatcacagttatctcccaggattgttaagagaagtttcctttaaatgttcagaatagtgaatggcatttcttatgtgcctaataaatattaactcatctactgccatcccttcctttctttccctctcattctttctcttttcctggcccataactttctgctcagaactggaaacatctttgaaggagggagaaggagcatgagagtcaggggcttgtttacaaaacaaaacatggaaatagtaaaaacaacaaatctaatagtctctgaaatgattttgtctcccactaggaccagaaaaagcagcagaattttatgttaatggattcggtggaaaatacggctttaatgaaacattgactatgattactctgttgtcatttctctgaatttctggtcctctttccatctctcttttaagaagatctgaatggttatttctcaacacaccaggattatgttttcttcgtcaagagtttgaggaacctagggtgcagcttgagctgctgagctgtctgtctttattctgacaggcgtggactccagtgtttagctcaagccccagggactggcttttgaacagcagctgttctcagtgaaactgaaatgcgcagaggggaggggaatagtacaccctgggaagtacagggagcaggtaagttgttttgctaatacatccctggggaagtttctagtgtttctgggcatggctgagcgcacagctcataaaaaatgcaccagatcattgttggcatttgatgtcagaagaagctacagtaccaagagacatggactgtctggtttcctgtgacatccaggtgacacaccaggtttccactgcttttcgtcattagcccagatgttcccagttacttggacagagagccttgtagatccctgtatatggagtcttccttcccgtggttcattagaaatggcaaagccaaactggcagtattcttcaatttgttgataagagtgcttcagtgcatgtatttacaaatacacattgttgttttcaatttgtttattcagtgaatcaaaatagcaaaacacattaactataagacaagagaaggataaggaagtaacatctattgggtacctgctatgttccaggcaatgacagagctgcttgacagaaaatgtttaatgtcttcctcattgtagctacatgtggtgtttcaggtatgattactgcatgttacagtgggaagtagcccagcattcttgaaagagtatagggtcctcactatctgtgtgaatttgagtagttacttaaaccctctgagctttattttatttctgtaaaggaatttaacaaagtggctaatagggtgtgtagggatgaagggacttttaagtttgctgaaataaactggaaatagattagcaggagagaaggcgtacaaatttattaacatgcagatgtgcacaggatccacacaaaatgggaagactcaaagaaaggccagatagttgaaggttaaatacccttttcataggggagagggaaatgggggacattgccaattttagagaaagagtaaataatttttagaggagatgagtggcctggaagaacagatgatagcctgggacaaagttcctctgcactatggggcaggtgatgacaagctataggaaagtgagggacagaactgcgcttcaaacaaaggttgttttattatacagataaagtctctaaggtaatggcccttagaagaataatgggaagaacaggtgaaaactctgtctgggtgtgttgtgggtgccctggaggtagagacttcttcttatctctcctgcatcagagttaatcttctctggttagtgtagatttcagggagcggtcaaagaccattgcattccttctggataaactttcttctggtgagagaacttcagagagagcccctccctacacttaggaaaggaatgtggggggtggggaaagctgtgcaggagaaagtcagagaaagaccttggttctgaggcctttcaaccttctttgttcaaagcaatcagtatgccaaagtaccatattttggggtatcattttctgagcctcaacaattgtcatgaagattgagtatgattgtaatataaagggctaacatttttacttgacctacatgagctgatcagtactgagagctcctcttacaagaaatggaccagagagggagggaaggggaaggggaggaaagggaagggaagggacaaaaagaaagaaaataaagaattgaggttcaggaaggttgaataatttaattcgcccaaaggcttacagctgctaggacgttcagccaaaaattacacccaggtctgatttcaaagacactaaaaccactgtttacttatagctacttagtgcaccccatctcatcccacccaatgccacctaactcccacctctattgtgagataactacatgcacgcactcatttggtaagtgggatcctggtgcctatttgactgacatttgagagttagcacatacaggtggcacaggtggtatctgcacagaaggaggaaggtggtgctgacacctctggatcttacacttgggtttagaacatagctggtcactaaagccacagggtagtggcagaacatttggatacatctttaaagactcaattagtatcccctcactgagtccccatcttattcattggttagccccctagactgaactgtcaaaaatgttctaagtctccttgtgttctctttatctttgtttttacaatcacaacacaataacaggagatactttttaatgaatgggcaggaactctccactgagatgtaaacatgttatactgggaattctgctgcagggttaatttatgatgatggagtcatctatatcatagctgaaagcaaggctttggggaagtgaaacccaggaaaggtcagttgtaatgcgcattgtctatattttaatgtaaaataccaattttgttgggaaaagggtggtcgggaaagaggtttgatccaaaaggttggaagttggggaaataattcaaaaagaaaactccaaataaacaacagagttggctggtcagttagccaaaggacaccggaggattcctgaaggtctgcatgtggtgagcacaaacttggtagggaaaaggcaggaatctgggtggggagaaggtactagaattcacaaggaagactcgtaaaatggaaactacggttgctgaaacacgttgtctactctattaattttctgccaaacatttcatgtgcttttagttcttcattgagcatgacatacttcaaatactcaaacctatttccttcttgtaggaatagctaggcatttcctcccacggtccaaggtgagactgaagataagtagaatctccacacttatttgtttactttggtccagactatagagtcaggttaaaagccatctggggaaatagccagtagccaatgcttattagcgtactacttgggtaggtgggaggatgcaagagctgtcaaacagcagccatcctgatgagaaagtgaagaaagccagaagcagcgtctcttctgtggcagtcacacagggtcccttgatactcagcccccaacatgagattgcctcttaggagaattctagaggttaggctaggcttgagacattatagagaacaggttacagcaccccatttttactttattggtaactgagaaagtaagatatattcctagcctcccagtcttagtagtaagaggtacttttaaactgttaatttttatgagcaacacagtggtatggccggcccttcctcctccttcagggagttcatttgatgtagtttggttgattcccatgcatgtggaatagctatgacatcatcaaattaagtgtacactatgtgctaacaattatcggggtgtcaagagtgaaacattcaggtcctattggcagttctaataggtgaatctcatctcactgttttatgtgttcagtgaagtaaatcttcagtaagtctggagtagctggggaagccttcgccaagaggtgaggtctgagctgggccttgagcattgctgagatctgaatgggtggaaaacagaagagaggtcattccagtcaaaagcaagatgtactcaaaaaatagcaaggaaaaacagatcacctggatgagatagcatttggggaagggtaagactatagtatggttggatttattgaacaggcacagtgtcaggaatccaactggctactttatatacactacttggtgttttatcctgcaaagtaaccctaataaccagtagcatttgctgagagtgtatgtgggtagcaggcaatgtatgagatgccgggaatacagagaaggatgattcgatgtttgccctcaagacctcagaatgtaagtctaggatatagtaacaaaataagtttattctagtataataggaatatatacactttaccaaggaagcatagagagcagaaccatttgctttgcctgctagatttcaaaatgacttctcagagatggtgagttctgagctgggtggtgaaggatgtgtaggagtttgtcagataaggagatgaaacaggcattccaggaaaagggaatagcaagttcagagacttggtatagtcctaaattatgtttgtcttcatttcagctagtgctatttcattgttgctggagataacacacacttggattccgttacgtattttcaccttgccaacttgctttgtttgcagaccataatttctgagtttatctctacagcaggttttcagccaaattgctctactaaaataaccctaaaaatctatcacctctgttttctgctgctgtcactggctgtttgtgtccttacttttcagtcaacctcaatggagactggaaagagaaatacaaattgccccagaaagagaacacaggcccctctcttcagcaacagggtgtgagtggatggggaccattatcacattatctacacagacaccgttttaatccacattgccaaggaggagaggaaaatgcatggccttcacagaacatcattaggagggtgggccattgtgcagcatctattgttaatgtcaatacctacaaacatgtccagactcttccattctttagcatactcattctctgagtggtattttatgtgtattattctctgagaggtaagcacggacaagtataattccatttttatgtaagggaaagctgagtaaagaagatgcttaaagaataggtggatagaaaaatgaaatgacttcagctcataagcattttgagtacctattatgttttagtcattatggtagaaacatggcaaatggatataaacaaaaaacatataattccatgcctctgttcagattgttgtctgcccctgagattcctctttttcccactccccttgactaactcaactagccctgctttttgtttgcctgtttgttctatttattttttggaggacagggtctcactctgtcacccaggctagagtgtagtgatgcaatcacaacccactgcagcctcaccctcctgggttcaagtgatcctcctgcctcagcctcccaagtagctgggactacaggcatgcaccatcacacctggataaaaattattttttgtgtaaagatgaggtctcactatgttgcccaggttggtctcaaacttctgggctcaagcagtcctcctggcttggcctcctaaagttctgggattataggcaccagccactgcacccagtcaactagccatgtcttttggtccaacccaatgttgcacctttgcataacaaaggcaattaaagaccacttcttccctcctgccccctgcaaaaacctaatagttctcaaacacattggttcatggaactcattatatatgaaaacccatcaacatccacacaattagcaaacttaaccctctgcagggttgacattgagttggaccttaagatatattcaaggctagttggctgggcttggcttgactcccccttagctctctctataaaagcaatgattactgtattatattggttttcaaagaattctgtcccacattctgttctacttattaccttctttgcttgactgtgatagattgaggccatctttctgtctgtccctgtattaatacattcaggctgctgtagcacaataccttagcgtgagcaaaggaagttaaagaccacctcctccccctgccccctgcaaaaacctagtagttctcagactcattggttcatagaactcattatatatgaaaacccatcaacatccatgtaattagcaaacttaacacacttgaaaatgctacctttcaagtcagtattcatattaggcagactttggagatgttgtggattctgcttcataccaccacaataacgtgattattgccataaagtgagtcacacaaattttttcgtttcccagtgcatataaaatttacgttgacattctactgtagtctattaaatgtgcaatagcattatatgtaaaagtaatgtacaaaccttaattataaatatttattgctaaaataatgctaaaaaattatcagagccttcagagagtcataaccttttggctgatggagggtcttgtcttgatgttgatagctactgacagggtggcagttgctggaggttggggtggctgtggaaatttcataaaataagacaataataaagtttggtgcatcaactgactcttcctttcatgaaagttttctctgtagcatgtaatgctgtttgatagcattttctaaatttatttcaaaattggagtccatcctctcaaacccagctgctcccttatcaactaagtttatgaaatattctacatcctttgttgtcatttcaacagtgttcacgacatgtttaccaaaagtagattccattttaagaaaccacttttcctcatccataagcagaaactcctcatccattcaaggtttctcatgagattgcagcaattccatcatatcttcaggctctacttctagttaccttgttctttccatcacatctgcaattccttcccccactgaagccttgaacccctgaaactcatccgtgagggttggaatcaacttttttcaaagtcttagtaatgttgatattttgacctcccatgaatcattgatgttcttcatggcatctagaatggtgaatcctttctagaagaatatttcaatgtacttcgtccagatccattagaagaatcagtgtctatggcacctatagccttatgaaaatatttcttgcatgataagacatgaaagtcaaaattattccttgatccatgaactgcagaatggatgctatgttatcagatatgaaagcaatcataatcttcctgtatatctctttcagagctcttgggtgattaggtacattgtcaatgatcagtaaaattttgataggatgttcttttctctctctctttttttttttttttctgagcagtagctctcaacagtaggcttaaataaaccatgatgtaaacagatgtgttgtcatccagactttattgttcctttgatagaacacaggcagagtaaatttatcacaattcttaagggagccctaggattttgggaatggcaaatgagcattgacttcaacttaatcaccaactgcagtagcctaaaacaagagagtcagcccaagactacaccttcgtccagcagaagactgttttgtctgcattgaaaatctagtgcagccatctttatcaatgatcttagctagaacttctgaatagcttgctgcagcttctccattagcatgtgctacttcaccttgcacttttatgtatggaggtgacttctttccttaaacctcatgaacaaacttctgctaagcttcctacttttttttcctacagcttcctcactcttcttagccttcatagacttgaagagagctagggccttgttctgggttaggctttggcttaaggaaagattgaggctggttggatattctgtccagacaactaaaactttctcatgtcagcaatcaggctgttttgctttcttatcatttgagtcttcactagagtaggactttcacttttctttaagaactttttctttgcatccactacttggctcagtgcttggcttagcttttagtctatcctggcttttgatatgtcttcctcaccaagcttactcacttctagctttttgtttaaagtgagagacatgagactcttcctttccctgaatacttacaggccattgtagggtcattattgacctacattcaatattgttgtgtctcagagaatagggagacccaaggaaaggggaagagattagcgagtggctggtcagtggagcagtcagaaaacacacatttatcaatccagtttgggcaaggtgtgtggcaccccaaaacagttacaatagtaacctcaaagatcactgatcacaggtcaccataacagatataataataatgaaaacatttgaaatattgtgagaattaccaagatgtgacacagagatgtgaagtgagcccatgctgttgaaaaaaaatagtgtggatagatttagatttgcctaacttaaggttgctacaaactttcaatttgtaaaaagcataatatctacaaagtgcaataaagaaaagtgcaataaaatgatgtttgcttgtagttttaaagttttgtatgaaaacagtagttggataaattgtttgcctaagcctcttttgtagtcagagggctattgtatgtacttggaaaaagtgtacatgctagggacttccagggcagcttgcatccctgaggacgggactaaaaataacagagtcccctgctttgtgggacctaaagcttgtacaatttgtgtgtgtgtgtgtgtaacgtcttgagtaaaaagaattcaaaatataaaaatgatttcatttaaaatgaaaaaagataatgaaaaattacagattttaagaagttggtaaatatcaccgaaatggataaattaatttactatttgcaactaactgcttgacattcttctataacacttttttctataaaattaataatgttcgctatgaatgccttttcatgtgaaaattctgtaatattcctttctacagataggatagaaaggtaattcagtctttcctctggcctggttcgtcaaactttctaaaaaattatggatagtttttagagtttatattggtaaatttaagtgaatttttaaaaaatgttataacttctggcaaacctctatcaaagtacaaattctggtcctgggtgaccagagaggacccctaggtaagacagcactgggggtgggaggagcatttctggaagccattttgacacctggacagtagcaataacttaattctacaaggacaagattgtaagcttttttttttttttttttttttttgagatggagtctctctctgttgcccaggctggagtgcaatggcacaatctcggctcactgcaacctccgcctcttgggttgaagccattcccctccctcagcctcccaaatagctagtactacaggcatgcacctccacgcctgggattacaagcatgtgccaccaggcctggctaatttttttgtatttttagtagagacagggtttcaccatgttggccaggctggtcttgaacccctgacctcaagtgatctgcctgccttgccctcccaaagtgctgggattacaggcataagccatcacacctggccgattgtgagctacttaaagataccccaccaaagaacttaaagtgttccatctcagcaccctggccctgtgttgtcaagctgctcccccttccatcatactgtgcactgtatggtgcctctttatgaaccagacgctgcttgtgcaacagaggctgatcccactgcagagactgtatttgtcttctctttattttactggaagtctttgccaccatccggctggtaattgctccacaccacttctgaatcgattgcttttagagttgttgagcttttattactactactcattggggagagaagagagaaagaagcaggttggcctgggctctgcaagagacggatgttgtcaaattgtctttctccagctgttgaatacaactcataatgctattcaataaaaccagaaagaaaatgagagtacaagggaaagaagagatgtcagaaagagagaacaagagaacatacgagtctgccttctcttggaatagacagcaaagccatattgtgatgttgactatatcatgcagtaatggtgaacaaatgtagcaagaagtaaaagacagagctatttaaatatatctgtgggcaattgcacaaatctgccacttttgtaggtatactgatgtttcctcattcctggagctgagaaaaagggtctatgttttgctttattttatttctttcatttagtttggtaggctatgtaatttgattcaagtatgatagaatttctccttagttatacacattactgttattttgctagtaagtggctttgtatccacaatcaggacactcttatgaactgtttacatctgctattgactgatctcgttgcgtttcctcatgctttcatcaaaaggtagcagttggcagggccattcactggagaatgaggaacacgcataattagatttagtgaagaacaccctcattccaattggaatctgtctttaagaaaagaaaagaaaaaaagctccaggttaaggagcttcgaaagactgaatactgatgtaacttttgttcatgctaattactcacaacccagataatacttcgtttaatgattttatcccatttgttatcccctataacattcatctgcataaattagtttcttgtcaacctttcagaaagggtttaatgacagttcatggtgtttacttattttctaaaagtagtctaagtgagtcattataaattgaacattcaagttaaatttgtctgaaacatatataagtatcatataaatttcagattttacacagggttctcctctactaagcaggtggaatataccccccatttcagaatgccagtttaaattacttgcctggggtaaaataccaaatcagagttggacataaaacccaggtatccttattctcattctactattctaataaccagatccaatgctataatgctgcaaattataggccctatttttcgagtaggatgcatgtgaatgtcatttgtctcttaaatgcatgaatagtgtcttcccttgtggtcgctctactgcttccagcctgtcatgtcaagcagcattgcctttattattgaaatgaagacgatacttagatcattgatctcaatggcatttggcaccataagaactaccagtctgttgtatcatataaaatgatactgcctggtatgcaaatcagccagtgtgtcaacaaaaatgctggcatcagatagaatgtccaaattgctatcactctgccagttttacacctacatccctattagttcctgtctaattaccaatgataaaagtactttgaagtcccactgatttccatgtaaatatcatacaaatttggatttgctttaacattataattccatcagcttagaagttaaaatttagaaaagctgtagttcattagtttaagtcacttcaaaacttaccttgcttagttttcagatagactcccatcctatacttctaggactgtacaaataaaaaaatgaattaaaagacatttcttgatgggtttaatgttttctactaattattttgacagacagtcataatctgttctgagttcttcttttctccttccatttcaattcttcataaaacatggaaaaaactttggagactgaataagatctatggtaatccacaatagatgaggccctgaacacaacatagggaaaacatataacccacccccaataagctcaacttactgtaaactcttgaggagtaattagggacttcagcagtctctctgaaaaagccaacgcattgtaaaacccttttagtttttacatgaatattaattctttgaaagtagatgaaagactttctttaatgctaaattcttatccatagagaataatattagagcgaggatctagtgtattattcccatttcatgaataggaaacggagaagtagagaattttagggaccataaaagtgacccaagtgccatgtgtcaaagctaatatacttaactcaagcctattccagtgggttctcacccttcacttgtgccctaaggcctggcagcttatttcaggagggacacccgttgttggtgtaaagagcaagatcttttatgggtatcagttttaaggggcttatgggaataatcaatatgctatggaagtaatgaagatatttaacgtcctgaaaattctagtctaagctttgagaatgtgaccataaaattgacagggattaactttaatatttgactagttaacggtaggattttttccgttacagtgcactgtgtcaaaatttggtctcgttaaataaattcctattctatcagggatgagcttcccacaaataatgttaaaaaaaaaaaaaaaaggagaaagcatgataaaccttttttcctgtttctcttcttctaaccacagggtgcactatggcagttgcagggcttggtaattgaattcagttctgcaacctgaatacatttctactgtaagtggatctccctcctctaccagagaaagaaaatggcctcaaatgattctgactggaacacagcagccacctctcttgtaaatagctgggtcttattgacttatcttggtagggagccaaaattgctgcccagatgagtccaagcagtagccagaagagaaccagctacttatggggtctctgtctttgtgaaataagtattaagagggtccatcttaaagaaggaagagaagtatggtcaggtgagtcaggcaatgatgcttagtgaagtacaacctcagagttacggtttttaataatacgcaaaattacatgtgtaagtgtattgatatgttttataatacagcatgcccagaatctcaaaaagattaaaaaaaaaaaaagatgttcctaggttctaagtatttttctttgcatagtggtttgagggcgagtcaagtttataggtgtgctgacctttaagagagttaggaataaaagagggcattgagagaaagtggtttgggtcgcagacaccatccctcaaatagctgacaatgaaggtctataataataattggcattatctcaatttgccaggtatctttagtagaatgtgctttatctaatacccaaggtagggtttcaacaatgttgagaatctatttatgaaaaggccaagatgataatgttagctaagtgctaaatataataaaaagtagtcatgaccaccattctagacaagcttcattgtcccgcacactttatctggacctgtggtttctggatggttaagcggcttgtactcacaaagacaaattgtgcattcttggaatacattcttggaggtctgagagttttctgtgagtggtgctgaaagtgtatatttcatctcaatgacaatctcaaaaaattataatgcaagcatattctgaatgatcttgttgaccacctaataaccaggtatttttatagaattttaatgcttgtgttgagttgtgttcatggggaacaaacctgtcataccttatttggtaaggactattgagaaaagagcagagccaggttgagaacataaggaatgcatttatgtcaaggaaaaaataaaatgatgccagagtctgattttaaaaacaaagctatctcacgatttcaaatggagaaaacagggagggagaataaaatcacagcaagcttaattaggtgtgagcatcatgacctcaggagaacctgggccagagaagtcaggagtattaatgtttaccatggaactggtaatttcatttaaaccaagcagcatcagctgtcacattaaattaatattattgaaattttatagcatttatatttatttgtatttaatttataaatgggtgttggttgtgtaagtgctataagtataaatggattgtagctagttttatgtttgtgtatatatatgtgtgtgtatatatacatatatgtgtgtgtatatatacatatacacatgtgtgtgtgtatacatatacgcacacatgtgtatatacatatacacacacatgtgtgtgtatatatatatacatatgtgtgcgtatatgtatacacacacacatatgtatatatatgtaatgctaacaaaaaataatttgaatgattgccaggggtccccaagaatgagctttttcttttaaaattggcctgtactttctttgagaagccttgccacgggtagaggagctattcagtgcctattgagtcaaaatttggccttaatataaatggggaggttttcccttgccatgtttggtgcctgctaggtatagtcacttgctctaatttcagtagggtggtggaaattaccaataggcagaaaaagacagctttgctgacacctatttggttgaattttacaaaatggaaggatgaataatacctcaaaggcaatctggtagattctttgagggaaagagatgtgtctatttacagggaataaagctaagcacattgactgttcttaggttaatggaaaagaataaggctagtgtaggagccagcaaattatgtttcctccataattagagtcttataaaaatatcagcgtgaattacttgctaaatacaaattacaattgttaatgtttgttaagaaaaataattcaatttagagcaagaatgaaagaaatacaggcacccaagaacaggcacagaatacaatcactttaaccaaagcttagcatggattattttcccccacttcagcttcaagtttattctaatctttttctggggggcaggagacagtcggaggggaatgcatctgtatgtcccagctgtgtggcttctgagcctgacacccctgtgctctaacaagacccagggaagaaatccttagcaggctcttacccttatcagaacaaagctatttagttgccaccttaactccagtaattaactcagtggagcaaatttccttatttcatgtaagatgtgagccaaaactctccttgctgcacttcttctatctctgggataaagccaaacagagaagaaactcaaggaccatagaatctttccttgcttttagttttcctttgaggccctacctcccaactccctcctcacctctctccttgaccactgagtagtaccactactcagttaatactgaattttcttcttttccaagccctgcagtttactctagaatttctactgacaaagccaaatcttgctgtgatttttgcccccatggagaagcatgtattataggaacaactaaccctttataacttaggaggccctggggcttcattgcattacagagtcatacaaccataaatgcccagacatacatcaccagggttaaatcattttcagtatgaaatgatgtaatccaatttgaacactgcctcaaacccagtgcccttcatgtggtaagtattcaatacatacctaatattttaactttatttatttttacctcctccgatacaaaaaaatgtaaataaccctcaatgatctgtaaaaaatcacttagttggaacactttgttcatcctctagcaatgtctgataagttagttatcattacatcatgaatcatgatactcctcatcaggcagtaaaaatacagtaatttcgtttaattgaagggaaatacatgtttaccttggtaaaacttatatattatctttaaataaataaagggttatcttgttcaaatagcttaaacccataatcaaatgttgcttatagaggtcctgctttaaggatctcataatgatttgcatatcattagcttgtcagaataccatcctaaaccttgctgatatctgctctctttgcagttcattctttgttgcatccaagtattacagtaagttgttctctggcaatttgtttatactaatgatttgacagttattttttgacccttgaatgacataattatgttaaatacagtttaggctagcttgtgttcaaattgacatgaatttttaaattagtaatgttggtatctagtatatgacagaaatgaaaaataacgtattttgtatttatgcaagaaattatctgtaccgatcaaaactgacctccggacacaagaccagactggacttgcatatgttaatgggaaacaaaatggggaaggggctcctaattacttaagtttattaagaatcccaggatacctcttagaatggtagaggtgatgttagcccttatgtcctggacatgatccagtttaggtaattgctaattacaatctgtctacttaattcccacggcccttgcttctgaatgttattttcttcacttagcaatatttaactattatttgctcttggtgtgtgactgttggaacatctgctgattcctccttctacgttcggcatgatttgcttttcatttggttatttgataattattattttcatattatttttgttctaaatatgtctatagatagaaaacagaagccctgtaaaagttttagatattttttaactgcgtgggctggactatgctttgtcaatcgagcatacagactttctggatgtaagtttgggaacagtgggcataccactggcccatgaaacactcactataagatagtgtcaactcagaggtgaatcacagatagaccagggttttcagtgtcttcaaaactagggctgaaatcacagcacttaggggcttataagtagatccctctaaggatctatcctattctggagccattccaaaacaagagtacctctgttttgggtgctagagcatgctttatttcaatcacaattcaatggaactgaagaacagaattagaaagtgatgagtcaaaaattcttattcaccgcaaatacagggctagataaactccaggtattccacacagtttccatccctctgaaggaagcgagattactcttgtgtccgctcagctatgagcaccttgatttgggatatattgcttggagttcagatggagaagacatccaggttttatctataaactaccctccatatctctaaaagttacttagaggaaatcactgagttgaaacttcattcattccctagcattgtcagatgaactgaagcatctttttcaatagtcaatatatcctgagccttcttagtgaacacagtgcttagaactttcaatgaattcacctctctaagattatggactacatattccaaatgtgtagattttgacctaaattttacccattctacagaaaaccaacaaactccacctcagagagatgttctcactatatctacccaccagggtaccagtctaaaaggccccaatattttctcctgtgttttctgaataattgtgtttgagctagagccgggagactcctcctgtggcttttattaatggaccaaagtttggttcctgtgaggactgcaatgtgtgattcaaatgcccagtccatgattcagctagtgaggggagtaacccattttatcagttgtgctgtcttccactgctgttctctatattccatcagaggaaacaaatggcttctattgtgcataagaatgccatttagtcccaagcaccatttgaaatggaaatgaggagtaacagtaacagaagaacattggctaataattgtgctctgaatagccatttggccatgtgggcagggtaaaggtaattgtgtcctagagtaatacatcttctgagcattccctgagactataattgctatgttgatgggatgcatttttaaacatgtgattgcggctcttagacttaaaaaaaaatggctattttcagaatgatctgactttaagatgtcaggcaagattttgaagtcagaataacaacacacaaacacagatctaagatgtattattgtgtagctacttgtctaactgcatttttttttcttaagtctcaccctgtcttggtgatacacagattaatactaacctcctaccaaacaatccctgttgccactctactgaaaatacattcttgccttccacaagcagaaggctgagtgtctttgtggcttaggagagaacaaaaacacatctatgtattcattgccttgttcacttgcacaaacggagaaaactctttgaaaacatcttcctttctcctgagtgaaagaatgagcaggcgctgcctcccctgatttactgcacccatcctaatcagggtagatgattctgatcttgcattaaacaattactatgcaggctctgggcttaagttttgacttaagtttagaaattgagtagttcccacaatgccctccatttctaaatgtatgagaagaggatcaacaaagaaaaaaattaatgggcttttgaatgagcaacgtgtgtgtgtgtgtgtgtgtgtgtgtgtgagagagagagagagagagacagagagacagagagaggcatgatcttggctccctgcaacctccgtctcccgggttcaagtgattctcatgcctcagcctcctgagtagctgggattacaggtgcccgccaccacacctggctaatttttgtattttttgtagagaccgggttttgccatgttggccaggatggtcttgaactcttgagctcaagtgatccgcccacctcagcatcccaaagtgttgggcttacaggcgtgagccactgtgcctggccaacagaacatattttaatgtctgaaaaaaaagaagaatctactttaaacatcaccagaagggatacacccttcggtgtccccaggccttgctggcttgctgtgggtataaagcattaattcttgtcatttgctggttatagtcctccaccaaaactcttcagttcttggcctctaattcaagctttcttccaagtttctctccactctcactgtgtcatttctaggaggcctcagagttttccacgctagaacacagtcggtactctcatgtgtgttttcattttagcctctttgttgatgtctgctgcctgtcaatccacctgggtttgtaaagtccctgaagcaattcctgccatgagaatgttccttcatccagaatgctgccttctatgctccccaaactcaaagaccttcagggaccagtaaactcaactgcccaaagccaagcacagctgtccacagaattggggcagagattcttctccataggactctggcctggtgcataggtttggctgaggaaaagacatgcttttctccttccccttttcacttctatcccttttcaccaggactcttgaagaatattctcacaggcctcgtttcccctcaggtcagaaaatatgtgcggaacagaccctgagatgctgactgtgcaaggctgttcagacccagtcaggtcaggccctgaatccttgtgatatggaatgagatatgataaattggaaattgtctttaataaattgccattcgtgataattctagtgataattaatctgctgaggctgctataaaatatcatagactgagaggcttaaccaatgtatttccacatagttttggaggctggaagtccaggatcaagaacaaggtgctagccaattggctttctgtgagggatcacttcctggcttgcagtcagctgccttcttgctgtattctcatatcacctttcctaggcagatgcatgcagagagggcaagtgagctgagcaagctcactggagtcttttcttgtaagaacactaatcctattggatcagggccttcacttttgtgacctcatttatcctcaattccttagaggccccatctccaaattcagccatattaggggttagggcttcaacagatgatttttggggcaagtattcagtctatgacaatcctcatttaaactcatcagggaccattgataaaatgctattcattcttccctatgctggtgtggaaatttgccacccaatggatgcctgcaatatatgccagagactttaggtacgctgtggcatggcttagtgactatgagaagactgacatattagcttggactagcttttgttaagcaaatggactattttacaatccaagaaaatgaacaaaattccgttttacttactcaagataaaaatgcattgatactgcaagacatatcctcactgaaagatagggtcacttaaaatatcccatttaaatgcaaaggacactagaaagtatagcaagacaaggtaaagaaaataacaaccttgctaacatatgactaaaataggaactggcagctgggggtgatgagagaaatgaaggcagtcagctacacactgactgccggggagcatcctgcacctcagataagggagcttccgcaatgaatgcctgggcctttggctttgtttcaagtcttttgatctagcggagtccataggatcatttttcccgtgggccagacctctggagaagcaattggcattgttagtttgcactgttagttctgaagctagtttggtaacaaaaagttattgtagtaagtgcacttgtgtgtgtatgtgaggggtgtggatagatgatcatgttcaagtctgtagtagaaaatttctaattattgagtctagagaactaagaatacttataggaggtaattaatccttacccgacatgtggaaaatgtcttataacccttctgtttaatttaacaaaaatatagtctactgttcagatggttaccactcggagcaactcaaactatttccctacagattttcctgtagagaatgaatgagaaatttttttgtttgtttaaggcctgaaattttactaccaaagtcaaattttgagtattgattgttgagtcctgaggatggttatattatcatgacaaatcttgcttattgtttttaattagacaaaattttcaaataactgtgagttattacatatctcttttattatagtgttctatagattgtattttgtttcattacccacactacacacacaaaccacatatacacatgcacaacacacacacattctttctatacttcatgtgaatgctttgagacaatcctatttaacattgacaatgaacaggacagctggtctctcaataaaatctaagataccacagtagtatctgcaaataatatataaattagaaatatttggaatgtttagtttatttgctaaagctcttcagaactataaattacaatattaatgaacttatttttaattcccatcactttcatttttatagaatccagaaataatgcatgtaacttgccattcctccccattagtacacttgagtccaaaggagaggttcacagcatcgtgctcttttgtgatgtggtttagaagaaaaccagctcaggacaagtggactctgaaaatagcagactttcctttactcatcttttgagttttcagagaagagtagagattcagttcattggatattttctttgtactaggctccatgctagaaattggagaaaataataaatgagaacctatctttaattaccattctagaaagaagacatgtacattaaggataatatgtaatggatgtcataatataaatatgtacaaagacaaggtgtagcatagaaggcagatgaattgttatgttgattggagtgtggtttctgttaagggatgacattaatgaggtatcgcctttgcaacttcaagaatgaatagaagttaatcagacaagaaaagaaccatttcacaaggaacaatatgtacacataattcaagacagccagaatgtgaagtaagaggagactcaagttttgtcagcatattatataagtaagggtgagttttggctttgagagttgctttgttgtgtttttccagatagatgtttttcagatatcttctcccctgtgagaaatttctgcaggtttgattgatcctttcagatgctttttaaatatatattagtttcatcactttaccacattgagagtccatgtatctttgactcaaatgcctaggaacagaagatgtgaggaaagggagagagagagattctgtcatttaacaattattattcaagtacctaaaccaaatcgaaatgcctaaaggaatgcagtgggtgatgtaaaagaaggtgtagggcaggtgtaacaacacagaatggtagagaggtgggaggtggggggacgggagagtacgcagctcttctaaggtgggcagctgccttatagcttcagccagttgtcacacagcactggttttgtcagttttcagttctttgaaaaaattggaaatgtgaaattttatatggaactgtcaatttgtggaagttagaaaccactcgcaggccagcactgggaaggccatatccagcctgacttgctctgttttatacaccatgcactctcagtggttgcctcaagggctttagaaagaaggtcaaccctttgccttgtggcttttgtgcattgctttcttaagaggaacataaggaaactctactgttctcagctgctgttgtggttacttggccatttgtaagacttatatataataatgaagttgtcttggagggctgccatgtccgtgatgtagttgcttatctaattttgtaatcttttatcaattccctctacagcttgaaggccaggctgagggtatggtacagaatactaagtggtttcaaatcaagtccaatctctgttgcaatttttattgtgataacaagatatattattaataacaataaaagacaataataatgtattattatattgtaagcttaccatgaagtgtatgggcaacccaaaaagatattcagccatcattaaaatcttttctaatcacagccacacatttcatattatattaaggaaaaacataaaagcaatcttgatgttaagtagaattagtaaagacctaaaggagtataaccgaataaacacaaagtagaataagtaggccagaatatgattgtattctatcaacaatgttatatttgcttagaaatctcttatatttcttcctccaaatatgcgtgcatgcacccacacacacacacacacacatacatatatacatatatgtatatctgcaattgtctaaaggtagatggtatagcataaaggttaagagtgtaaatttggggttcatactactagagtttcacaactgcctatgtagccttccaaaaatatttagcatcctgagctgcagttttctcatctataaacaaggattaataatagtatttatctttgtactattagatatgattgaataagatatttcatgtaaatcatctagcgtactgccagatatattttatagtcattattaatgcaaatcattattgtatcattattattactggagttttaactctctggctgttggcaggaggcctcagttcttctacccatgggcctctccacagagctgcttgagtatcctcagacgtggtggctggctttacccagggtgagtggactggggggtttggggaacaaactaggtagaagaacacctctaccatgtctattctttagaagcgagtcacgatgtttggcccacaataaagaagaatggaaatatttgctaaagattttgcagatgtattttaaagccacaacaaggcaaagggttattattcttaatttgcagaagtaattgagactcaatgagattagataacatacccaagaaaacacagtaaattgcataacttatttactggagctcctccccaaacccctaaactatgtgacattcttgctttaaaaaaaaatggattatacagcacgtgtcaccactgcattctcttttttatgttgttcatgtgtgtctgtgaaatgtgccttctaataaaaatttgaggatcttatacttttccagaatcattttgttgaagtcatgttttggagtacatttgtatgcaatccgtctgataagggaagtatatttctcactggaattagtataggcggaaaacaccatcaatcatagtcatcacaaagcaattaagtacctaattgttcatggctctgagtttgctactgaaacagaaaacttcttaggcttgctaagaaaacttcttaggcttctaagccctcctggggcttggaatccaagaattcagtagaagacggaagcgtggtaaggagaacaagaactgaagacataaacaaatttatttgaaatatggttgcagtggagcagggagagtgaattcaggggaaagaaaaataaaatgaaataagatgctgaggttcaagaaaggataaaaggtaaagtggctgaatttaaatgacctgggtttcagtttttaacaaaacataaaaataactgaagaaaggctctatattttatttaacaataacaacaacaaaaatcaaagtgcttgtttatcattgggactcaacttttgcagagtttttgccttaatttttttctctctaaagcagaatttcccatcactttagattcctttccgtgtcaatgatggcttttaatcccaatttccatcattacccctcagtgaaatgattgcttccatgtttgagtatatatacatatgtctgagacttaggtcaattattttcatgcagaaatcggggagggtgctcctgtttttcatatgcatttgtaaatattttcaatcaatcatgcatttataatccaattgggaagatatgattcagacacaatagcccgtctgctgcaagagtctgttataaaattgatcagttggccaagttatgctatttttttaagttactttgctttctttcagggaagaagaaagacaaaaaagtccagaaaccagcagcagcaggtgctgccaaaatggtattcttcttatctgtgctgatttcaaggggtgtgcaaaagaatgtgtagttgcttttctctctggctgttgggatggcgtctgtctctctggcattatccacttatttgatctagctaagtataggagcagaaataaattaaaaatgctttttcccagaagccccaaggatgttattcacacattctcccttctactgatctctgccagtggtgtgtaaatatatatttagggggaagtggctgaagtcaaaagctctgttggatattctttccctttcagttacttaccttcttatgcacaaatagaaagagagaaatcagaatagcagagaaattaacagacatgacagcacaacaccttctttcccatgtgctgatttgaagaggctcatgtatttatgtcacaaatgtcaaaattcaagtttctaagcaaaagaaaaaaggaaaaactgctaaatgttaagtgatttgcttatttgaagagttgtattacaaagcaatggaatgggagagctctcccagcccaggaaagacaaatgggaagacgggtctattttcattttggcattggacagaaggcagccttctggcctgctgtcacttcctatctgttcagtcttcgttttgcttccccgctgaccatggatcggattctgactcatatcagagactccctcttctgatcctatttatttatctgaggattttttcttttctttttccatagactcctagaatccagaggaaactcagtggcatctctcatattatcctaagctttctcagaaatgtgacatcaatattttaaaattttcagtagttatcaatatttcttaaatctagcagtaaggatggtctttgaaatatcttttctaaattccttctgttataataaaagtcagtgctcttttatatggtttggctgtatccccacccaaatcttgccttgaattgtaatgactcccacgtcaagatggggccaggtggaggtaataggatcatgggggcagtttcccccatactgttctcatggtagtgaataagtctcatgagatctgatggttttataaatgggggttcccctgcacgagctatcttgcctgctgccatgactttgctcctcattcaccttccatcatgatagtgaggcctcccaagccttgtggaactgtgagtccattaaacctgtttttctttatcaattacccggtctcagatatgtctttattagcaccatgagaacagacaaatacactgtttatcatattcttgacagcaataaaacaattgcttactgtcagctcttaacaatctttagtataattaagatagtctatttggattctttttcagagccttctatttttcagtcttttgaatgtactcttattgctaaatttggaatatttttagttttgctgcatcattttttgaatttacctttctcccctcttttgcctattcattattcaaaaccagatcaaacactctttctgtgaagtcagtaacttactccttcagaaatgtaggtacattgaaattggtaaacattatcacactttgtacatacttttacagtgactatgtatatgtgtgtgtttgcaaaactttctgcctcattggacaataaactcctcaagtgcagagatcttgtgttatttatctatgtgtcttcagatactaaatgtggcacatagtagagctccatacatgtgtattgagtaataaattaatgaataaatatgatgctggtggcaggtaaattcttggtgtttactttgaggtccggatcaatacaggatcaggatagtgcttctcttacatctgtttgcacagcagaactgtactgcactgaccagatgtctcaaagtaatgtccatcttgcctggaagtgtctttccttacttggggtcttttaccttcagaaatccaggtgcattcacaatctgcactgttattataccaactctaggtgaaggatgcatgatccaaaggtccagagtttgaaagcttgcagtctgcaaaactgccctcacttctgatttgaattgcaagttcaggggtttctccaaatcactttcagatttgataatttgctcataggacttacaggactaactgaaagctgttggactcatcattgtgatttattgtaaggacaggatacagattaaactcatccaaggaaagggacacatggggcaaagtgagagagctccagatgtgtagcttccagttgccctctcccatggggtcaaataactcctccaggcaacagtgtgcgacaataggcacgatgttgctgacaacagagctctcctaagctttggtgtctgcggtttttggaggttgggtgggtgcttcagcacatacacatgattgcccatatatatatagctaatctcggtctccagcccctcaggagatagacctgagaccatgcgccccaagtcccacaacctaagccgcatcgttggtgtgactcacaacccccaccataagtcacattgtcagatattctggcatggcagcacccacactaaacaaagatgtggctcctactaggcatgctcctcctagggctaaaagatttcttcctagaagccaagagcaacagccagaccattccctgggcaagattaaattccttactgaaccacattttagttcttccacacaggtctcaccaaacctataatttccaagtgagagaacaggaagcctcatcttgctttcacagcttgagacaaggcaaaaggaaacgctgttttgaactttgtagtcagggtgggtgtgtttacaagggatacaatcccctcaagtcaatttaaatcaagaatctatatgtacagtggcatacccagggtatgtggctgtaagtaaatcgtgttttaactctctccctctactttcttcctctcaatgacaaaattattttcagtaataattatttaataatatagtaattctcaccatattttaaaattgctcttcagttttaaaacaatttacaagttagaagcatacatttcaattttacagctattattcaaattcagtagaaatatttcacatatgacctgaaatttgaacttaccaagcaaaagtattatataacacagacttctttttttctactttactgagtgagtggacacagatgaaaaattctaagttagaaattctaagtggtcctaaggaatgaccaaattgaataactcaagttttctttcttttgtcattacaatcagtgtgctatcactttttattttaaatgttggtttaagcaaatgtgtacgtatgtgtgagatatatatatatttcatatatatatatatatataatatatatataatttcagcattaaggagacattgtgcccacataaagtgataatgagactggaacattacaaacttactccttcaacgaatgcatgtagccaatctatgtgtgatgggactgataatataaccaggagctctccaaattatcattcatgtagaatacaatggtttttaaataatcggtaatagaagttattaatttgaggcttacatatgaatctgaaatgcaacaatgtctgtagaaattgtttagaattttgacaagatttgtttgtggatggagtttctttttaaaagattgatatataatattttacatatcagtggggtccatgtgatattttgttgcatgcataacgtgtaatgatgggtatttgggatatccatcaccttgagtatttatcacttctatgtgtaggtaacatttcaagttctctcttctagctactttgaaatatactttgttgctaactatagtcaccctactctgctatcaaacattagaacttaaaccttcttctaactgtatgtttgtaaccatttgccacatctctttatcccctcatcccacccacacacccattccagcctctggtatctatcattctactctctaccttcttcatgagataaacatttttagctctcatatgtgagtgagaacgtgtgaaatgtgtcatctgggtcttgcctatttcatttaacgtaatgacttctagtttcatccatgttgctgcaaacacatgattttatccttttttatggccaaatagtattcatatatatatcacatattttccttatccttgcatctattgatggacatttaggttggttctataactttgctgctgttgtgactagtgctgcagtaaacatgggagtccaaatgtccctttgatatattgatttcttttcctttggataaaaattcaatagtgggattgctggtggatggagtattttatcactgacattgtttagaattgtgaagggaaagcagaattaaattttctgtctctttaaactcagtcatcttttctctatagcacaaaagattatgttttttttttttttttcataactcagcatctttgtgagctatgaaacttgccctgatagccttttcttgcctagggtaggatatattctgaggaagggctgggactgcccatgcattcctgcagagcattcacgggtgctatttacagtcctaattaaatggaggattattagaaacgggaaggcagctataaatagcatggtccattttatctgtttctttggtgtgtaggaagagcattgctaagattctcccttgaagttcagttaactcagaatgtgttctgcttttgttattctgctttggcttaaaaaaaagtctcctgatgctgttcaaagtggggaaaagaaaacaaaaacaaacaggagtcactctcagtcattttagcatatggacagaaggaacacagaatgaaatagagttggggaggggtgtgcacggtataagaaaaaaaaatgtgggcctaatcctttccgataacttttttttctgaaaacaactattaataaatcttatttccaagtctgtagaatattggttctcttcatccaactgtaatgtgatcagtctgttcagggagcagaggagtgggtatgggagccttccctctccgtggtcctgttagggcaccttttccagggagtggggactctgctggcttctctttcagcacactggacggtgcagaaatcagctcaactctagaggcagtgctgggattggaatggaacttgacctggatcaaatcaccgagcctttgcaaattcctgattttccaagttaggacatatctttagacccagagcccttaatcttggctcttgggataagcttccttactgcttctctcaacactcatctccacctccagcctctgctctacaagctgccactcatctaccttacatctctgatccatccccagtattcaacagccttcagcatttcttggttacctgttttaaatttcccaagttcttaacctgtgtttataacaactcatgaacttccaaccaacacatcaactccagctccctccagtactccttctttcaaaagggttctagtcaaaggggtttgcaggcattgcttaagctcatggggtgttttcgtcaatgccccattggatttgttcatgtctttgtttctttgatatatcatccttcttctcctacttatcttaattgatctcaaagctcaagtcaaattatatttctcccagttggtaattattttccccttactttaaattctgaaaacgctaatgactgagcttttcatttagtactaactggatggttagttttctttgtgtatgtgatcgtttacgtggtcgttttgtttctcaccaacacattgtaaactcttttagaattgttatctaatagaaatataagtaacataaacctgtattatatttttggagcatctgaaagatttctctcaaatggtctcatctgatccccaaagcacccctctcaggaagtaatttttttatttttatttttggggaacagggttttactctgttactcaggctacaatgtggtggcacaatcacagctcaatcagccttggcctcccaggctcgtgattcacctgcctcagccttcccagtagctaggactataggcacctgccaccacgatgcccagctgtttttgtttgtttgtttgtttgttttttaagtagagacaaagtcttgctatgttgcacagactggtctcaaattcctgagttcaagcagtcctcccttgtcttggcctcccaaagtgctgggattacaggcatgagcaaccatgcccagctgaggaggtataatattatccatagtttcacatgtaaggtaataggagctcacaagggttaaataatttgcatcaaatcactcagctggtaacttttagatccagatttaaaaattctcaacttctgactatatcctatgttttttgtttggttttgtttatagcttgcagttgcttttataattattatttttttgagacggagtcttgctctgtcactaggctggaatgcagtggtgtgatctcagctcactgcaatctctgcctcctgggttgaagtgattctcctacctcagcctcccgagtagctgggactacaggcatgtgccaccacgcccagcaattttttttttttctagtagagatggggtttcaccatgttggccaggatggtcttgatctcttgatctcgtgatctgcccgcctcagcctcccaaagtgctgggattacatgcatgagtccccactggatttgatctttacaaattaatattagcacttgttaactaaaggaatgaagaaataagtgaaagaatgaaggaataaatacataacaacattatgtataacacagatgagtgtaatgattcagcaaaacttcattataatctcttcagggcacctcctggaaacctgagaaataaaactgttttattactggtacttgcctttctcgaaaactgatagtaaacgtcctgacaagttagtcttaggtatctttccttcagttcaatagcaaatgctgtttaaaagcaaatacacagcatttatagaatgtttttgcctcttcattatattttactacataaaaatctaaaacacacaaaaaagtaaaacacaaaaacagtctaaagtgtgacactgatttcagtacaatacatctagagggaataatttttctctaaattcccaggtggctaaaaagagggctctgtggatagatgtggaaagcgtgagacagatgcttctctgagcctcgggtttctcatcttaaaatagagataattacagtacctacctcacaaggttgtggggatttgttgggaggatctaagtaaagcccttaagacactgcctgggtataaagcagctatgtagcttctagtgtcttaacattgctaagaaaagaaacacacttgccccctttttgcagaagtaagctcctttagtgattttcatctcattttcttctatactttttttttatatttgttgtgagcacgatcttctcttttttaataaattcatatttttcaattatttttattattaaggtaagaagtgtgcttttgttggtggaggaagaaggaagcccctacatgcatagcaacgtccatgggaatgaatcactgttcccttcttttctatgaacttaagattatactcaagccactccagaaaatgaccatgcagtcactgtaagcaattcctctaaaattattaaaaactgtttatgtttggagaaaggcagcccctcttgcagtgataatgactgctatatgagaggattaagctgattacatctttggaatactgagattgtgcaaaatagagggaacgatgaactctccacataagctaaggaattcagcaaaaggatgaatcaacaggagagagagaatatgaagcctctatttggaaactgaacacgtagcctcccagataaaagtgagaaagattttgagtaatatctgaagtcatgtagctgagaagttccatctacacttgagaataaaaacaaacaaacatactctaggcgatgtctatgccagttccatgaagtcatcatagacttgcaatcaattgcttgggaaaatagattttaaagttgaatttctggctattactaggataattttttctcctggacattttatgtatttatgtatctactttggtcagggtgacaaatggtatgtggtatgcagagcttaactactactcctagcccccaggccccataatcttttagtggattcagccaagcagaaatgtatgttgaataaaaccatgtccagggggtgagcagaaagaaatgcatttgaggaaaggatattatgtcaatcccaaactcgatgaaatgttctaagagtatcccagagattggttctatgaatctagtgaaacacagaataccctactcttcacagatgggtgtttatttgcatgagtccataggcatgtgagcttttgttccttagctggaggattagagggaagaaatgacataggtgattagggatgggggagagctgggatgaatatggagaaaggttagagaatgcaggcggaagttgatggcagcaatttgacttagaaccttatgggacttgggacacacgcactgtaaccttgagacctagataacagtgttttatacagattcggagaatagattatttctcccacaacccagctactgctatgggtacagctttagtgctctgcgggctcagctgaccacctgaaggtgactggctggcttggagtgacaatagaagagcctatagcacttgtaagagcagggtcctcactgagattgtgcacagcagagggagccatgaactccctgcatgagctaaggaattcagcaaaagcatgaatcagcaggagagagagaatatgaagcctctattcgattaatgaacatgtggcctcccaaacaaaagtgggaaagattttgagtcatagctgaagtcatcatgtagctgggatattctataaacatttgagaataaaaacaagcacagcaaccaatgtcctttctgttctaattaggactaacttttgagtgctagagactagagggcaggcatagccctctatggagatgggccgttcaagttttaataaatgtgttgcatttgtcatcttagtatggcatgacaaatgatctattttatattaggagctgcccaaagatgttgggttaattttagtcaaagtgattttatgcccacaacatctggatgagtttggtcaaaggaaagaagtttagtagactcataaccagaaagatctttgtcttcacctggcctgccagacttctgagggagtaatcatgcccaatatagtaactggaaggacatgccacttgtttggaaggatagaggcatagcctgagaagataaaggtgaaatctctgaaaactttgataaagaggctgggcacggtggctcatacctgtaaacccagcactttgggaggccagggcaggcagatcactaggtcaagagattgagaccatcctggccaacatggtgaaaccccatctctactaaaaatacaaaaattagctgggtgtggtggtgtgtgcctgtagtcccagctactcaggacgctgaggcaggagaatcgcctgaacccgggaggcggaggttgcagtgagcggagattgtgccactgcactccagcctggcgacagagcgagactccatcttaaaaaaaaaacaaaaaaaaaaaaaaccaactttgataaataaaatataactctaactctagatagggaccgaatgggggtataatgtttgtttaagtttttgggagacacttgataacacaacctggatatggtggagagcattcacattccttttcagtagtagcctcttaacgatgaggtatggatgaacagcaaattgctgctgacttattaattaccatgcccacaccactgatttccctatgtcttacctgtgcacacacattggctttacagcatacgaacgccaagtttgtggcgtagcatatggtgctccctcaaataagcacaactgtctgcctctctgcttatctaatcatagcaacagaaaaattgacttttcagttttcttttccccaggccctgggagatgcatatgccaaatacttggcattctttgtaacagagtcaatcataattaggattccaaattaaagtacactgccagccagggcatgtggtattttatattatttgtttgaacaaatgtattataacttgaaaatggcaaagtaaaagaattaagtaaagctcacactttttatatgtaatcatcttgcggagttttattttatcagaatgttagatgaaatcagaaagcaaagaatgtaaaatagaaaaatgtatctgaaactttattcttttaagtaacaggtttggttttttgtttttgttttctttattttcattttgtttggtttttgaaatgctcattgtagaatgttgaatatggtcagatgttgggtgtgaagtttattagaaattaaccctgaaaaagtatggtatagtcattcagttgccttttccagtggagtctgatttggcctggcgggtgtagtgaaacattaactacacccgcctcagccacccaaagtgctgggatcacaggcgtgagccaccgcgccaggccctaaagcacatcttgattgtaggttgagggtgcagtgccaacaaattctactttcatggctcttgaaattctgtgaacatttaagagccactttgacacagccatttcttgttttttgagagagggtattattgaaattctttttaatccaagatttttgtgacaatttcattcattcctactttctttacaccagtagtagctattcatattcattcttctattttctttgcatgattaactggcatatactagttcttcacattattagcctaataatagtagttacaggctataataggctattaattcattatcatctcctgactcaagtgaatctgctggtaactgagagctcctactcttgtcaatggctttgatcccactgatgaccattttagtgctattcccttctcaccatggttgagccttttctacatattcctctcagaatggttgtgccagactttcacggggagccatttttaaagctatcctcactacagaatatggcagcatttcgttggcagtaaaatcagttaaactgcatatagaatgctttagtttcttctgaataaaatgtgttacacaaactgaagtcactgctctttttaaaaaccaaagcagaataaaccgttttgtaagataattttgccactataaatatagtttcctttggcttcttcttggaaagattttatttcagcttgcactgtgagatctttgtcgttttcaccacacatttccgtcaaggaagcccttggatgactgccatgatttgcctctgctggacgcttccttcaagggctgtcaacacctctcttaattgtctggcttaaacatcaggcgagcaatgtgttaaagttagatggcaaatatacttaagacaaatatgtaaatttttactctttcaaatatgcattcaactggtgtgtatagatttcagaacaaaagccagagagagagcaagaaagagggaggagagagaaatctatatgtataaatagaaaagccaaggtagaaatgctgtgtgtgtaaatacccaatttctggattaagacgtatcacaaatacatatgatcaatacttatgtacatgcaagtgtactgcctttccaaacaccagcaaatcttggtgagcagaaatcagtagactgtccatagtgggatctagaatttgaatggaaacggtcttcaattttaaatattcatctgttttcatttgtagatatgacactcactttaagaggtgatctgagttcaaattccctaaattatatttgcatttgacttattacacatattgttagttgtcccttgaattccagtttctctttgagtaagttcttagaagatatatgtagctaggtgacttatagtcacctcttagtcattctcaaatatgattataggctatttcagattcatttcaggaaaatgtcatgtgtcaaggtgtcaattctgagcaatttttacattttgccaattctattatagaagtggctctcacccataagtagcttgaaggagtcagtatgtaatgtgccagtctcattttcactttatgtgggcacaatgtctctctaatgctgaactgttatataacctgtggtctatctgactaccatagcttcgtagatcaaaatattgttatggtcatataaatgactataatgtgggtgttttagaattgcacttttgtttatgcataactggtcccaactcaaatctgcttcatcattttttagtcaaaggatagtttttcatgtcagtagtacctcaaactccgcttgtgaacttaacacccagctatatcctgttagtttttaatcaggagggaaaaaaaggctgctatttgaactaaactgacagcttttgttgatgagctgttaggcagattaaattctgtcttgctcttcaattgttcttgaggctctgtgggacttacagtaatagaattttatttgtgtcagtaaagttgacagccctgattcagaagaccacagggagctgagatgttgattaaggagcatcatattgaccatggcttaagtgggtaacaaatgaactgagagagaagactctggatctacttttgcctgtccatgaactcgtccaaagcaaatatgctttgagttttcatgtctgttttttaatttttgtggatacacagtaggtgtaaatatttgtggggtacatgagatgttttggtataggcaagcaatgcatactaatcacatcatggaagatagatagggtatccatcccctcaagcatttattctttgtgctaacaaacaatccaattatacccttttagttatttaaaaattctattgaggctggacacagtgacttatgcttgtaatctcagcactttgggagggcaaggcaggaggatcccttgagcccaggaattcgagactagcctgggcaacatggcgaaacccaatctctacaaaaaatataaaaattagccaggcatgctgacatgtgcctgcagtcctagctattcgggaggctgacgtaggaggattgcttgagcctgggaggttgaggctacagtgagctgtgatcatgcccctgcaccccagcctgggtgacagagcaaaactctgtctcgaaacaagcaaacaaaaaattgttaaatcattattgactagagccacccattgtgctatcagatactagcccttattcatttactctatttttttttgtactgagattttaatttctgtacttagtaatagctttcaaaattgtcatgttatcccaggaaattgttatttttatccaaggcttattccatttttttttccagttgtttggggcccacaatattgtttcttttagaaataaagttagaaatattcagaataatgaacacttaagagagaataaggagtagaatacctaaaaaaaaaaaaaaaaaaaggaatcaaataaggaagagatagatagtaaaagagaagtggatgtaagcaatttagaatatattttatcaaaaattgctttttaagtggcattttctcttgctgcagaagacattattgaacaaaaaaaaagcccaatgcaattcaatttaaatttatcactctattattttaatatatttactcagggttaacaactcattaaacaccaaattgctcactcttaatgagtctctgacgctaaaattgagctgacttaaattttactgtaaaatatcagcaccattgcataaaactgtaataaaaattaactaaaagctattgaatgactgtggagtggaaaacagatttgtgacacaaaacagaaaatgtagcacacgatatgtggctggcagaaacatgagtaatagcttttattcaccaaaacatgataagcccatttttcttttgctgtattggagtctgtgaaacatgaagtcatgttttctttttttcccccattactttgtacaacgagggccagtggtggaatgatacagtttggctgtgtccccactgaaatctcatcttgaattgtaactcccacaattcccacatgtcgtgggaggaacccagtgggaggtaattgaattatgtgggcaggtctttcccatgctgttctcataatattgaataagtctcagaaagtctgatggttttaaaaatgtgagtttccctgcacaagctctctctctttgcctgctgccatccatgtaaaatgtgctgctccaccttgccttccaccatgattgtgaggcctccccagcgatgtggaactgtaagtccattaaacctttctttcttttgttaaaaaaaaaaaaaaaaaaaaaagattatgatagtgctagtcaatactgagttgactgtcaaaaataagcacactttacattagccagttacttctgggacactgttgaagagtatgtcacatgtacccacaaattagtcaaacatctttaggcatcacatgatatctaaattagtctttttctccttctccatcccctggttgtccatgaaatattggcctcaaatcagcttgcctatggccaccatggaaaccatccatcatgaacagcacctatgcccctggtacaggagtgcatttctccccaagcctacagtcttctgtgtgtcacagcaatgctgagtttcccacagaggtggcgttgatggactctttctcaactctttgctatggagtatcacctgggctaagaagttctgcttttgcatcaaatttcaatttttttctttttattggatttgaattgttctggcacttttgccactatgctgtctctcaagccctaccatcccctccatctttctaaggtctctcagaaccttagctccaacaaaacccccttctttttctctcattataacacaaatttcctgtgaatatcaatgaagcaaacagatacagtgggagctcgtgaaagacaaaggacaccgagctagtattttcattaacaacatgggctcttgtactgtcaaccaacaagagctttgttataaatttattcacaatggcaatggctttgggcaacatttagatggaaagtatttatgaaaaatatactatttatgtttctggataggaaacatactattcatgtaacaaaatatgacatttaaaggaactcactttttcttttttgttgacagtcaccgtgtcatcaaggaaatcaacatttagaaattatgattgtcactagctcactctgagccatggctctacattttatccttgtcaataagcaatccagtgttaggattttaaaaattgtttaaaatatccgtacaaagagttattttctatcttggtccacaaatttgtcaatattttccacagcatcacaattgtcagaaaacacagtgaagcttaagttaaaacaaatctgcaaagaaaaagtcaaaaagaaaactcttccacagattttcagagagatgatttattagtccaaatttgagcattgaaactagcctatattctaagtttaagaaaactgtaattttcatgtttctttcagttcaatacaatttatatattgaatacaaaagagattttcacttattgatatggctttctaggtgtttaaattctaactcaatattttaaggattcagtaatagtagggtttccatttctacatggtaggcattctctagtttacttttcctcttctttctgtagaaattaactatttttgcttcacagtcatttcatgatagacccgatttcttacactgaaattcattttaatgtttggattgagcaatggtttgctttggtcttaacttttatttattgaggtataacttacatacaatgaaaatctcaaatcttacatctactgttcaatgagttttgacaaatgcataccattgtggactccatccacatccctataacaaagcagggaactttttcaccttttcagtaccctgtaaaagttacctcatgcccaattctccccttcctctaagcaaccactgatctgatttctatcaccatagtttactttttcatgttctagaattttataaaaatgaaatgatatattgtatccttttcttgtctggcttctttcactcagcatactgtttctgagactcagcggattgctttttaataatataattacaactgagtctcaaagatttgaaaaagtcagaatttcttataaaattggacattgtggtttgctacctgctgaatgatgaagacgaataatgtacttcagtgccctgagatagtttttgtctactgtaataaaatatttccagtcttctctgtttttgcattcttcaattattaccttgaagttttaatgttttttaaaataatgaattggcctaattgtagcctcagcacaactactaagttacacattcaataaaaagactttttctttgtaatgttatatgttaatggtcagcctcctagatactgatgaagcccatcaatttctactgatagttaagatcaattaaccaattagttacccattttcatttttcctgtatattctttgtagatcacttactaaaatgattttctaagaccttcactttcttaagtaaagaaaaacaatttgactgagacttggccatttagctaaaatctaaaagacctatttaatttaaagtataagtcaagcagagatcttatcttctgtccataaataataagaatgattgtttttcgctaagtggaaaaagtgagatgaggcaagaagttgaagaatgcctagccaggtagcatatgaagcctacaagtttccagctgtgggtctgatgaaaaataatgagacatctgatggaacttaggatcttatttgaaaaataagccatcaagtactttaactttctggtatttcaaaagtaaaaacatatactaatcacttgtttttatttcacttatttgacactacacatctgtcttagtacaaactcatgtttatgcaatgagatttattagactgatagttcatatcttagccccttttcatagagaatcattgaaaaaaaaactgttcactgtgagaaaactctctcccctcactactgatcgcttatagtaccaattcagtatatgagaagacactatttttacaattattcacatccttaagaaaataaaactctataatttaaacaatgggagtataaaggtattttagaacgtatttgtatatgttaaaacaacagcatattaaaaatttaccttgagaaggccgggtgtggtggctcacacctgtaatcccagcactttgggaggccgaggcgtgcggatcaccaggtcaggagatcgagaccatcctggctaacacggtgaagccctgtctctactaaaaatacaaaaaaattagccgggcgtggtggcgggcgcctgtagtcccaggtactcgggaggctgaggcgggagaatggcgtgaacccgggaggcagagcttgcagtgagccaagatggcgccactgcactccagcctgcactacggagcgagactccgtctcaaaaaaaaaaaaaaaaaaaaaattaccttgagaaaaacaagcaaacacatgaacctaaaaaggcaacagcagatatagtgttgattgatccactgccactccagaattatttatggtagcaaaaataataattttcaatttgatggattcttatttaagcagactcattatactttttggaaaataaaatattaacattcaatataatatgactacctcagtcactttagctccacaggtgattgggatagcgctgctggcctgaataataaaatggtaataacctcagttagaacaaataattgttttactagttcagatacacttaacattataatagatgccctcataaggtgctatgtataaatcctttttttgaaaaaaagcttgaatcatcatgtaaatgttttagggcaactcattgcttagagaaatcctttgaagttttcttttataatgcaaaaactcctactgccttatctgttttgtaaattaggttgtattcgtaccagttttgttgaaaagtgaaacatccttctaagcatgaaagttttagaaataatgtctaagtatatctaaagtagctattataggacataaatgcattgatattttagtggatctcagtctagaggtgagaagagggctaatcataataattgggactgagtgtgttagaattacacatctttcccctgctctgataaaaaatatcctgccatagagagtcactgatactaatcagagcatgtcatatctttcagatatttggggacagagaaaaaaaggtgatgaattacagtactagagatactatagcctttaaaataaatattatatacttttggttctacatacttttaaatgaagatggtccatgaagtaagttatgatcaaaactaatgcaagggcttacagcctaagaagaaagtccagaatttagagaatggtgacctgtcttttcttggcaactaatattatgaacatcaatttctcatcactttgtggcttcaagaaattctcccatcatagagatgaatcacctttcttccaggtcttcaaaaaaaaatatatatatataaaggtctgtgggagataagcttagaaacagtggctgaaaaggagaaaaattcagatttcagtcctcgggggtttgcataacaaatgatgaagtatagttttatagctcatctaagtaccttggtgcttcttttgggtacaagtccctgtttattagacaggcatggtgacttctagatacattcttccaagacatcaagataattttacttcttagttttttcacatgttaggcaattccaagattaatcgtgtataaacttgtttgacacttgaatcaatttttggttttacataaacggcattatttcatgcatacctcagctgaaaattggcagttatgtattagtgcttgattttctagaccagtattaaaattaccttccaaaaatgtttcagttgcagaaagtattggtggccaacaggtcttccatgagtcgggacacattagccagtgtcaccctttctctagccagtcagttctatgagaatggtattggaagaacagacaacctacctgcagcacttgccctgtcctgttcatattgtggacaatcatcaaaagataaaagggcatatgaaagatttatggtaaatgtcttccattttctctgccttgagtacactggagttagctttcattttcatagttgcttactatgaatgtcttagatgtagcatgagaaaatcttatattttctttttgtctagaactctgctgttcaatatagtagtcactagctattacataattaaaatatggctagtatgaataagcagataattttaattcttatttcagtataatttccatttaaatttaaaaactcaagcagtgtaaaatagttttcatcaaacacaatttttgttctaataaaactatatttcacctaaagcactgaaaatttagcattgagtttcagtgtgctgttaagtataaaaatatactagattgtaaaaacttcatatcacgatataaattatctccaacaatttttatatacattagatgttgaaataatattttgattatattgggctacacaaaatacattattacaattaatttaacatttctttgtacagtttttaaatgtgaatccttggaaattcgtaattgcatatgtggttcacattatgtttctcttggacagtgctgagctagtacattctgaaatatgtagcaattatttctctatggcttcataaagaaaatgtcaatccaaggctgaggatttatttatgaaaatctaaagacagccggttttcctgatggttcatgccgtgggggaacgggtctctttcccaatatataagaggacaaatcttgggatgggttttttttttttttggtcttttatgacattctttaatgatttctcctgtgcttgccattctgccttgtacgtaatacaccctttctagcaatgggtttaaaggtttttccttcctctcctttttgagctgtaaaatatgcattatggggagaggtgagctgatagttgagaaaggtcattaagggttcagcctggcttagtcggaaagatgtgaattcaaattgttattctcccagatatatactaacatgaccttggggaaattgcttaacttttctaaattttagtttgcttcatctgaaaaaggtacctaatagggaagttttagatattaaaatcaatgaaatttaaaagaatcaagaaatatgataatgcctagtatataacaggccctcaaatgtgttctgaaccaagagatccctgtaagagttaaagaaacaggaaagaaacacgaaaagcggctcaacagtcaaagacaggttaattttgcagaataaacctgagaggggcttctggccaatttttggacaggagcactctctcttacagactaagagtatttattggttttagggcgagagagctttatcacaggcttggaatgtttctgtgtgggggagaaatttatggtggggttggaatgtctctgtttggaagggaagttatcctggggctgacctgtctctggtcggggaggggtttatcttatggttggaatgtttctggactgggatgttatttgtggtttatggtcatgctgacgttagccattaagctgatgccctttggatttaggcagtttttgatcaaggggaactttagaatggtggtgcttgtccaagatagccatgctcccgctgtgtcaatccccaagttttaaatgtgtatctttacttagtgacttatggagtcgtaactattaggacacatacagcagtaagtctaaggcatataccagcttatcagatggatcccctacctggcaaagggaagatcctctttctctactaccttagtccttctttttatactctgtgcagcttttcagttcttccacttgcattaaaattagattacctcttagattagatcaaaagattgtccctggttgtgagaagaaagaatactttaatctagcactaatcccttaatacaccattatatttgggtacattttttttcctagcagaaaaattatttttcagccttctcagaagtactaaaagtcctttgccaacatcagcccagtgcaagttaacctgttatgagatttgttttgtgctttggaaatgcttgtcagacaagctttcaacattgagatgtgtgatttaaattagtttgcataagaaaatgtaatgccagggacaaatttctctctttatcccttcttatactacaaaacagacaaagagggttaggtggttgctttttagtatgcgagtaatcacttgggattcacagaaatattagatgcagtgttattagtgaaaccttagttccctttatagatatgtcttatgtcccatttgtaatattattattgttgttaccatacgcaaactttatttcttagtttggatgcttggtctcaaccagacccattacctccttatcttcctatctcttagggtcacttcatgcttagaggcaacttgttgaaagtggaggtcagcgtgatcctttttcttagaagacatagccctttcatggaacttacgtagctgattcatagcctgagtcagtctcttggatctgtgaaaaaaaggaaaaatgaaccagacatggtgtttgcagtcagtcttctttgaatataaaatatataggcagaggaaaaaattaaaccaggcagattaacctcaaggcataaagacaaatgctaaaatgtactctaacgtgaagggttaagcattccaagatgcccgttggaaggttctttatccaacacttctctacccattccaaccccagtgtaaacattaaataattcttttaaaatttgaatactcaaacaagaaagtaaagcatggaagataatttttaaatcattatgtagtgattagaggaagaggaataaagggtaatgtgagattttagaaataggtgctttgaatagataaagagatattgcaaggatagatgaactcactatcgtctttgcagtatagtatcgttggtgcagaggatttgggatagaaatccagtctgggggccgagatgtgatcattatgtgcaatatcatcttcaaaaagtcaggtcatggttatcagtttgctacaaagaacatcttagtctcatttcctgtccaaggcaggaattttcccctgaacattcctgacagaagataacctgttttgtgctctaatcacccagtcttctaccagaggttgaagtgacattttggctccattttctcgtattttatgcaagaagctgggaattccagcatcttactctgctcatcagggatcctgagggagctggtaatatgcagaaaggatgtcaaagggccatgttactaatagctgtggaagctccgctatccacaaagcagagattatgaaacagtctatactttggctagaagcctaagcagaatctcttctacttccctcaaaatctatttcttagcaccagcaagactgggtctgtccagtgggttgtgggtttggggagaagcagaggaaagattgacatcatgtggaatctggaagagacagaacacatctcttggtgcttttgaaggtacagtgactccatctagtagtaaaaggtgttcaaatgaatggcttcaaatttgaccagattatcaaatgctgcttccctgataaacagctcagacatgggttagaagaggtggccctgggatgggaagcagtgcagactctcatgtatgaatagctccaattctcaaaaaattcttttagttaactgctgtctgtcttcttctacattgcactcaagcttaactctgcacttttaaaatcaacatataaattataactttctctcctatgataacttttcaaatgttttttgacatctattcagtaccgagctcccttttgaaaactgggccatcatttcccaacctccaatttctgactgtatttccataatttatttaaagactcctaacaatggagccacaatcataactacaggtcccctttatatctcaggatgacattcatttggttctaatccttgaactcatttgaagattctaattgctcttgtattctctcctcttctatctggaacttatctccctgataagcatctgtgttgtgattcttctagagtggagattatttctcttgtaaggaaaaaaattaaaactaccttgttctactttctctgttgcatcacaccttctctcttaagtaatagtcctaaaccttctctgttcttctccagacagatcataaatgttacaccccaacctaaaacaaaacaaaacaaaaccttccttcatgaattattattggccttgtatgcaagactgagttgatcccagtctcaatttacctgataccatctatttcaacaataacaataataacaacaataatgaatatttatttagagctttctctgttccaagcactgttctgaccactttatgtatatttacttggttgactctaacaataattactgaggtgggccaggcacagtggctcatgcctgtaatcccagcactttgggaggctgaggcgggcagatcacctgaggtcaggagttcaagaccggcctggccaacatggcgaaaccctgtctctaccaaaaatacaaaaattagccgggtgtggtggtacacgcctgtaatcccagctgtccagaaggctgaggcaggggaatctcttgaacccaggaggcggaggttgcagtgagctgagattgcatcactgcactccagcctaggcaacagagtgagaatctgtctcaaaaaattaaataaataagtaaataaaaataaataattactgaggtggctattactaatttctctattttggtgatttggaaactgaacttagaagttaaagggcttgagcaaatacattggactaaaaggtggaggagctgaggtttgaagtttcaatgcaggcatctggctccagggttcatggtcttttaccatgatgccatgctgctatgtctacttataggagtatgcacgcttttatgttctttcctgtttttgtgagccttattctagcttttatatatttttaaactctgagctccttagagagtttccaatggccagtcaaatttatttaggtcctctgaatagtctctgaatggaagaaagtgtttttcatccctaaagcccacatgtatacttcagatgcacaaggttcaaggtcagggcctgaaggagaaagtatcacagcacaagtaacaatgttaaacttcaaaggaagataaaacctcaaaataagatattaaggtcaaatactagaatctgcagggacactgtcctggttaagaggcaatagaaaggaagtagcataaggtgattcagcaggggagagatgtgagaccaacagcgttagatcagtggggctgtaagagagactctccaaattcatttatggaggagaatgccagaagagtggggagagagtgagctagagattcccaagtcccctggcaacgcgaaataccaggggtactagcacccaggtctttgcttctaatgccattctctaatgaaagggacaaggcatccttggaaaaatggctaattctagcacagagcagggaatagacaagatgagcccggagaatctggtagtgacagaaaggaagaaaatgcagaaagaaaaaggaaggaagacaagggaagggaagggatggtatgaaaggaaggaagaaagggaaggaaggaaggaagtccaatgaatgggattggggtctatttctatctgtgttcttaacaatcttcttcatcagggattagattcttgtttttttctttgttgccttttttttttttttttttttttgagatggagtctcactctgtcaccacgctggagtgcagtggcgcaatcttggctcactgcaacctccgactccgtggttcaagcgattctcctgcctcagcctcctgaaagctgagatcacaggtacacgccaccacgcccaactaatttttgtatttttagtagagacggggtttcaccatgttggccagaatggtctccatctcctggcctcgtgatctgcctacctaggcttcccaaagtgctgggattacaggcaggagccaccgtgcccagcctgttgccttgtttctgatgggagtccaagaatctccaagctatctatatgagaaagacaaaactactctttctatcctgtactgtaatcctacctgacaaatatatccttcatgctccttgtcattttgagcaaatagcctgagcttacctcactttcatttgaacttcctccctctttattgccaaggtactacgttcctttatctctgtgcctgaacaagccccccttgctataatcttcatgctgacccctcattctctagagtatatgctgttttctgcagcagactacacggccagtgcccttgcttggagcagatctagacatcatatcgccacggtcttcattctgaagtaaccttagaagtcactttcagttcataacattaaagcacaggttacaactcatatgactacatgggccatataaaataaatgagtcaatgtgccgaagatcaggaaagtgatagctcaggcaagactgacactaattcttggcctctctgtctaagagacagaagagagtgctagagactatggcacccaggagaacccagaccgaagagggcagccactgctcagctgctgccagtcatcacagcacaggagcaatggaccaatattatgaatttatcttcttttgaaagacaatccagaagtcgagacttttataaaaagtctgaattcattacctgtattaaattttctttgatttaaaacactgatcaggctaaatacaacatacctgtaagatattacatacctactgcaagaaccctgcctctgcatataaaggagaaagataagcacagttgattctcttcacaagccctgtgtcatgcaaacaggattaatagcccagttctaggctaacaatttcatagcaaccatgtggttattatgtgttgtatatatgaaattatgccataatgagctgtctcctaacaagattgtgcaggctataaagctgttttatagctccaagagagttgctcctgagttcattgacagtgcttattgtttctttccatctcagttacttttgaattaaaaagtgctcaccctactctttcttctcggctacaagttttgccatagtgcacagtgtttcttcatcttactttctttaaagaacctttcccatctcttcagttatttctacctgttccaacctccctcctgatagcaccccagtagtgggatggaatgtgctggaggggtttggccagttcttgggggagtttcacagtcacctgtctacagtttcagtgagatgggaatttatcaagctgaaattagcaaaagacaaaactgacattgtttaaacacatacttaacaaaagatctaaccagttcctcctagaactagaagatatttgaaaattagagaggagcttttttttttttcctatcgctttctttaaaacacacttttccatagataatcttatctttttggcatcaacaattatttataattctggaatgatttccaaatctaacttgtaaccatatttccaactacctgccaagtgtctgtgctggaattacctaatggcatttgatcgtggctcaaatgtgctcactcaactttattccgtgggctgctcacctcccctgtgtggagcctgggagcctctgaaggcaaatcttgactcatctctcacctctcaactgatcaaccagtagccacacctgacttaaatgccatctggaatccagttctctttcagctcttccatttcttacaggaacttttacagtaacttctgaactgttactcttgcctctgaactgcctcctttccaatttattattcacaagttccctggagttattttctttaaaacaaaatgacagctttgtttcgttaaaagactgtcaggttactccattccattggccagagggaaagggacaaagcaagtacgtgcccacacaatctctttactgtggtatttggtagctaatacatctttcaagcctcatctacttcatcgcctcctgcaccccaagctggaattacatgtgtcttattgccctgtccctgcatatcttctggccttatagacctctgtgcctttatctatgtcgttccttctacctcaacaggtttctgtcctaccatggattgtctaatgccttctgcacatgttctttatcctaggaagcaaaatatttattccttttcctgcattctttaatacctagtttatgcatgtctcattgcacttattctaatcggagcttgttcttgtcattttttttcatatttttttccttttgtgggggagtttaggacccaagtctttgtcctcttttggtttaactagtaccttgcacagaaaaggtagtcaataaatgtttgaaaaaaaaaatcccagtttgataattagttgaaaatttcttcagttaatgaaaacttggtacaaccaaaggaaaatgaattatcagagtttactatgctccatgagattcttttcatacaagtatgctgcagaggaatggaagagtgggaatataaataaatatgaaaaattcttagaacaatcttcttattatttgagacagagtccagctctgtcacccaggctggaatgcagtggcatgctgttggctcactgcaaactccacctcccaggttcaagcgattctcctgcctcagcctcccgagtggctggaattacaggtccccaccaccacgcccagataaatttttttttgtatttttagtagagacggggtttcactgtgttggccaggctggtcttaaactcctgacttcatgatctgcccgcctcggcctcccaaggtgctgggattacaagtgtgagccaccgcgccctgccagaacaatcctattttctaattggggtttttctttgttttttgtttctttgtttgtttgtttgagatggagtttcactctgtcaccgaggctggagtgcagtggtgtgatctcagctcactacaaactctgcctcctgggttcaagcaattctcatgccttagcctcccgagtagctggggctacaggcgcctgccaccatgcccagctaatttttgtatttttagtagggacgaggtttcaccatgttggccaggctggtcttgaactcctgacctcaggtgatccacccgccttggcctccaaaagcggtaggattacaggcatgagccactgctcccggactttttttttttttaatccttctactttactcatactctccaaagttaattcacacacaacctccccaataaaatggaagtgaggtttaaaatcagaccataatttaaccagctgaccaaatgccattttgtataagaagataaaaagctaccattgttgttatatctcagagcagaagctctttcttcattttattctttaaaaacatcattcagggttgggtgtggcggctcatgcctataatcccagcactttgggaggctgaggcgggcggatcacttgaggtcaggagtttgagaccagcctggccaacatggtgaaaatctgtctccactaaaaatataaaaattagctgggcatggtggtgggtacatgtaatcccagctactcaagaggctgaggcaggagaatcgcttgaacccaggaggtggaggctgcagtgagccgagatcaagccactacactctagcctgggcgacagagtgagactccatctcaaaaaaattttaaaaataataagtaaaaaataaaaacaccattcaatttatagttagcatgaagctacaccatcaatctttcctcgtgttcatgatcatggctcagcatttttctgaagtgtcattaataagccatgttagcaggaatgacctacacatatgcatgtcaggagggcttcaggccactgctgtctgtgtgtcaccttgacgtcagccttgataattgtccagggcctccaacttcacagcagtacctgggcctatgtcaggttgagttctatgatcacacactattttcatcagaaattttaataaaattatttttttctcagatgacttcccgcatactactaagtgatctgggagaaggagtcttagggtgtggatgggattctgccttgggcatattttgctctactgggccctggagtctttgcagatgctgtcaagatactgcacttttttttcttttttgagacagagtcttgctctgtcacccaggctggaatgcagtggcatgatgtcagctcactgcaacctccgcctcccaggttcaagcaattctcctgcctcagcctcccgagtagctgggactacaggtgtgcgccaccacgcccagctaatttttttgtatttttagtagagacagggtttcaccatgttggcccggctgctcttgaactcctgacctcaggtgatctgcctacctcggcctcccaaagtgctgggattataggcatgaaccactgcgcctggccgatactgcagttttgatggccatcactggtacaacaccctgcgtatgccaagactgtcatgccttgtcagctataataaaaagcaggagacaaatggccttttgttacctgaaatgatggatcagtatgtatgtgcaaggatgcacgctgtcaagttcttgtgggttaatcatgccaggctgatggaggggctccacgagttccaaagtagaaggagcttgaactccaggctgtggctttgaagcagttgttttctctggaattagctaatgaggctctctttgtttgaggattggaaagcctccaaaaacccactcaggagggaaattaacaaatgtctgttttgttacctccggataaatcttcatgatgaaatgtgcagccggtccacctcttcaatcttctctcttcttcttcctcagtggaagctcaattaccatgaaggccaaaataaataaataaataaacaacaaaccaaccaaataaataaataaagcagataaaccgtggttctttgcttaaaaaaagttgcagcaaagaaaagctttagagtaatttctagttagaagtggctgtgagattcactgtcttctggtgatatttgaaatatactatattcatgcaaatgtttctgattatttaaacacattatctgtatctataattatcagtagctgctggcattatgtgagcatgcaaaagtgggaacagcagcagtaacctgactcatttcaaccaggatggaccatctcagagggtcacagttactaatctctgcatgaactagattttataaggtattatgattctttcatagcttgtaacttttcattgatcatcaactttactgatttttgttaatactggaaattttaataaatgggttgtgcacaggtacttattgagcatctattacgtgccatagaatattctgattattaaggatgtcaaggtatataatccagagtcacggttttcaaggaactcagtcaataattacaagctaatacatgggtaccactgttctaggcacagcgtggcagaaaagaatagcgtggacacacattcaggggatttaactaggagaaaacagtaaggaaggggatcttagcagaggtagtatattaacagatgtatatgacaacttacactgctgtaagtcatcctgtttggctggcaagttttgctttagaaactgggtaaatattgttcatgaaacttctgtgtaagtttcacgtgaatgttttcctatgtgtatgtgtgcatgcttatttgcatttgtgtgcacttgtgggtatgtgtatttgtcctgtgtcacaataaaaggtatctatttctggactttgcagtcaaaaacattggaaaactgtctatgtaggtaatggacacaatagaatttagaaagcaacttttacaaacattgcagatttgtaattttctaatatcattgatatataaagctgagtataccagacacttgtaaagaaatgatcttttccaatgaaaacacaggtgttaaacagaacctttcttctggcctacaaatcactcttctaacacttggaaaaaattaaagaaatattcagcaatgtgtagaatttcaatcccagagagacaggaagagactgtatagctgcagatgcaatatgcttgttattttggcaaaagcgtaacataagaagccaccaactctcacagaggaagcagagaaattcagtatttgcttgtaacttagatatttctttctttgttttccccctaagaagaacatatcttttctggtgggaaaagggaatttagataattaaagcagagggaataaacattttcaggaccaaagagaaaatagccgtttgagccacatatttaaatgttaatctacaatttttttttttttttttgagacaggatttcactgtgttgcccaggctggagtgcagtggtgcagtcttggctcactgtaacctcccttctcccctcttgggctcaagccaacctcccaccttagcctcctgagtagctggaactacaggcatgtgccaccatgcccggctaattttttgtcaagacggggtctcactatgttgcccaggctggtctagaactcctagactgaagtgatccaccagcctcagtctcccaaaagtgctgggattacagatgtgagccaccaccgtgcctggccatcaaatgtttttcatagtggactagggctttatgatcccataaaaattatttccctcatggaaccactccatttatgtattataaagctgtcaacatctggttttattgataaatatccctggggtttttgagctttttcttttcaacatagtgcctgtgttttatcttgacctttgctttaaaattactgctagatgtaatgaggattctggaaagagcatggttcaagattttgtacaattgatataatgattctgaagcaaataatgggaaaggggagagtttcagaatttggtggccttagggtaagcttatgatttgttttatctttcctcatatctacctaatgctgtgaaattttgggattagatttggattggggacaaatgaggagtggaaatagtggagggagaaagggttaggaaagttacagaacttggcaaggctcttggaggtggtggattgatttctctggtgttgtgaagtgtcatcttctttcttcagttaaactgaagtacaggcaagcttctcctgctgcccctcagtttcactgtgtcaccatttttagtagggataagcagagacttgttgttggtaaggacaggaaggaaggtgatgctgatgaatttttgctggtgctaggttagctgccagccggcctggcaatggctgtggtccagccagcctggggcgcttctagtattctctgtcatggggcaatatgttaacgaattaaaatgccaaatagaaatgagacagaattccaaagacatgtaaactgaaaaacacctgtccccatttgttgattttttttttcctgcatatacttaaaaaaccccaaacctttatgtaagagtctcaggagtgcagtgaaaaaaaagtgtttattgacgagccatttccaatttaggccttaaacttcaagacccatttctaagacccatatgcttcaaaacgttctatataattcagctcaaaaggatcttcctctcctctagatctataatgtttattgactacatccctcaaagagcagtaatgcatcatggtgaaataaaaattgaactgcaaatccgaagacttgaattctagttcctgatcgtttttcatagtgtatttaatcacacagtttaacccctaggtctccttcactgtgactcattatggtgagttcgcgtgagaaagtgtccaccataggacactaaattcaaaagagtgaccagtaatgattgttgtcccaaggatgtccaaatgggaaaaccattatcagtctacactctaaaccagaagggacttattccaccaaaagaggttaagggctccttaccacagtcacaaaaccagaatatatattctttcagagaaaacccggatacagggcatgagattagaaccctagaatggcatatcaaaaacttctggagtctgttgagtagaagtttggagaataaacaaattgatagattgatatttgaatccccggcagagtaagaggaataataagattttgaatcaagaagaggaattctgccacatgcaactaggaagaaaaaagcaaattaactgtgataacactcattagggattatcattatatctttaatgaggaggtaataaagactgattatttactaggcatcccttattgatccctatttatcactacgtagagtaaaatgtacaatttttcctttcacttgtggatttcattaatttatacagtcatcacatattgattgtacatatactgtataccagacactttattagctttaagaataccaaaacgaatatgccagatatagtatctaacttcatggagtttgtagagagattttttgaactgaatttctcagcaaactaacacaagaacagaaaaccaaacaccatgtggtctcactcataagtgggagttgaacaatgagaaaacatggacacagagaggggaacatcacacactggggcctgtctgggggtaggaggttgggggagggatagcattaggagaaattcctaatgtagattacgggttgatgggtgcagcaaaccaccatggtacttgtatacctaggtaacaaacctgcacgttctgtacatgtatcccagaacttaaagtataaaaatgagaaaaaaagatgcacaaatagtgtcacatatagtataataatgatatggatatggcctaattcatagagtcaacattctgatactaagaggaaggaaaaatcaaaacaaaataaagaaaaaacaaagcagacagtagcctttaaccgtttccttttaaagaaacattgttatctgggttcattacttgttagaaagtaatgtgaagcacttaataaacttcaggtggtggtattaggtaattaacatgtgaaattcctcatatggttatttaaatttcatggtagtatttaacagttttcatgtttatggccttttcctgcaactaagttgtaaaatccttaagggaaaggatgaggaaaggaagacaagagagaaactagcatttgttgactggctactacgtgccagccacagcactagctactaaacctgtgtcactttatttaaatatgaaggtcagaaagcatttctcatgttcctggtatctcctgcactgcctagtataatatttcatacttacaggtgcttcatcaatatttgtgttggttgacttagcaatttaaactgcttctaaatagagttacgtgagtttttccccaaagactcatgcccttttttaggaggcaaactagccctttccatgtcaccttccttaagaagcagggcaaagaggtgacagtttttatactgaaatcagttgtttaattgttcacccatttatcaaagcctctgtagagttaaagacaagtacagtgcccatgtaccctttatgctgcaagttctggacagatagctgtcaatgcctgaaaatagtgtaaattcactgggtgaagagagcaacttgccagggggatgtgatgtagccccttctagagtatggggttttctacttgggcatagtcagctgctagtttgttggattgctgctgctggggaaagaccaggccacttcatgatggaatgcgtcaacttttggaaagtcaaattcaggatgcagtttcaactagtagtaactatatttttctatcttttaaaaagtgaaggagcaacagaccagtctagacacatggacgggctttagggctcagttgctaaagagatagaagtaaaatattatagaaaatgcttatagtacatgttaagtgagaaaggtaaggtaaaaatggtttatgacctataactgtgtgaaaactaaccaaagagacacgtatcatttaaaaagatttaatgttgtgcctgtaatcccagcactttgggaggccaaggcgggcggatcacaaggtcaggagatcaagaccatcctggctaacacggtgaaaccccgtctccactaaaaatacaaaaaattagccgggcatggttggggggtgcctgtagtcccagctacctgggagactgaggcaggagaatggcatgaacctgggaggcggagcttgcagtgagctgagatcatgccactgcactccagcctgggcgacagagcgagactccgtgtcaaaaatgaaagatttaatgttggtcaaattatacacaacgattcaacagtactggaagttgaggaggacgagcaagccagatagcaccaatgatcatgaataaattccttatctttcagaaagcattattgttcagtggtttcaagttttggatgtgcactcacattgcctgtatggaatcctggctccacaagtagttgtgtgagattgggaaagttgcacttgtttaatctgtaaaatggaaaatatctgaggattaaattaaaatatagctggatcatgcatagcataatacttggaatatactaagtcatgaataaatagtactgttgtcatttctttgacattaattattaaggcaattaggaaattttccatctagttaacatatagcaaatcaaactaagctgtgaaaaatatataatatgctatggtaataagacactgaactgtgatgctattattggggtctgtctaaatccacagaagcatcagaaattcacataaatcaatgctaatgtcaatgcctagtaaattatagtctcagaaacatgaagattctagatgttttccccttctttgcacactttgtttatatttcaccctattactattatcacctatatttatggtttttcaatcatttgtgagtgcttggaggaaattcattggttcagcagttgaaccagggtattgaatagtacatgaggactctcagactctgaagagctggtcgggtgtctctggctaacacatttccagtggataaagagctgctccagggacatctccttcctctgcagtacagtgatctttttgctggtgactagaaagtccaggggaaaggacagccagccaaagggtggcaaactgatggaaagtgggggcaagctttctgtaaccatgtaaaagaaactgccaattcccatgaaaatccattgtctctttttcttattaacaaatccccaacaagccaccatggctcaagcctgtaatcacagcattttaggaggctgaagcaagagaattgcttggggccgggagtttgagaccatcctgggcaacacagtgaggcatgcatctctacataaaaattttacaattagtctagtgtggtggcacatgcctgtagtcccagctactcaggaggctgaggtggatcgcttgagccaggagttcaaggctgcagtgaactaggatcaagccactgcactgcagcctaactgacagagcaaaatcctgtctctaaaataataataattttaaaataaaaataaaatgctaaaatgaaccaaatctccaattttatttgaaataacactgccttagttttttaagaaagaaaataaaacatttctcaccttttctaacagtcaagctggtatgttgctttaagtttggtgagtgtcaggtatgcaaaagtgttgagtggcagatacagaaagactgcttaaaggcatctgactcagttgcaaaggacatcctttgtccttcttgctgcctgtactatgaatgtagtggttggatcttcagaagcctatttaatcataaggtaatcttaaagatggaagttatgattaagaatgccagaacacaaagataaaaaatatagaagtctcagatgaaatttctgaatcagccttaaactataatgcttaaactgtttaaatgtgaagggataaaatttggggcatttatgccactattttatgttatcgttgttacagtgagtacaatttttaattggtatgtgtgtaagatttgctcagatctcaatcaatggttctaagaggaaaaagcttaattccaagctgcctctctcctgtctatgatatcccaagcatcacaaagtacacttccagctcctcagaccctgtccttgttttgcattgtttagccaaaccacttcttaacttcaagtagcaaatagataactcacattagcattaggttctcttattacaagtaattgacaagaattgtaccagtgattaggtgttgcccaaagatcttttaaaattccatgtgacccaaatactaccaaatcctaaaagatttaactaactggctcactaaccaatgcacacacatacttacttatttcacccagtatgtgttgactaccttttgcccaccaggagctaggcaggttcacagtgcctagctcccaggcacaaagataaatcagaaaccattctgtctaagtcaacctttcattttagcttagcaggaaacacactaaaccacggctgaaatatgccaggaagttggtagctggtgatgcctctaccacaccgcagtgcggttaatccagcattcgacttagtcgaaatcacttttttcttccaatactggcatttttatggatggatggatggatagatgaatatcagtatcaaaaggtccatgctttattttctaataacaattcatgtccaattatctgactgccagcacagttatctgctatggttgttagaaactttagaaagaagtaaatcctccaaaattgtcactcttaaaatctgagagaaaacagaatgaatagataagagatgcttcaaggcagttcagctctgtgatggttccgttgagatagaacacacatatacaaagtgtttgaagtaagaatttccttcgaggagaagcacaaagggaatagaagacccagcatttgttactggccttagataagcttactgttcacttatttatcaatgtaaaaacgcccagttagtttttagctcaaggaagagaggacatggccaaagatggccttcatgaacttttttttttcctgtgtgaagtatggaaactcattttcagtattggattttgactggattgtcttctacccagaagctggctctgcagaagttatgatcagatctttggaagtaacatttgatctaccgccgaatatagatccccttccttccctcttctactccctccttgcttttccttcttattacactgatttcatgcaaaattaattatcagtcctgtcacatcttgcactgctaacagtggtcagtattgaattatggggaacgtgaacagaattttcagcagcctaattgcttctcctgtgcccagcaaaatgttacgttaaatactcacagcaagtagactagactgtattctatttccataacaaactggcgggatttcattaccagaatccctagcatctactcacatgactctttcctaactgccctatcagactggtcttggataaagtaaattcctttccaaagctgcagctgcctagttaggtattgaaatattgtatccacttgcaggtcaaaaaggaaaaaataacaacaacagcaagtggtccatgagagtgaagtggaggtattaaaactaggctgggtcttctcttggaagatgacagactgagtcccacagtgcctcactccattcaaagcaattaggagtgtaggattgcagtgacaacggatctccagggctatcatagtgctttacctaaagataacaagagattagcccttagtgacagatgactaatatattctgtggacactgactgagagtttgggagtttctactgtccctctcaaggagcttagagaatatgtacacgggaagacaaaaattaaagaaataaatgtaatgcactgtataatgcataatgataaatgcatcttcaaggtacctaagtaatttagaagatattgcagtgggagaagagtactgagatattcaccaaattcctaccagaaaaaataacacttgagttggctgatgaaggttgactaggagttcattagacatagtagagaaagtcattttagaaaaaatgataataaccagctttgattgagagctcaattttgcttgtcctttttggaagtgtactgtatgtatgtattagtccattttcacattgctataaaaaactgtccaagactgggtaatttataaaggaaagaggtttaattgacccacagttctacatggctgggaaggcctcaggaaacttacaatcatggtggaaggggaaacaaacacatccttcttcacatggcagcaggagagggaagtgcagagtgaaggggggaaaagccccgtatagaaccatcagctctcatgagaactcattcactatcaaaagaactgcttggggaaccgtccccatgatccagtcacatcccactggttccctcctacaatacgtggggattatgggaactatagttcaagatgagatttgggtggggacacagccaaatcatatcaatgtattaaaacagttaatctttatagtgatagtgattctttgaggtattattcccatcttaagaatgaggaaactgaggcactgagaggttaactcacagctagtaagtaagagagcaagaattcatacccagcagtatgaagaagtgaaggatgagttgggaatacagaacttgatcattgagagtcatactagtcacaccaaggaagttagagttaatcaattgacaacggggagctcttgaaaagaactgacaaggtcagatttgcattttagaaatattgttgtggaaacagaaggattgattagaaggaagccagaactggagcctggaaagttggctacatggctttcacagtaatccaggaaggggatgatggaagagaggctgcagcatgggagcaacagctggagtgaagaagagaggatatgtgtgggaaatctttaaggggtacatttggcacaactaggtgatagacagaagtgatgggtggggagtagaattggtgaatctactcttctaactgcctttccctatctccagtctcaccaagtatcttgaattaggaagcaaggaaaaggggtcaattaagaaaaagggagagcaaggttaatggagaacaggctcaagaaggaagaatttaaaaatggaataaggcaagagaggataaagaaactacctatggagtgctatgcttgttacctgggtagcaaaataatctgtacaccaaatccccatgacatgtgatttacctgtataccaaacctgcacatgtatccctgaacctgaaataaaagtttaaaaaaatagaatgagttaagagatttggtaatcttgagaaatgtctgtaaagtgtccatgtattccatgggttcaatggggatctgccattgaaattcatagacctgaatatcagagaagggtagaagattagagaatttgctgtttggatagtcgaactccttctttcatagatgaggaaagtaaagtctagagaaattggagagacttgtgttatatcacttagtttgttacagagctgaattcataccacccatttccatgtgccctcaaatagtagccgacctcttccttcctgggagagaatccttaaccaccaagtcctgatctcataggcctgatagtcaatccttggaagggatactgtggtgcattgcttagatccgtcccacttaaccctgggacccacatactcactcaccaacctgctgggagtgctggtcactgacctgtctcaactaggttgactccaggaattgctctctgctaaaggattttttctgtttcagggatataccaaaatgaaaaaataaaaattttatataaagagcgtttgttgcctgggttgtatgcctgtagaatacattcagaggtagaattactgtttcaatagtattaataaatttttacccaatggcttttcaaaagtgtgcatccccaatggcttttcaaaagtgggcatcaatacacacttagaaatatgcagtaggatcaatttcaccaattatctcaccatctttttagaagctaattcattttgcattcttaaattccactaaatttcaagagagcagttaaagaataatacaaaactttgaagcactaaatgtatatatttaagatattatgtcttctgtagtcaatggcaaatatcaagaatagagaagatgcacaaaactgaccagtagcagaaacagagatccacattctaatctcacgtctttctactttggttaaaggcaataattcctatttcactcactgatgagtctttccctaacgagaatgtgactaaaaccagttgagtttgcgaaagggatgtagaaagagacaattaggtaaaggtgaaaaatgagactgacgaagtgacgttggtcaatctcctgtttactgagtgcaggttaggaaataacatcaactaggttttctggaatttgagaactgagtattataaaaacactgactccgttattattattattgtcatttttaattttggattcagagataggagctgaatagcagcaaaaaaaaaaaaaaacatgcttatgaagagctgcctagtgaaaatgacactcctttggcttaggaagagaaagaaaatgaaagccttacttctttcttctactgattgaagtttttactttctgctgtttacttgggtttttaatattgaagacttctttgtagtctctgatgagttttgaagattaattttgcagaagtaagataatattcctgtttaccagaaatatttctgaccataagactcattatttatttattatggatggtcattttatatatttttaatgcttatttaagactccggagtacatgtgcaggcttgttacatggatagattgtgtgccactgaaatttggtgtaagaatgatcccctcatcattcttagcatagtagtcaatagtcaggttttcaagcctcaacccttccctccccctctagtaatccccagtgtctattgttgacatatttatgttcatgagtactcatagtttagcttgcaattacaagtgagaatatgtggtatttggttttctgttcctacatcaattcacttagggtaattgcctccaggtgcatccatgttactgaaaagaacatgatttcattcatttttcttttctgtggctgtgtagtattccatggtgtacatgtaccatattgtttttatccaatccaccattgataggcacctaggttgattctatgtctttgctattgtgaatagtgctgcagtgaacatacaagtgcatgtatcttttttggtaaaataatttgtattcctttgggtataaacctagtaatggaattgctgagttgaatggtaataccattttaagttcttttggaaatctccaaactgctttcaacagtgtctgaactaatgtacattctcaccaacagtgtagctttccctttcctctgcaacctttccaacatctgtttttttgtttgtttgtttttcactttttagtaatagccgttctgactggtgtgagatgatatctcattgcagttttggtttgcatttctctaactagtgatattgatcactttttcatgtaattgttggctgcatgtatgtcttcttttgagaagtgtccgttcatattctttgcctatttttaatggagttatttgatttttgtgttgaattgtttaagtttcttacggattctagatattaggtgtattttaaatgcatagtttacaaatattttctcccattctctaggttatctgcttactctattgatagtttcttttgctgtgcaaaaagtctttagtttaattaggtcccacttagcaatttttgtttttgtggtaattgcttttggagatttagttgtgcattctttgccaaggccaacgttctaaatggtatttcctaggtttccttctaggatttttatgatttttaggtctcacatttaagttttcaatctatcttaaataatatttgtatatggtgagaggtgtaggggtccagtttcaatcttctgcatatggctagctagttatcccagcaatatttgttgaatagtagcgagtcctttccccattgcttgtgaccatgagattttatgtgatgttgaaacccaaaactacccaaaggaattaactactgctggttaattgtacctatattaaacactttctttatagtattttccttatttgggggccatctcaaagtcctaacaatcagaatttgtgtcttctcatatgatttttactcagaattacacagaatacagtattcataaaaatgaaccaaccataaaatatttattcttctactgtgtcaggtagtcttgtaggttcctaagagataccaaatacaggttcataattcttgtcctcgaagatctcccaatctactgataaagcaagtaccatatgcatgaaaagataaatgtctttataaagtttcttaatcatgagtgcccatttgagtggtctgtgggtttttagaagttattcacagaaacgaggctccttagttctgacatggggaccatttgtttttattttcaaaaagctctatgaagtgatttggatgtaaacctctgaaaagaagttattgtcttaaatattcatgggaggctaggcctacttgcatctggagttggctccagaagtctttacaaagttagcttggcattggctgggtttcaaagaataaatagaaggggataaaccaagaagaaatgtggatatatatggggcacgattgaataatttccagaaagaaatcagatagtacaaggagtgtccagagaatgatgtatatggctgaaatggaagtgttatagaatggtagttagtaataaagctttaatatcacaagcatattgaaacaaattgcatgtaaaacactgatgtaataaaaagatttagattgttggagtattttgatgtcaagtacttgtcttcctggtgatgtgaaaccatgcatatgtgttttaagtagaaatgtgactccatgggaaaacatgtaagaacatgagcaaagatggatgagaatagggtgagtgtgaagggaaaacttattaggatgctagttctctgaggttataaagaccataaggtagtggcattggagtacaataaaaagatgacgacattttaaaggaagaacctccctggcagcatggctgaatagacctgggaagaaagagaatttatgcctgaatgaatggaaaactgatgattttgtatctcaaagtggataatttatttagaggcaactggctttggaggaaagagaaaatgaggggttttctaatgtttgagatgatagagaaacaggcaagcatagatactttggaggcagttggatatgtagcattggagtcaaaggccaagtaagaggtagagaaagagattttggagaacttctcatggaggaaatacttgaagtctggagaatggatgagacctgaagggaataagatatgtagatagagacaaaagttgaagggtaacactcagactttgggggagatctacatttaggaagtaggaggagaaaagtaaaggcacagtaagaaaaagaaagattcaactaaagaaaaggccaaaaaaagtgtaacccacagagaaaagagcatttctggggctaaggagtgatcaacactatcaaaatactacaggtaaactagtaaaacaagtaatgtcagcattagtttccttgtctgcataacaataatagttattatgaggtatttttgtgaataaactgaaatgatgactattaagcatttagcccaaggctaggtaaaagaaaaggctagccaaaagcatctgttattataaatataataattactaatcagcacccaactatgccgggcacttttgtagttacacatttgaataagatgcaaccctcaatttcaaagaggtaagtgtcaatacaaagataaagatgtgaagaatagatagataccattttgtggtattgtttctacaagaaagatgtaaatacaatggaaaaggtgccagtggagaaaagtgataactttatgagtcctttgccagacataagtgatagggttttctgtacatattacatgttattcttagacttgtgcaatttgctaagccagtttatagactcttgaatctgtgtaattgctatgttcttgactcaaacctgaagggacagactcttgggagggaatagccaggttcagccttttatctttcttctgtgcacagaactcttgcttactttctccaccatgggtaaatcagaatggctttgaacaatgagcattttctgcagcctgagcagcagttgctctttagacccaatttacaaattaggaaaaacaaataaattatttatagcatgacaaaaataggatttggcttaatccaacagctttctcagttacaatgcttgctgctcaagtaatggatcaattcacagttggctaaatccaggtgtttttgaacctttctatttaaagtatggttctctgaccagcagcatggagatcccttggatatttgtttcaaatgtagaatctcaagccccactccaaacttaactggataagaatctgcgttctgtcaacaactttagaggcactgtatgcagattgagaggcactgggctagaatactgaattagggctgaggaacatcatcacattctccacgctgtcccagtatactgttggatgatgtcagagcaacgtgaaaggattttgggttatggtttagctcatagtccatgcagaagaggccataattagcacagggtaccatggcacttctcatctgagacatgtgacatggatttgcacagatgagtacttctgacctattaatgttagtagtagaagtgatccttttgtcagtggaaaaagctgccagactcagaagcaagtaaaacctgaagaatcttttagaactgttagtcaagaacttcataggtggtttatataaaatttattgtcacttgctaactgcatggctttcggcatttcttaacctttctaaacttcaatcttttcattcatggaacgtagataattattgtacctgtatgacagggtcaatgaaaggttaaatgagtgaagatacataaagtagttagcacaggatctgggatttagtgagggcccagatactacttgtctgttattatttagtttatttagtttatttttatttatttatttatttgagacagagtctcactctgtcacccaggctggagtgtaatggcgcaatctcggctcactgcaacctccgcctcccaggttcaagggattctcctgcctcagcctcctgagtagctgggactacaggcatgtgacaccacgcccggctaactttttgtatttttagtagagatggggtttcaccgtgttagccaggatggtctcgatttcctgacctcgtgatccacctgcctcggcctcccaaagtgctgggattacaggcgtgagccaccgcacccggcctattacttagtttattattatttcattattattgagtatctattatttgatcttttatgtaataatagtgaaataatagacttctgaatatttgcagagaaatccaataattttaagtgatattggcaaatactatgatattagaaatctaggtggtacttaggaatctattttcttagtctctattctgtggccagggaaactctttattccttttgtccctgctatatttgagacaaagatcttgaatgcatccactcttccctaaggaaatgccatcaactcatcatccccataccatgcaaatgccttttacagctgcagagcaggtgtgggcagatgcatacagcagcatatgaacacatgtttaccctccttggccacactttgtcttactctatgttttctaggaacacattttggggtggaaatgcctttattccatttatatttagtcaattatctggtttagcttccattcttacaacctaattaaattcagcccatcaactcagtttaaggcatagcagctgtagacacttcgtttatctacttggagagaaaaaagataagttggtacaggggttccccatcttgtgaatgcaattcccattcaactacatgcaattgaatatgagcatgggatggtattctggacctaatgttaaattctgctactaagctatcatagttgaaataatatactcaactgcaactttacatattttccagggaaatgcaaatgattgcttttaaaggaatgacaactcatttgcctgcagatttcattcaggatatttaattctgaactactagcctatcacccattaactgccatttctaatatcttttgactccctcaaagagggaaactcataatttgtttcacttagaatttacatttttttaatattctagaaaccatgaaagaaatcactgagtccttagctcctgttttttttttttttttttttggttgttgttaaattgtagaatattagaatgtttcagttttactgattgtatttgttaatcattcttcttccactaccgttgtcttttcccatcctcttggaagggtgttagagaagactctatatctcacctacagatgatttcacctagaagcttagcctcccttcatgactactgttaaagataaagactgcctttggttgacaccataacccacaagaaatgattgcattcctcctggatggggagcaggtgacattgcagatgttacacttcccacatggctaagccactgatcgagattaaaaattcaaaagacaccaaagagccacgttattgtcccctcacagggagctctagaaatacatgacctaaattgtttcttctaagcatattatcagttccattttcaaggtatcaacatgatatctttccattggttcacaggaagaccaaagagtgacaagagaaaaatgtttccatttgtagtttttctacagactcatggtataggtcagcttttttattgtaaatatttaagatgtacatttaaggtgtctccatatatgtatatatatatatatgtatacatagtgaaattactagtagagtcaagaaaattaacatatccatcatctcagttacctttgttgtcataacggcacataaaaatctactctcttagcaaatttccatgatacaatacagtagtagtaactatagttatcatgctgtaccttaagtctctagatattcgttctacataattgtaactttgtaccctttaacctatatctccccatctcctcttccactgcatctggtaaccaactttctactctgtgttactatgtatttgactgtttattagtgtcgacttaggagtgagatcaaactctttcactctctctttctttcccgtttttttttttgtttgtttttgtttttttttaaacaagatctcacactgttgcccaggctggagtacagtcacatgattccagctcactgcagcctcaacttcccaggctccagggattctgtcacatcagtgtccttagtagctgagactacaggcatccaccaccacacctggctaattgtttgttgtagagatgaggtctcactatgtttcccaggttggtctccaactcctgagctcaagtgattctcccacctcagcctcccaaagtgctggaattatggtgcgagccactgctcctggcctctacagtatttttcttgctgtgtctggcttatttcacttagcataatttcttctgggtccaatcatgttgttgcaaatggcaagatctccttctttttaagactaaataatatgccatttaatatgtacatctaccacaatgtctttattcctttagcatgaggagaatattgaacattactttgagaactagaaaaaaatgaacatgtgggttattttagtggttaaaaaaaataggaaaataactataaagacatgaaccaactatcaggggatgtttgggttgtttccatatcttagctattgtaaaaaatacaagaaagaacagacatctctatggggtgcttatttcatttcctctgggtatacccagaagaacaattgctagataatatggtagttctagttctaattgtttgaggagcagccattctgatgttataatggctgcacctatttatattcccactaacagtgtacaggcattccctgaacttcactctatattttatttcccaaatgagatggaagtacatggaataaagtagtattcaagccagtttagtcttcacattctaaatcacccctctatgaaacctctccagattaccttttctccccatgtggatctgaatatgctcctttattcccagttgtcctgtatgtatccagttttacagacatagcatctgtaaaggacactgttgtcttacaccgaagtgtagcagttaagaactcagggtttgcacctttccagctctgtagacttgggccggcaactgagcctctttcacccatagtttctttatctagaaaacaggagtgatgcatgtctcataggaccggtgtaaggattaaatgaattgtaactagaaaattgttgggaaataccaaatataattatataatgactagcctctgtaggtataaacagtttaattacttataagtttacatgtctgcttatattaaagagggaaagacttagactgtagttcattttcatgtctctgtaacacagcactctgtttagtagttacataaatagtgattgaatgaatgtacaagtgagtgaataatcatctcaagtctatcctttgtcaaggaaaatttccagatagagttctttctcctttagggggtctttaagatggtcccagtgccagcccaagaagagccagagctagatcttcaaggcagtctgggacctggatcctcccctccagatgcctagaggtatctcctgggaccatgatgggtctcagtcataccccttcattcattggttcatgtcttcatagtcattttctttttttttttttaaaccactgaaataaccctcattgtttgtcattatttctaatactcaatgtagttttaaattttctccccatgctcaagaagagaaatggaaatatggcaaacatctccatgaacccacattttctcacatctttagatcaaaaactcttattcttcagataaacaggttgtaaaattttcagtgttgaagagaatgaaatatgacatttgattttattgattcattgcttatttttggcagaagttatcctttattcagtttcatctctttatgtcttaccacctctttgtgaactagccacttgccttgagggtttacaaattcaagatttctcagcacgattagccctaatagtatgctttccttccaaggtttccagattatccaatacagtattatttctatcccaatcatgtttaaggattattattttacatagaaataaataaagaaaggggaaccaatacaaagtgttagaaagacagctacgattaatatattggactggcccattatcagaccctctagattttacaggtagctttctgatcagaaatctcgggtgagaaatagtaagaatgatggccttagttaaatcctctatcaatatgacaggttaaaaaaaagacatatgagttagttaaaagcacctctcccttggtaactctaagtgttttagtttttcagatggcaatttgtgactttctatagctttttcttgagatgaatttgtggaccagttgaatagtgatagaaatacaggacttgctaaaaattacaaagtgtttatggcagttctggcaaatatcctctagatcaccagataatgccaagtcagcaatattatcaataatgagttgcctactaagaaccaggggaatgggggcatggactgaaactttaccatagacatctttgctattctggactgttggtttgcttcctagtgtacttctgcttatcctttcttccctttggcttcattgagatcctcagccactgagttctatcttggtgcattccagccacaccccaaaagaataacaagaatgaataagccatccatctctgaatgtagagcaggttggaaaatgataaccttattcattattattgcttgatacatttccgaatttgtgttatctgtcattaaatagctaccacagccttctttcattcttctcggtatcagtttaataatttgttcaatgaatatgagaaagaacaggatcacatccagattttaccacttactggctgtgtgacactgggtatggttattaaccccatggaacctcatctttaaagttcagatgatggtaactaactcatgaggttgctagggattaaatgaagtaccatgtttaaggcttctggcgtgggtgctgagatatagcagataagagatggtagtcaaaaagaatgtgtcttactttttttatagtatatagagtgacaattttcaatacaaatagtgtctgtatatatgcagtcttaacacggcattttaaaatttcattgtagactttaaaaaacctaacaaattggatttcagcctctttcttactatattagaaaataaaagaagattaaaataaaaaaaggtttccttttaatcaatctattaataaaaagataagtactgagattccgttgacataaaagtaattgaaagtttataggcaaattcttgaaatagaaaggcactttttttcctcataagaggacagtttagaggatttaaaaagcaatcaaaggtctcatgttttatatgatcaattcaaattgactgaattttcatcatcatcctcctccctccttctttctgatagtctacatttgtggaatagagagatttttgtctttcaaattctaaccctgaggatttttgctaggcacaagttaagacctgtattgttttctcctaacagttcctatgacatttttaaagtatttactttattctagtatgtccattctgttgatcttcgaaggacctgtgtctctaggtgacatctgtattcaaccaattttgaagactcttctgattggatttagcaggagatttgtagagtgtggggctttgactaggcccaggtcctttgccagccaggcatagtttgtccttgtgagggcagatattggaaaggtggaggagaattatgttctatggcactttcagaagctcgagaataccttggcagagccaagccttctgcttagggaatggctagcagtaacaaagcatggtacctgagatcaggtacatagtcaagagttaggttgaaagtcgaatattaacctgaaaaaggaagatttggcagcacagtgtatcttacagtcccaggaaaagagccagttgacatgttctgtgagacttcagaaaactgtacgacgtgaaagtagaagcatttctaatcatagttatattttgagtaatctcttcacagtagaatgagtcccccaacactggatgtactaaagccaaaggaagggccaccacttttcagagttattgaaggaattcacccatcagatatgttttgattttattcagtgattgttcaaactagatccgtttctctaccttattttcaatgggcagtggttctctagttcatcaaaaagtttttcctctggaatttttgagaagcaatagaaatccagagcatttaaaggtgatgattaattagtatattaatcttagataaatgtccccagataatttttaaatgatcaaatttgtatcaaagacattatttattttagcatcattttgatttcttctactttgttgctggggttggggtaaaagagggagaaatggagaccatatataattccgaaatgaaaaaaaataagcaacaatacactgaattttcttagagtaaacataatgctatgctgggttgttatagcatttacaatgctcatcttcccttacacttgaatgacttcctcctggatctgaaacaccttcctcaagagcatcatcacaggactgttaaaaatcctaacatgttacaattttactacctttcttcttccagtattccagcttggagactttgcgtagccctggttaattaatgttgaacttttcagggtatctgtgaatcatggtggggggtagggttggggactagaatttaattaaaggcacaagcttcatggggattgtgaaatcacagattccaaaagggagacagccattctagggagactgctaatagggagtaagcagggtgacaaagtgtgcaggaactgaaggaagatgacattcaaaggtctaaacaggggagaagaaaaacaaagagatcagcatgttacagctgagccttttcaaatgcacggtgataaagaacagatatgttttgtgtgtgtgtatgtgcgtgtgtgtgtgcgtgtgtgtgtgtgtgtgcgtgtgtgtgtgttatgcacagtggcttgaaggtagcagccctttcccctgatagaaatttgatgatggcagcaacaaaacctaaacagagaataattaaagagtaagggggtagttaatgaaatgaaaataactttaaaaggatgaaaagaaattgttgttaacacaccatgtggtttacctatgaacctagctgctgtggaaacataataacacagagtcagctcctgcaatgcaagtaagccacttcctgggtagaaatggggctcttcggaaaaagattaacttttctgtccacaggggtattatttagctcactggaatagcaatttgacaaatggtgcctttatggcccaagtgaatactgctggtttctgctaaaagggcaggtgctacaaacccaagaagaaaaacattcttgcatacttgcccccctcagcataaggacaactttgagcctgttcatttttgagagttccagcagtggaaagaaagctctaaggtttggtaacctgtgactcacagagagcagaatttcaagcctagttgagaaaacattccttcaagagggtgctgcttatctgctttggccacgttggattttggaatcttaactgttcttgtcactttggtcctggttcaagtcaaaagagtttcttctacttgggacttgaattaggtgaagactgacggacatttatttacgtaccaaaatacacaacatatgtgttgcagttagttcctccttacagaggaactggtaagcactttagccaggtagggctaaggcaattttcacagttctgactgtatgaggattcctgtttctttgttgtcctattttatgcatcatccactgattctcatctaaaccccaggccattttgcgtgaaaatagtccttctataaataaaaaatttagaccagaggcaaaggagcctccatctctctgcttacaattattgctcaatgttcaaagttctcaagacttatctcttcctattgcaatccctaatatacccgtatatagatacatttaggtctgagaatgcttgagcttaaagagagtaagttcttgtttggtacaagctctgcataatacgtctgagctgtctccctgctttagaatgcagtggtagaagttttttttacagcactctgattttagccaaggaactaacaaccgttgtgtaatgcactagctaaaatagtctcctttatcgtgtaaaagtcatccattgactcatttatttatttaccaagtgcctactatgtttcagaaagggttgtaaagggaacagctaagacaaggtccttgtcctcatgcatgtcatactctaatgagaggagacagatcatactttaattggtaaattatagtcaattgccaacagcagtaagtgctagagaggaaaggaccagaataagggtaggaggtacttttgagaggtgacaacgtgctagcagccctcgctcgctcttggcgcctcctcggcctcagcgtctgctctggctgcgctggaagagcccttcagtccgccgcggcgctgtgggggcccctctctggggctggccaaggcctgccctctgctggcggggaggtgtggagagacaggcagaggtgggagtcggggctgcactgggcgctcgctggcaggcaagggttcgggctccgtggccccgcactgggcgcagccggctgatgcctgctgggcttgaaaagggacgagctccctctgggctgccggagtgcccgtgctaggttccaaagtcgccagtgagtgccactgagaggtgaagccggctgggcttttgggtggagtggggacctggacaacttttctgtctagctaaaggtttgtaaacacccaatcagcactctgtgtctagctaaaggtttgtaaacgcaccaatcagcactctgtgtctagctaaaggtttgtaaacgtaccaatcagtgctctgcatctagctaatcaggtaggggacttggagaccttttctgtctagctaaaggattgtaaatgcaccaatcagcactctgtgtctagctaaaggtttgtaaatgcaccaatcagctctctgtcaaaacggaccaatcagctctctgtaaaatggaccaatcagcaggaggtcggtagggccagataaggaaataaaagcaggccacctgagccagcagcggcatcctggtgggtctccttccacactgtggaagctttgttctttcactctttacaataaatcttgctgctactcactcttagggtctgtgccgcctttatgagctgtaacactcaccgcgaaggtctgcagcttcactcctgaagccagccagaccacgaatccaccagaaggaagaaactctgaacatgtccgaacatcggaaggaacaaactccagatacaccatctttaagaactgtaacactcaccgcgagggtccacggcttcattcttgaagtcagcgagaccaagagcccaccaattctggacacacttcgagtagtgtggttggagaaggtccttgggagaagacaacatcacacctgaaataagagagattagaaggagccagtgataacagacctggaagaagggaattcaggacagagggagcagaaggctctaacgtggaaacaagaaggccagagtacccagagcagaatgagaaggggattcctaatcaggaaggaatcatatgtggttgttcactgagagcaatcattgacagtctcacccatgttctacaaaatttcacttcatgattaaaacaaattatatctctgtctttgcctaagacgtgtattaaataacagcaatacaaataataaacatattaagtccattctgtgttctagtcacaatattaagtattttatatatattatttaatcttcacattactgctaagaagcagtgataaaaccaagattttaaaatattaaccaatttctcaagactaaacacagctagtaagttgcacgacctggatcaattctccattggcttgtttccaaagccacaggtttactttaacatatacagcttttatagcactaacattgtgttctatgtgtccgtcattaagttgggtattttacacacattatcttaatatataaaacaattatatgcagcagatgttattaccatgatactgcaaataagaaaactgagaaatagaacattcaagggatttgctcacagccaaataatagtaattggcagtgttaggatttagactgatttctgtgtgatctgtagtccattctgttcaacactacatgtacctgccttcccgtggtatcattgccccagttctgaaacctaggtctaggtcgcaggagaactagcttgataaggatgggctttagagccaaaatttaagccatgctttgtcttatctgcataattttatgttcccagtcaggtaaaaccttacccatttatctttatttcctatcaaatgcagacttccctatgagctgttgcttggtaagttccaacccaatatgatgtcaccactgggtggacctctatggcacctgtctcactctgccttggttccagttatttttgtatatgcttcattgattatttctactcacttcccggaaatgttccctttccctgagaaatggagttgtatctccctcattgatgcatcctctgtaacatctagctgtttaatgtgtcactcagaataagtgctcaataaatatttatcaaagtagctgatgtttcaggaagtctaggaagcaaaccacctcttctgttctgctcttggattcaagaacttaagaggattttgttggaaatccacaaagaatattttaaacgagacacataataagactctcttttgagatgagagaaaccaacaacagcaaaagatgggtggtaacagaacggtgctgtttgctgccagctgatgttcttcttgcctcctggaaagatagagccagaagtcttccatcacttcttgggatgagccaactggcctgttttaacctatattacttgagttttggctaccaaaactctaagcattcacatgggcccccacgaagctctgccatctgacactttcagcaccttcaactctatccagtctcactcctgctgtactaacaaacattccataaacacaaaaccaaaaccacttaaaaaaaaaaatcttaggctgtccctacaacttttgctatcctcacgaaagagtgttactccagtgagacaaaagtccatcacaagaaatgatttttctacggaaacagctgtgattggagcaagatacaaggtaaaacatgttgtggtcaagttcaaggagaaaacagggtggctagccctagcaatcctactggtggacttacttctgcacacttcatgctactatctatcctgtgttgtctaaggctatataatgtcgagagacgggctagtccaggaatcatgacagcaaatgagggagagagagagagagagaggagacagagagatggctcttgcaacctttccaatagcttttgataggttacgtatggaaaaagcctcatattgacatcaggtttacttaggttcaagtgaaaataatgtctttaaaataaattatctcttttgatgaaggaagtcctttttgttttttgataccatgttgcttttgggaaaacatgcctgaaagtaggcaagtttctctaaagcaagaactgtaaaactcacagaaacataaagttgacttgatcatgcccattttataaataaaggaatggagactcaaagcggttaagggacatgtctgcagtattttacccgtgagctatatgccctctgggtttctcctcatccatctgcccccaacaactatgctctttcctctttcctttactgtttctgggcatatcaaagccaaacttaacagcaccaatttcacattaaacaaaagaagaggaacctactgaccaacctttccccatcgccaccacgtctagcctcgccagactctggtaatcattacactactctgtaattctaagatcgacctttttagattccatatatgagtgagatcttgaggtatttgtccgtctgtgtttggtttatttcatttaacataatgctctctaggtttacctttgctgcaaatgatgttctggtgttctgttgcacagtagggtaactagagttaacaataatatattgtgtcattcaaaatagctagaagagagaattttgaatattctcaccacaaagaaatgacaagtgttagaggtgatagatatgctaattgcccagatttgatcattatacaatatacacaggtatggaaacatcacattgtaccccataagtatgcacaatgattatgtgtcaattaaaaacaaaataaaacataaacaggagagaaacatgagctaaaaagaaaaccagtaagcaaatgcactagctgaatcagatcattttatgcctcttgatcggactttgatggtgggaacatcaggctacaactcttgcctgaatccacagacatggaaggcaagagaaattatttaagcctatgcaatcatccaggaatggaaagtgggaatggggttcaccaaacgtactagttttctagggctgttgtaacaaagtgtcacaaactgggtggcttcaaacaagacttatttttttcctattctaaatgctagaagtctataataaagccagggccacattcctgctgaagactgtagaatccttccttgcctcttcatagcttctggtatgtgccatccacctttggtgttccttggcttgcaactgcatcactctaatctctgcctgtgtcatcaaatggcgttttccctgtgtgtctgtatttgtctgttctcatgctgctttgaagaaatactggagactggataattcataaaggaaagaggtttcattgactcgcaattccacatggctgggaaggcctcaggaaactcaaaatcatggtggaaggggaagcaaacacatccttcttcacatggaagcaggagatagaagtgcagaccaaaggggggaaatggcccttatggaaccatgagatctcatgagaactcactatcatgagaacagcatgggggaaactgccaccaagacccagtgactccttactgggtccctcccatgacatgtagggattatgggaactactattcaagatgagatttgggtagggacaaccacatcactgtctgtcttcacatggtgtttctttcttcttataggaacaccaatcattttgagttaggatgcattctaatgacattatattcgtttgattacatctataaagatcctatttccaactaaggccacatttgcaagtactagggattaggacttcaacatatctttttggagacacaatttaacccataactccatgttataactgtactttttcagaatatcagtacgatggtgcccctaatcaacaaatatattgtcaccaatatgctgcagtctgggagaacattcagggatttaatttttctgacacacagactgtgagttcttttgttttttgtttttgtttttctttttttgttttcagcacatcacactctggctgtcattatcagttccccataaactgtgataatttttgtgtcacatagagtgtttaggttggcctctgatgaaatgaagcccaagtacttgctcttccaggcacctaacccagggcaaaaacacagagacctaaatgccttctctcagattatttttttattatatttccagtgagcagaaacattacagatgtgagacttgttctagaaatcagagtatttccccagggaagcattatcactgttcagatattactaagaagtgtaaaatgctggagggcaattgcatccacaccgtcctctgcccatcactgcaaagggagaaaggagaaggccatggggggatgcagcaagaccccaaggtctaggctcctctgccaaaggagcatggatgaccaatttggaaagaacacttgagaacctctgctctgtcctcttcacttcactagtgagaaagctaaagctcagaaaggataaatgacttgactaagctacttattggaaggtgggtgattaggatgtagcataggggtaagactgtgtaaccagctgacactgctttaaatgataaagcattgagttgttctgttttaatggtacacaagtcaaaattgttcaaggattgagagtggagccagaaagcctgggtgtaaatcctggctccttcacttacaagctgcgtgatttggggcaaatcaggtaaccccttcctacttctgtttcattgtctgtaaaatggatattataataatgtttacttcatagattgatgtaaaggtcaaattcataatatgctaaaagttcttggaacattgccttacacagatcaagtgttaaagaagaattgatattattattattgttattgttattattcttattatccttgagttcataatcagggtgtcctgaatatactacacccaggaatggaagccccaccacattgtaaagacacattcacttcccttaaacctcggcatatttgaggtggttgtagcaatagtggagggagagcagcaaggatggacacaaagcttacagtcacccagcagtgtaggaaaggggggaatcctgcacacactcccagacatggtggaggtcctcaatcactgcagagaagactgttgtgggaatgacagcaaacatgtagctcatcaagaaaatcagctgacttattagttcttctggatctggttggagtccctgaccccagagctaaattataaaggttattttgttgtaattttgatgctctaagaaactgatgtaagatatagaaaagttcttttttttttttttttttgagatggagtcttgctctagcacacaggctggaatgcagtggtgccatctcagctcactgcaacctccacctcctgggttcaagcgattctcctgcctcagcctcttgagtatctgggattacaggtgtgcgccaccatgcctggctaatatttttatttttagtagagatgggttttcaacatgttagccaggctggtcttgaactcctgacctcaagtgatccacctgcctcggcctcccaaagtgctgagattacaggcatgagccaccgtgcctggccttataaagttcctcctatattatacgtgcccatacctctatactagtttttctctcttaaagctacattgccatctcttgtattatccgtgcatttgtcacctgccacttgtcccccatgcccctcctttctagcctgtggtttataacatgctgtaagtctggaaaccaaataatcatgtttattagacttgtatgtaaatcgaacctaatgctcctttcctttgttgttgttttccttgataatgtggtcttttaaaagagtaaaatttgaactaggatttatgaaatctaggtttaagtttgagttctttttctacttatgtgatcttattcgagtctcctgacttctttggataaagcccaaaacaccattttacaggtgagaaaactgacagagtgacgtatgagtagaacagaggagaaaaggaattgaaaattcaggtctgtcaaactgtaatacccaggttctttctgtttgataacaccgttttcaaatgttgagaatgactaaagaaagatatagaaatttgtaatgattaggtatttatacattctcaataatgaattttggtataaaaacatatttttttatctaactatatttttcatgcagtcatttcagtcagtatcaccatctaggtttcctctagggaccacatatcaatgactcttaaaatcactgttgtgcaaggtgagtgggaaaggaacaggatggtagagtttggattggggaacagactttgagcactgaacagcaggcagcattgctgttggcagagtaacggagaaggcgctgaggcttacccatgccatcatggcaaaaaatagcacggaaacagctggtgagctgtcagaatgatcttaaggaggaaatgtgaaatgtttctgcttggtgcattaatcgagagttatttggacagaactgaattgccaggggaggaacaagcaaggtggtaactcacccttccctgccctttcatctctctgtaatacggttctatgtcatgggcctccttcacatacacactcccccagttgtccattactcccaccctctccgtcttacccacacctagagatatgtgtgcacacatccaaagagataacagaaaaaaaatccatttgaaatgcttacagatatttcaagacaaaatttaaagagatattggacagattagcaattatgacttttttaaacttttattttaggttcatgtgaagttttgatatataggtaaactcatgtcaccgggctttgctctacagatattttatcacctgtgtatgtaagccttgtacccaatagttatttttttctgctcctctccttcctcctaccctctaccctcaagtagacctcagtgtctgttgttcctttctttgtgttgatgagttctctagaaatctttgtgattagttgtagttgagtactaatgtggctttgttttttttttcatggagttgtttaaatatgtgtcctgattaatttttgttaactgttatactaagacttttcaccatcaatgaattcagtgaagggttgaagggaagaagtgcaggaaaggagaacacacaaatgagaatgtcagtcttgactgctgggtgaactttttttcgctgtagaagatgaaacaaattgagggccaacctcttgaatcaaattgcaaagtaactttctgctgggaacagtttgagtaacccgaagtagctaaggtcataaatatttttacaggtggctaaggaaagagcatttgcagccatggaatcaggtgttgttattttgggtgtgaccttgaatagaggctgctaacttttggcttctgtttccgataataaatctccctcctccccacccccaccatcagccccaaggaaagatgaatgactcaggtgcttcagagacttcccaagaagtggtttcagtatatgcagcaagtggacatttagaatggcacagttatccatataggaatattgttgaggcagttcatcttgttgtccctatagtgtaattctttggagtagaaagcaaagagcaataatttgtccaataaatgaaataaggaaatgaagagaaaatttacataagccagggaggccaacttaattttctaaagtagtgaattgactttttttccttggattttgaaataaatggcaataaatccagttgtggggtagagttctttgctttcagtgatagcttaggaacattctgcagattgttaggattgcttgtatgtggttttaaatgaatgaagctgtttctatacagctattttcagaaattctatgatctaaatgttttagattcaggcaaataaatacatatctatattgggagataaggtttttgctcaaacaagcaatgagtagttttcccattcctaatgtccacactatcttgaccactaccaagaaacactttttgcaccatgatgtgcaaaccatgtatttcttatcatcttgatgctgttgctcattttgcttaagttttaaagatttggcctttctctttttatgttgattaccaagagtgtctttgcaaagtcctttatgcagtactcaaagtatgtccatgccatttagctcctataaagaaaacaagtttttagccttcctaggaaattaagtttcctacaaaatatatgctcttcaaaagctctctcggcttcatttcaagcatggaaagcttgctggtgacttttgttctacttgatacggcatatccattcttgagtgaggctgagtacaaacagcattatcctgatgtaaaggaaacaaaaataattctaaccactaattaactaacagcaaagagactgatagtcttaaatggaaagaatacttccatggtctagtttctagagaacactaccaggggcttgaaggtaagtagcctctactggaggctaagggaagctaaacacttaagttttcttctatattatcagttgctgtttagaataaattataatctccacgtttttttttgagacagagtctcgctctgtctcccaggctggagtgcagtggtacaatctcggctcactgtaacctccgcctcctgggttcaagcgattctcctgcctcagcctcctgagtaactgggattacaggcgcacagcacctcgcctggctaattcttctgtatttttagtagagattgagtttcaccatgttggtcaggctaatctggaaatcctgacctcgtgatttgcccacctcagcctcccaaagtgctgggattacaggcatgagccaccgcgctcggcctcttctttactatagagtaaaagttgcatggtcgttttcttgcatttgggtcacagcttcagaaggttattaccaatcagaaaaaggttttgagtcttttatttcctaaaactgagtgtattcgttattgtctaatgacacagcataacaaaccactgaaattcagtggcttatcataccaaatatttacgcccatgtttacaggcctgcaggttgactgaaatttggcttgtctccgctgggctcagcatgttggctctcctttggactgcaggtcagctaggattggctccaggctgggattaggttcagatatgctccatgcatgtttttttctggggctcaaactgaagggacagtgtctatccagggcttagtctttcatggtacatttctgcagcacacaaaggctccctccaaatgcagcaattccttcctcagcggtagtagtccagacagaaacagttttggtggttgcttgagttctcccagttgttctcctgtcattttgcaggtcaatctgcttcattataggaacattctactggagaaaaaagtctatcattattcaaaatatccctccttatgcatacttcccactgcttagatgtctatactcagaaaagttactatgtggtttttctttatgggacaatactgcgtgatcgtggcgttcacatttctccctccaagtccttgcttttctagtttctgtaatcattcctcaggtgacataaaagtattttccgaagttttgccattttcatcacacaatattgtggacaaattaaagcctattgatgactttattaaagcagggtatttaccacaaattaggattctctgcattttgcctgactcctgcagagcacagagaccattcttgtctccaatagcaacactcttctattaatcaatcaagagctgacatgaatgtttttatagagattctgttccacttagcgatcctattgaacccctggccatgtggtatccccacagctcttcttctgaaatcccattttgaccaagccatccaaattatacacttagactgtaattgtttcttttccataaatgaatttacattcatcttaattcacattcgttgagattttttctctgtttccaagtctcttcacagcatttgtattctgtcattcaatacatttcctccaatacatcatatcacattcatatgcaatatgaatgaacttgtaacaatatctctctttttttttaattcaagccactgatacaaatattgaccaggtaggttgtaaaggacatggttctgtggccagccctgcaagatctccttatctgtttgtttagtacaccatgtatataatgtgtaagcctgcctcagttttcttcatggtggcctcagagatatcactgaagacctatctgatgctttgctgtgatttttattccctgttcacgccattctcctgatttcctgtatagtaactatattctcaagaagatgagattagtttgatgtgactattctttgtgaagctgtactagctaattgcatttcctcttagtttctaaaacccagaggtcccaaagtcaaatgctttgcagccaggcaagtaacaaatgtctgggtcagaagctgggtattattcgtcatttcatgaacagaaatatatatcctctgagtagaagactctgccagcagaacaaaattcttctgttagctaatttcactagccatcatatgatttagcttctgaagcagcttgctgctctgttattcgtgtgaactcatatcctttctcatttggaaagtcaagaccacatgggtacacctcttatcacaagcttcgtagagaccacaaagatgccactttagtcccaactcactaaatctcctctacaatgtctctaaaaattatccaatagtgttttttaaaatatatatcaaattatgctatctcaccacatcacagtatagctgctactattcctcctgtcttcctgtctcagaggaaaaatttgcttatcaccttccacagttgagtctacctaggtccttggcctcctgcccttttatcttttctgagatctcatgccatctgttacctcatctctattttatctgttataattcctctcctctgcttcttccccagctgctcagaacatactgaaatatatgtaagattttgggttttttttctggtcattttgctcaatgacttcctaataccaactgaagagagtttatatttcttaatacaacattgaaagcctaacatgatttggcctcaacctacctttttttatccagtaaaattcatttctctctaatgtatactatattccatccaaactaacccactgattagacttcatttttcttttaattactgctttttgctgtgctggtcccactgcttagaatgttatttcctcaaccttatttctgtttcctacatttgttgaaatcctagatgtccttcagaacccagcctctgagtcacctcttgcaggaagccttccttgctttccctagcagaacaacaatttctactgaaaccctgttgaattttgtctccattattgcctttaccaccttctatgttttgacagctattttgactatgtcttatctacccaattgtaaacttaatgaatacccacactgtatcctatttatctttatatctttagattgcaacacaattctttgcacatagtgtgtgccaaaaaatctctattgattgatggtgcaattctgatatttattaataatgatcaatctaagtatttatccaaatcaacccaatgccctatattttgggacaattacccttgagatttttataaaccaaattcaccccatgtaaaacagatgaaattaaccttaatttttatctgatgtgtaatggctaattggctaaatttctttcataaatattacatatgtactattttttatctctataagtattctagtttgtctagatgaagaaacagaggctaaaaatagttaaacaaaaaattacctgtttcagagcttgaaagccagatctgtccatggaaatctcctgagagaagaaggtttggggatgcatataatgagagcagagaactggataaagagatgtctggatctatttttggctgttgtttagatttactttgtgactgaaggaagtttatctgaggctttcccatttgtaaaactgagattcatatacaactgtgcaaaatatgtgtccctttacttacctccctctaagagattaatgagatgatactcaagaagcactttgattttctctgatgaaagaaatggataagtatgaaatgaagcatttactacttctatcgaaggtttttaagatggcagcctttaaaaattatcaaagtgaaagctaaaggaagaaacagccgtgtacattttaaatcaagtcaataattattgtagtgcacctaatgattctctgatatgtgttttgtgcattaaaatttaccaagcacttttacatatattatctcatttgatccacaaaactatcctgtgaagtatgtaggctaggtggtttcattaccatttttgaaataagaaaactaatactcaggccaaatgacttggtcactgctgctcgactcatgtgaaacagtccagggttaaactcaagtttcctggattccaaatcccaattcaggtatcttgcatttctgtccacttgttaacatcatagcatgcacattggaccatctcctctgtgttcacttacattctatccatgttcaggattgagtttaaatcccatttctgctcttaagacttcccttatcactttaactgaaaggcagactttcttattccatattttttttgtccttaaatatattgtttcctggaggtctttctagtgagttggatttcctgtattccattcttccttaaaataagcctttggaattcagcccagcttccacacttcttgatagctgccaccatccatttcattcctgggactgagcctcagcacaaggattatttaaaagttaaaaatagttgtattcataatcccagcattttgggaggccgaggtaggtagatcacctgaggtcaggagttcgagaccagcctggccaacatggtgaaaccccatctctactaaaaatacaaaaatcagccgggtgtggtggcagacacctgtaatcccagctactcgggaggctaaggcaggagaatcactagaattcaggaggcaggggttgcagtgagttgagatgcgccactgcactccagcttgggtgacagaatgagactctgtctcaaaaaaaaaaaaaaaagtttttttcgtgtcggtattaatgcctggtataatacctcgcacacagaaggtgttccatatatgcctgctaaagaagtggctagactaatcaacaattatggatgggagggaaggttcagaaagtttggtgacaatactgggaaaaaatgttggcacctgataatggtggacctgggataccaggctgaagagtttgaaacttgcccttttggcaacaacagatttattggcaccaaggaatagttttgctggattccacttttgaactcatcaaattccttgcttttcttttccttgtcttttcaatcctactgggacctcctcccaccagtgccactttactggaggcttgtgatatgtatgacaggcagtaaaacccaagtgaatcaaggaagcctgttaagagcactgatttctatgatgtctcagtttgttaactaaattgcaggttgtactgcttggccagagacagctgacaggcaactctgcctgaacaagtagcatctccaaaatgacatgtgcactttagtttcattagaggcagtggtatcatgattgcctgggccattgcaataaatatggtgatcatatgtatcccttgggatttggggttgacagcatagttgggctgcactaaagagtcttactctgacataaatgacggcaaagtagatctctgggcccctcagcaaggaggcagaagttcatgttgcaaagaaagttccacgggcctactgaaatattaccaatcaaaattacaatttcatttattgacaagtcatatttaacattcttctaatgttttttctcacatgccaatgtccaaaaagctaaaccatcagctgcatgatgctaaggctttcagcagtcagcagaagcagtggtagttgcgagctggttattcagaggcagctactgtgctccacataaccataaagtgaacattttgacattcccgaaaatgtaccaacctccaagtcacaaatcctctgtagatgcctgtggattggcttttcagatcctcttaaaagccaatctgtggtggcaggattgtctgaagagggtagacttgggcttctggtacgttacagaaggcatggtttctccatctacactatgctataagacaactgctcttctctgaaaagaaactactggaatcacacttcttgtaacttctctctattcccttatttagttggtgggattggatgaaggatcttcacatgtctagtgagactcctttcttctcttcttcctatccaaagggcttttcttcctgggctgagtgtatccaggcctatttcatctttgtaggaggcaaagggaaagagaagagaactagaaattggtgtaggcagactgatctgtggccaggtctaagtgttgccccaatccgttctcccatccaactccacaagcagtaaagtttgctggtcctttcatctatgtctatttctcaattggcttggatttcacaatgaagagggctatgatttattggcccacttaaacctcaacatggtagagtggcaattttgtttttctggctcttatattgcaatgaatattttttatttgacagtctgttataaacgaaaataatttttttcactatcagtttctactcaaaattaaatggtagctctagaatagtggcctgcattaaatttttctttatggttatagccatgcagatagatgcatgaactcagaggactaaaaatgtgtttccatgtaatttaaatgtacctttctatacggaacggtctgctgtcatgcaactttcaaataatgcattttattatcattatcttttccggcattgattaatcctactgtttattggctaagtgtacatttcctattggtatgtttctgagtcaaggtgaaagcagttaatacttaagagttgagaagcaagtttatttaaatctagtctttcttatgagtctgcctaacagtgatagattttgttgttgagccacagtttatgaaaagtgcattaaaacctcgagccgacccatctctctgaagcagcagttgggccattacattttggcaggcacttcagatgtgtgtatgattttatgatcaggtctgcttaattcatcccaactcttcaaagaggaagggaactaaaattccttgagcatcttctagtatgtgctagatgcctgcatatgttgttttatcctcatgacaatctctcatggtagatagtattttttcagcattgaaggtgagaaaattgaggttcagagagtttaaataatattgtcaaaaacatataggaagtgatgaagttaagctttaaggccaggcctgtctactcaaaagcctgtgattgttatattaagggttaaaaaaacaaaaaagtttgcaagagacagacaagttatttgaacggaatgaagtataagaaaacctgtgctttccttaatttttcttgaatcctgtggccttctcagtctatcctttattgaggttcagagaggttgctacttatatggtagcaaaagtatttcccttccctacttaccctactatacaaaacaaacaaacaaacaaacaaacaaaaaacagaaaacttgatgataaatgtcaatcaacactcagcctctgcatctgatgagcaacagaaattagcggggactgtggtgaattggaaaacctgtgcctttctctcccaatcagctctggctgattgtcctacagaaaatgttggctctgtgttactaaatcttaccattttttaaaagaacagtctagctgttcacgagagatctgatcttaaaatgttgaaaactaattcacatagaaaaatactatgtagtacccacccctcaaaaataaaacttatgtgagcactcgatccagcataaagtctctgaatttgtaagttctgtattacacaaggcagctaataagtaactactgggaaaaataattaacaaacaaaaatcaaatcaaaataattttcattactcttccaataattgtgccttccagatttagtactgtttgtgtattgtgcctctctgtggtagaggcatgacttctggtcctctatctgcccttcacagagtggagatgaggccagtatgcaatgactactcaagttttagatgttctgagcacttgtttctgtgctttctctggatagatctggtagtttggtgagcagagttggcgtggctcatcagcagtcaccctttggcaatggaaccagaaaagcatcatgctgtctgttaaagaatgtgtctatgcttgtagctagtttcctaagatgtttgcctctaggtatttgcctgcagaaagttttttgaagtcaatacaaagtagagtggcaagcgatgcatccatgtttgaggatttgggaagcatttttctgtattctttcaagtaaggcctggtcgataagtttagccacactcaatctaattccttgtctgtatccttattatctcccctcctcttctttaagttttcacttccttctgaccttaatcactccctcaatgaacccataagtatcactgaacatgggtgtcaccagttagcaacagtaagataaccgctaacttctgaaacatggaagctctagcattgcttggatgatgtcttccctgactgcctgtgagcctctggccaggatccggggtaagtgcctcacaaatcactgttcatctaaacagctaaagctcttctcctgatggaagagggatacctacagcagaaagcaagggagtccaccaggcacgtttggaaaataaaagattttatttatatttattttgactctatagtttctaaattccataaatgaaattttgccattatcaaggaaatatttgctagggagtataaggaaggccctttgggtaagagagaagatattctctaagctgtagcatgtttatgaaccttaaaaattacttgtctgtgtttgtatatgttcagctctgagagtcttccttaacattcaaatgtctctgtcttggcaaaaattagtgaggttttagaaagtagaaaagctggttgatagtgtaaggaatttttaggccaattttctattttttccttctatagactgaattttatttttataccaatagtttcaatcttctaaacttctcccattcctctttactttctcaactgcatccacttaaatacatcttattgtttcagtcagccttggctgctataacagaatggcatagattgggtgacttaaaaacaacaaatatttattgctccccattctggagactaggaagtccaaggtcaaggtgccagtcaatttggtttctgctgagggtccatttcccgactgacagatggccaccttcttgctgtatctttacatggaggagagagaaatcatgcctaatgtcttttctatctccgggcaggtagtgcaggaattgaacttggttggaggacatccagctggtgtctgctgcagattgcttgcttgcttgcttgcttgcttgatgtgtggggaaaaacctccacacatctagcgtcagaagcgtgttgtgagagtataggagaaactgagtttgttttttctacacagaagaatttcctatcctgaaggccaggtaatgaatcctctttctctggttacttgggcaatttatcaatgactgtctgtggatatttatttggaaatattatatgggaacgttccttcattttttatatctcaatttaggaaaccatgtgcttctttctcatttctcttttgtccccatcagcgatctatatttttttaaattgttattagaaacatctcttatttaatctccatcatcacccaacaagctcagcaatgtgactttgtcttacggatgaggaaactgggtgcagagtatttgtggctttccccaaaacctgcagtaagtgaacaactagaattatatccaagccttctgattcaaatgcagttgccctatgcaccacaccaaagtatcgtttacactcttgagggctaaagaatgccagatgtatttatctaacttctgatgtgcctcccaaaatgccctatacagaggataggatcaatacacacttgatttcaaaatttctatgacttgattctacttacacatcttattgatttggagaaataaaggtacttcttgggggaaaacatgactacatgttaaaattctgaatttggcaagtctagtgcaaactgaaatggatggtggttgaagtacagccaactcatggtggtccaaaagactgtggtgaggggatggcctcccaagaggcagggattgagccctacactgaccagaaatcactgcattacagaataatggagaaggcaagacaatgaaactgagtttctctgaaagcttggcatcttggatatttcaaagattaaagttgtatttaatgggaatcacgtggttcaattaactggtaataggatggatcagtgtccacctctaggacttcaatttgagtctaatccaaacacagaagcagagtaggttgaagcccttggtaatgaacactaagcctttcacctcccggtccacagagaaagttcctctcaggccacagaggcctgctggcaattttcctgaagacagtttggtagactatgtgaaacaagtgaacagctatggtcacctgagaggtagtggtactctacattttcaaaagttctctcccaaagcaaaaccatagcaaaaattgaaaagcagtaaatgaaccatggatggagatattgcactatgcacttgtcttgctagcagaagaatgcaaaggtgctttcaccattgtgtcagatgcttggctgaacatttattaaacttttgatatggaggaagacatagaacataaagatgcattttcttccctcacaatgctcatggtgtgacaggaaaaaaaaagaattgttccattaaaaaaacattgaaatgaatcaacacaaactgatgttattattgaatagataatggagagattgtgggataattagagaataaatctggttatcaaagatgtctctggaaggcacgtgtgtaaagttgttttcagctctgtacacctgtgcacactggccaggaaagctggaccttctgcagagaaaactgtcttctccagataggaaagtgtgcctcattgagctttgggctaggccagagctagaagatctttcctgtgtttgggtcattcctagatcagtgatccctaatgaccagttccattccctaaagctaatgttgactctagatctttctgacatttgattcatgctggaatccatagtttgttttgagtcaggtctataatagattcatattcctgagaggcttcctattgaaagtgaagactcaggattccactgactgttctgccactgtttaaggacgatattacagttggattatagatgacctccagtggacacagaggtgcttagattctactgagccaccattactttgcctaaaagaaaataagagggtcaaagggactaacttttgtgtaagttttaaggttttattcaaacacaaacacacacaatcacacacacatttacatggcaacatatctacaaataactatttctctagcattatgttcctcagcctcttgaatgacatcatttaccttcgtcatgttaatgaacaaaattgtagctcactcataaagaagagagagaagaatgtttgtgccctttaaatgtcaaaaaataaatgcttcttcatattgtgtatgagttcactataaactcatggataatttgtgtatctgaagctctgaccggcttccagagggcttacagtgcctgccatatcttaggggaacaatgacctcatgctgttccagggacatttctatttctccatttggctgaaacttactcactttatactttggtagggatactgaattcaagtaaattaaaattaggagatgtgttctctaattattctatcgaaagagcacatagctttgaaataattctcaatgctagtatggtggactcttttcaaaaggtatgagtcagctccctgtgacatgttttccagtgtctgcttggggtcacctttactaatttcatcaggactgagggaaagcactttccttttcatatttctgcttgggtgtccagatcattctcccctacagaggctttgatgctgtcatggaggtcatagggccggccttttttcgaagtactggagctttttaaatttcactttttaaaaaatttttgttgcttttattatggtggttgggggtaagtaaggacccaccttttgaattagaattactgatcttatccaagagagaatgttgtagtgggtgatagttgacgaagaagagaaccataaaatatcacctggatgaaagacctaactgcagcactatctccaggacacacacacacacaccagagtccccacgtgcagacaggcactgctgatatattacagtctgttggccattttgtttatgataactaggaaaggaaaaatgagcccttatttcagtgtgttcatcccaagatgatgacacagtagattccccttgcaggtaaaccgagagagctcagttaatcaccatttatcactcaagtgactcaagtattttgcagatgcattggagccctggagactgagatattcattgggctgcaatgctattctcttttctcattccatctaatataataaaataaactcaaatcctaacatcagagtgatgtgtgctatcttttagagtcccaagcctttaaaatgtatttgattcactcccatagaactagatacattttccaaacgaaatgtgatatcattacaattttaatgacttataactttgctccatctcctccattaccagactattcctagctactaccatcttttgccagaagcctctaatttatttctctgcatctgcagctgacctccttcaaacagtgttattttgagttgattttagtatataaaccactctcagtgggatctaagatagattagtttatgcctaattgagtgagcttttgtagatcctcttattttatataacttattagaaaatatctaagatatattgttctatttgccaaataataattgtgaatcaggttcattgtacactggttaccaatatgcctgagcctagtgagagagaacacccccacacacaagtcacatataggcagtaaaggacagcagaagctggggaatcattttgagctcattctccaaggctcaggaaagctgcctatggcaaatggaatccacctgtgcacgtactgcacctaagggaccttggaaagtaccccactctgggttttataccccaggggcaatatgactcaataagctgaagtgttgaaggacatcctgttctggtaggaagtggaacagagacttggctattccagccagttcctccttatctgagaatgttacatttctggtatattctttagttatttttgagaactacaagtgagaaaagaacacaaaccaggttggtccgaggctacctagagaactttcttccaataggtgaatgagcaggtatgttacaggttcctcatttgatcctctcaccctatttgagttattctgaccacttgtacatcaactattgattaaaatctgaaaaaagaaaatcataggtgaccttaaattaaacttaaattaaacttaaaaaaaaaaacttaaaaaaaattaaacttaaaaaaagttccacaacgaacaggggtcagcaactttttctgtaaagggccagaaagtaaatattttaggcttgtaggccacatgatctctgttgcagctactcatgtctgctgttgtagcatggaagcagccaaagataataatacatcaatgaatgagtccagccgtgtcccaataaaactttatttataaaaacagggaacaattatatttggcacacagtttgctgatctctgctctaggccaatctatctcctccaacttttgcatattcatacctcaaacatatcataaaaaactgccacaatctaaaccgtattatctgatgaccctaagtactaaatctctccattctgaaatgtgtatattaattttttttcaggtagagaatggtatagaatttagacagggaatttatctgagggattgactgaaaatgccttacttatgaaaaaagagttcttggttggtgtttattattcatgtaggtccatttaccttgaagccataatgctaatatagcctgtcatttggaagttagataaatagtaaagcactttaaagaatcactaaaagtttcctcacaaccacagaataggtcttggagggttactcacgctttgctgatctctcatttatagaggagcagctgctcatttttggcctagaatatccacctctaagagaagaaatttctcctttgcatcctgttcagagctgatcatgcatattcttggaaactgactaaaatgacctagtctgtagtaaagtaactaatttagagttgggactatcaactaatgttattttgccagaggagatgaatgaaaagacttccttagggactagcagcaatcagtcagtagggaacagggttaccaagaccagatggagaaaatggcataggacatgtgtattagacctgccactttctggctctgtgagcatgcatttcaaagtttatacctgcaaagtgggcatttgacagagtaggggacagtcggagagcttatcgatacatacttattgctctccttgtgttctgtttgctggaacacaattttagatcaaatatttaaaaattcacacgtgcgtgctcatggctgtgcactcatgtgcatgtgtgcctgttgtgtgcgtgcatatataccatacagaaaagtactgtctggagaatacattagactatgcatgtaaatgtgtgtagaatgtttttcttttttttcatgcaatacatgctctatggatatttgttaagtgactgaagttttgcactccctggtgcagtttctcaatagtggcactattgatattagagccagctatttctttgttgtgtatcattgtatatttagcagcatgcgtggcctcgacccactagattctagaagcactccacttcagttgtgacagccaaaaatgtctccagacattgccaaatgtccctggagataagcatccctgttgaaatcactgccttagtgaaccaagacattaatgtaagaaagtggttcctaaactttagcatctgaatcaatcaccttaagttcttgtgaaaatacatgttactgggcctcacactagagtttctgattcagagggtcttgcactagcactagacccaacaatttacatgtctaatgagtccgctggtgatactgctgctgggggtcttagaacctcactttgtaagcacataagtaaggtgtaagatgttctggaaaaattccagatgagttaaaatgtgtttcctcatttcaaggactgtaatgtttgttgttagtgtgagcacagggcttaaggtttctttatgaagaccgctgggtggttcctcacagctgtggttgagatttagcggggaaaccggacgtttatgggagacgttcagtctgtactggattttagtcagcactgccctgccagctgtcacctgagtcctgccaggagactgctccaggtcttggcacagggctggggcacctatggaaatgaacttgaagtttgccttgcagtcaaacttaactaccaaataaaccagcatgacattggggtctgtgaatgagaagtggatgttccgagtagatttgaaggacgtgatgactcaggatgccagttgtgactggtgacttagagccgtggtagctttgacttgcatcttatttacttgcatcggctgtcttgtccttccttgcttctcgccttttcaggtcatggttcctgatgtcctaagctgtcatccctactctctctctctcttttttttttttttttgcttggagtcagagatggagctgtctcgagctatttatcagtcttatctctctgcgccctctgttagcatttcagactgtggatctaatccactttaattgattgacctcgtgcaaccagacatcagtaaaacaccaggtgaagcacaactgcagccaggggagaggtggatgtaactttcctggttgggtgcaaagttcgctgaggcctataaagatttagaaaaggagaaatagttttcaagccatttaatatgaattttctagggacaatgtatacagatcccagagtcgatgaccttgactgggagacagtcgttgtaaatagagcagtatcctatagggagtgtgcaaatgcctctgactcacctgtcatccatattagtactatttctcagctagcatcactattatcaccatctccaaacccatcattaacatatttttacatcattgtttgtagataccttcagaatttgccaagattttatttatttctcttaataagtactatttaacacaagtattactgttgctcttgtcttcgttatcgtttttctagacaaagcttgagccatggatagttgagggacctgctcaagatcacatggaaaaaataatgtggagcctcaatcagtcccaattcttttgattctaaatctcaaattcttctagaacacaaagtagacattttcctctcccctgcttttcctgccacagccacacttcagcttctcaaggggaggggactgggtcattgtcatgaggtgatcatggactttgaaagatcttcaagctctacagccgtggtcttgtcagtttgggtgatttctgaaaggcatcttctctgatttagatttttcaacggagagacctggtctcttacctctcttgaaataccttaataatgaagtgcttactctgtgcttataaaccaacaactgtccagagtgtagaacaagaagaccataatgttgaaagagtagagactaatgatcttcactgaaagacacttaatagccacaaaaagagcgcaaattatgttctactgagttcaatgttttattctaaagaactgcagtaaaagcctctgttagtcaaagtcaaaattgatcaatcaggtaagctgtaactcatctttttgtattttacagatgcatttataaagcatagtgagatgttttgcctaagatttattgcacgaaatttgaatatggtagcaataatttattttatcctataatactgaaatcatatttggtctcttatggtacaaaaaagattcttctaatttttttaaaatcacaaccacacattctaattcatcatttattcatttccatatccattaatttaacaaacatttactgagctcatgttaggatacttacatttaaaatactcacaattaggctaagtggacagataagttaggcctacataaaatatgtaatatgtaacacatgtatttctgttatagaaataactcaattataacatgtaaaagctgtgattgtcgaaaatgcatggattttagagtcagacctggattctatttttccataagtctcttattgtgtgaattctcttgtaattaattgtaagaatttgaatatacttctattataaaaatatttactgagcacctattctgtccatttaggtagcctggtttatgttgcagtgacaaaagcctcaaacacttggtgctataaagcaaccaagctttgtttctcagccatctgcatgtccgtagcaagttggcttattgccatcctcactcaatgacccggaatgacaaagaagccgctaccaggagtttgctgggtgcagtggttgacaacaaatgagagaactctcgtgggtctcacaccagcaactaaatgcatggctcaggaatgatactcaatttatcagttaacactgttctcttggcccaacccatcacaacgagacccaaaagtcctctcttactacaaccctataatggaggagaactaggaaagtgtggtaaacagtgccgctcattattttctttactaggaaccagactttgaaatgggtatggaagaccttgctgtgcctggcccacaagaggcattatttacatattgccttccttgtgttcttgcctagcactgaactaacaaattctgtgggaagcctagcagttaagacactgagacctgcttccattgcccatatccctggcatacatttgaaaatcccagttctgtttctctcagctgcaattttctaaaatagcggatgatgcattccgtcttccccaggggcagtctggaatgaacgaagagatagccttcagtgacatctttattcctgagaattcttcttgcccctgagcatttctgctcctggagtctgaccctggtgtcggtagcatctcttaggtcagcaccaataactgcagtgtgactgattgaggatagggcagctgaagctggactaatttggggagccaggtgggcttataaacagtcattattgatgaagagtgacttactggctatttaaagacagctggtttctgtgctgttcagttttttttttttcctgaatgcacttgaggattctttggtaatgtcttctgatttaccacttgtttttgtttttaatatcaaggaagaatatagattgaagcaattgtcttggtagcaactttagtggtgatggctgtggagttattaaaatttatagtcatgctgtttttgcagctacactttgcatttcttagagaggcttataatatctggttacaaagaatgtagagagatagcaactaccaaattgggataggaaatcaaccctgcataaattgttttaatatatattctgtttgctaaaatttacatttattttcacaatatgtcttgatgacagtgcccaccaagccaactagcccttagctcatgacactactttcagttacactaatgaggagaaagaagggagaaagaagactgacattttgtgggtccaaaattatccacagtgaatgccaggtgcttcacatgtctgtgctctcctataaccctcacagcaagcttcagaggtaacaactggcccctctttccctccacacatctctttatgaaagagaaatcagaagtaaaataaccagaccagggtcatacagctttaagagccatcgctgttatttgaaccatgctaggctaaaacccacatttattctattgaaacagtttctccaaaaatcagagtgttttatatctgatcaaatgatgggtggttccttctcctgatctgttttatctcatatatttatgtaatgttttattacttataaagtaccatcatgttcatcatattatatcatccttacaacagccctatgaagtacgaaatgctgatatcctgtccttatagtgtattatcaagaagtggcttcagaaaaatcaagtaatttgcccaaggtcagtcaggtctgacaccaaagccaatgcttttgttccctcacatcttctcttttctagacacatgagccagcggagttgatttgcatggcagctgtgcatgatagtttcaagcctgggcaactctatgggtattcgccacaaggcttccgtgacttctaatgaactgaaacaaagcagttagccatggattataatgccaccgtggtcccatgacaaatgacaaggaggttgcagtaatgaaattttattactgcaaatagagaccacatctgagatctagcacggccacatttaccattgtgggaaacaaaatgaaacacctgggaaaggatctccactgactttagcagtgagctaacaggattaagaagatctcccagaaacactgattacaatggcaaatgtgtggcacctaagataaggaccaaatatttattctggcagagattaaatcttttcttttcctgaatcaaatatggatcttgcagaaaatctgcccaagaatatatcttgctgatcagcgaactcactgagccagaaccgtacttggccactgctgtcactgaaaagctacagaatgctgctttaaaggtctccatgcttcccctaaaactgttttccatccatgattaattagtgacttaggggtgaattgaatcaccagctgtcctttccatgcatccaggatttatgtactggtttctcattgaagaacagtggtgcaataaacagccctcatttgtggggtgggcagaggagtaatggtgtctgcagtcatggtttcttaactcctctagtacttccattctgctaagcaggttatggctcacattattacagcctagcttatttaggcatgagggtcgtgggcagtgacacacacacacccttagaaatgaataccagttctttaagagaaagcagaaaagtcatattaccatttctgaattccttgagaaataagaagaataaaatggacaataatattagctatgggcatgaaaagtacaaaaagaacccataatcaggttcatttatatatgcatgcatattttaaagctaggtgcttttcctagtgcagagatgtagatagcggtttcaacaaacagatttacgaaatcatgagtgtgtttagtcacaattttgggaggtacctggaactcttttcccagagaacagaacatggggattgcagacatcattttatattgcatattatgtaatcagggcacaaaggaaatactgaggtccaccctgtatctctgcatccttgaatgctcacagcctgctttggttgatcattctatattcctcgcttctaagatcaagacttctgcatgacttgtccattcttttattggatacaagatgaactgacatactaagtgataaatggaaacttgaggaaagccttcattttgggaaaagaagtgaagtgtaccaaactatatatagaaaccagtgtccctccctccagaactcttaatttgttgactttaggtgtagtaggtgcttaataaattttgtatttgtgtatttaatgaatacatgaatgaataaaacaaatgactaaatctgagatttagaaaaactcttttctatatcttgatttatatggattctggacttttctcacattcttctttttcttttcctccttctggttttcctccttctcttccttttacttcttcttgaataaaaaaataatagaagataacaaaggatcgtgaactagtactgtgactcagtcttgtagaatgtcagaattactactgatatggtttggctgtgttcccacgcaaatctcatcttgaattatagttcccataatcccaacgtgttgtgggagggagccagtgggaggtaattggctcatgtgagcagttacctccatgttgttctcatgatagtgagtgagttctcatgatatctgatggttttatgagggggttttcctcttttgcctggcacttctccttcctgctgccacgtgaagaaggatgtgtttgctttccaggcccccacagccatgctgaactgtgagtcaattaaacctcttttgttcataaattacccagtctcaggtgtgtctttactcacagaatggaaaggactaatacaactactaaattttattatccttgaatgcccaacatattgccagtaatttggaaaactaaagaaattgagcaagatgtctcccttctgtccttacacatgcctccaacaccctgcaatgctatgtctttccaagagcttaagagaggctgattatatttgaatagtaaggttacatttatttcatgtctcattgtgactactagttccaacttttagtcataaccaattattagagaagagtcagagttttaatagcattattatgtatgctttgtgttttagtgcacttcccaggaggttggtgatatcaccaccagcatcaccatttgcatcattattatctgtattagtccatcctcacattgctataaagaaatacctgagaatgagtgatttataaagaaaagagtttttaattggctcacagttctgcaggatgtataggaagcatagcagcatctgcttctggggagccctcaggaagcttccaatcatggcaaataggggaggaagagtctcacatgacaggagcaggaacaagagagacacagggaagatgccacacactttaaacaaccagatctcataagaactcactcactatcacgagaacaggaccaagggaatggtactaaaacgttcatgagaaattgtccccatgatccaatcacctcccaccaggccccatctccaacactggagattacaactgaacaggagatttgggtggggacacatccacaccatatcaccgtcttcactgccatagtgttactcttatctaattcattgcaatttcccttctgacaagtctttgatggccacagaggttctcttctgctgtgttgcataagctctggtcttgaatatatctctctttggattaatctgaggagtagggctacaagttgggaagcatggcagccatctaatcatgaaaattctaggtgagtttcattggcctctactggggttaccttttctatgtggtttggaactgcagaaccattatgtgcatgtgtgtgtgtgtacgcgtgtgtgtgtgtgtgtgtatatttatatacacacacacatatatccagcccctctgacattggctcctaaccattctgtacacctctgctttgccttgatcgcatgaaaatatgctgagaagctcatatttccactttaattgtaaatctgaattgataaatgatttaaggtccagtgtcttggtgtactctcttagtaaacaggcctaattcatctcacagaaataaactttgcattgtcattgcatagctactaggtagttccaggcctgatttgccttgaggggaattgaatgatgtaacctgtgcggtgcagcctgtgagagcaatttgggtggtttttatgccattggtttttatgctcaggatgaaagctcatggagaaatgtagaatgctattattatcttatcttcatgctgacagctccctctgggcacctacaggtttattgctggttggaggatcaagtttaaagggagagaacttcgtggttggtgataactatgccttttgtgtttctttattataggaacaggggaaaattggagttgtcttcaacattggcacagttgacatctccatcaaagaggagagaacccctgtaaatgacggcaaataccatgtggtacgcttcaccaggaacggcggcaacgccaccctgcaggtggacaactggccagtgaatgaacattatcctacaggtacatgttgttcgctcaatggtcctactctttttgactctcccattctcacttttcagtggtgatttttctcatgactgtcaccaaattccagaacactgagtgaagtacacattcatgatttttttgtatgagaagataagtcatctctttaggacttgatccagtatagggagcttctggagactttaccaactatgcactggacactttttgtcaacctttgactgatacagcctgactggctcataccaaagacaattacggtagattttgcagggcctgtagatgaggagcagtgaagggaaggatcatctctatcatgagctagtgtcgataatcataagatgctccatttgagacccagactttgtggtgccatttagtcggatgcagttgaaggtgcagatgccagagagagactctaaaaggacaattactgaacttgaagacacagatcaagtcatggtaacaatgagagaaaaactaaggtggaattttattcgtttggtggactttgctagtttttattttctcacttaccctaagcctgcctggatattcaaaggttggtcctagtagtcattttaatagcaagcatgctggtgtggcaggaaaaggggttaatcatctgtttaaattttacagtcaagaaacattcagcaacaaattcccagagccagatggctgaatcaagcacaacgggagaaaaggttgccttccttaaaagagatcattcaaataatccctcagctttccctcttgcctctcacttctcccaggaaaagtcctgaatgctgatcgtaaaagtgccaggaatggaagggacaacccttcagcaaagggccattgttccacaattgcactgtcatctgatggatgcaagagaatagtgagaatattgcacttctcactaatgtgggcatgaagtgatgtgctactctctatcctacacaccaaactcctcacaattttctcaccacttttctctaacttcctttacagtgaggtgggcacaataacaaagaagcttgaagcacattttcacatgtctaagagccattagctaataatggttatgcttgtgagaaagatacaaagtgaatttgcctatttgtaggccaagactttgaatggcttgaaggctgttgtatctccacacctaactcagcattaattttctttaaaagcctatcagaagtatctgcgctgttgggttgttccctaactgctagagtcccgctatatctgtttaagaattgtaagagcatctggaaacagcatgcaagacccccaaggtattgaggcaaaaagctccacccactattgatttgccatctcggtttccataaaacagccagctcagccattgctaggggtctcagaatttcttagattaaggcacataaatgcccttatgaggttatctttgagtatttgaagaaagccaaagctattaacagcttctaggaatttttatcattcaaattcactacacactaatagacttaatttttaaatgcttcctgcttaatccctgatggatgggggagagggtgaaaggaataaaagcagtccagtatcttaaaagctgttcataggctcatagaaaaaaatcaatctctctctccatatgtgttatcattggccttgctagtgttgctgaagggtttgttgtgtttctgttaggaatttcaaagatttctaaattgatgttaaccacttgccttgagccaatatagaatctacaagtttgctgccagcaatgagcaggctctttaatggtcatttttaaagccacagctatgtaaccaaaccggagattcttgctgtgcgcctatcttttggtgtctttctttagttccaaattatgggttgcttcctatatgttttcaaaacagattaagcctttctttaatagcattgctccctcctgaaaactattattatcattggaaactgttatttagtaacgatatgtgttattatttcaggacagggtacagtatagcatttataagtatgggccttggagtcaactggctagagttgggatcttggtttcatcacctgtgagtctaaagaccttgaaatgtcctaagcattgaaatatttggtgcctctccccacatgtaattcaaaatacagtaacactgaaccataaaataagtgtaagaatttctaagagtttttatttttctcctctgatgatttctgtaatgctttcaaaatatattagattctttcttcccaaattctcattttgtactttctctgttttgttgttctttaagaagatgttcattcttctccctgagactgtttcctagtctagacaaccagggtaatgataatacctggttaatgtgaagattaagtgagttgaccacatgtataatgctgggacaattaagtcaatcctcaataaatgttagctgtgaggattaccaatcatttggctagcattttaaattaggacatatttttgagtacagatttcttcattttgaagatgaaataccctatcaattagacaaggtagatattttttattctccatttcaaataaaaacagagacccaaggaggtgctatgcccttcctaaggtcacatagcaagtgaaggaagacctaggacaagatttttctgtttccaattgggcagttttcactattgctcccccagagaattgggggatgttctgaaaaatgcatagctagaaatgagtatttttcttcttgtgtcatcttagatttctttctttaaagaagtgtcatatctcaaaggtcactttccaatgatcacacaaaagtggttattgtgaggtgttgagttcaaaatcctcatttaaaagttttattggcaccagtgaccccaagctgctctccttacaacaatggcaatgtgctcccatgaagcagctgaaagaatagtgagtatttaaaggagctatatccccttaccttgctgcctcaattaaaaagttgttgtgtgatatactagatcgaggtttatgttccactctgccaagacttcctaggagcggttcactttttgagccttggataccttattttctctcctctctgcttccctgtgctattaaaaggatcaatttaactattaataatttaaagtatcatgagaaaaatctggcaatgtttattttaaatcataagatcaaaattccccgtgtctgggccatcaaacaaagccatcaacctggcaaggcagtcttgacagtttctacaaaaatgtgtccttttgttttctaaagtcattctattttattattttatcaataacagtaggtttagaaatcatcaagggtttagtctcactactcacttattactaatgtttaaacagtaaagacatacagagtagctcctatagaagatttatgttaagttatctcacttggagaacatgctctcggggaattgttcctgcctacaaggtctgaatgagtcagctgtgcaccgggatgaatgggtcatctccacagtcttctcatgggcatttatggggctctactgaaacatcccaccgtgaaatatttagaacccagctgggcacagggcatgtagcactggctctttctttgtgaatcagggaagaaacagaatgaaaatagttctatagcaatcggaatcttatatcactaaattctgggaggtagaactgaaaagcaacttctttctttgaacctgaaaatagaaaagctaagaaacaggagagggaaataaaagaagaatcagcccagagctatcatccaggcactgacaaatgttccttataaagtctctgattgttgtccctatacaatgcggtggtaggaacaagggagggggggtgaaaggtgacttgagtatgaggaattaattttagccacagctctaggccccctggaaggctgagctgactgggtttgttccatatcttctctctgctgtgagtgggtggccggtgatactgtcactgctgtaagatccctgagcatggtccagtaaaggcttttcaggtcctatctaggcttcctgggacatgcagactgatacacagcttcaatctttgtatgtcagggggtgctgaggagagcagggcataccaactcagttcaagtgctcttcacagaattcctcttcttcagtctttaaaatgcacacggatgacctacatttaaatcctatttgaccacccaacttagaacgtgaaaaagaggtaaaagtagctccctttcaaggatgctacattagaaaactctctttatatttgagtttgtcaaattccacagaaacttgtctttataggggttggaagagaaaacattgctatggtacttataaaacattgctatagtacttattgatgaccaaaataccttcatatcggttattacatttgagcctcactccatcctgtgaaggacagggtttggtattattactcctgccatacccattttaaggttacgttatcaaggctctgaaaggctaaataactttcccagtgtcacacagcttaaggagcagagccaacacttttctatcctgatcctcagactgcacagcctcaaactttctgctcactttcctatttctcagagccacgattttattaataatgacagtatttctttttgtaaaaacatattctcaaatggaaatctctgcctggagtagtctagttagtaaggtttttcaacctattgacatttggggctggacacatctttgctgttggtgtgtaaggaagggggcggggtactgttttgcacattgcaggatgtttagcagcatccatgacttttaccccctggatgccactctcatgtttccacaagtgccaaataccctctggtcagcaaaatcacccccatataagagccgctgacttagagaaagtttccaacatattttgtttaaatgttcatcatgtttttgtaatttagacagtatacatcggtataagaaagattttttttttgtccacatctcttcctcaattattgagactttaaaggattaaaaacaagtctatgtacttgacatgatgctgaaatttctcaggccttgggttttcattaattcctagccaggaggtttactttccttttctttatgtcttttcctgcgaacatttgagaccttgccagatttgaagcatgcattaaaacaagccccatctacctgctcattcatccgttcaggactagcgttgctttcagttcaacagggggaaaaacagagagagcagagtcctgcagagggaataagaagtataaatacaatcaagaaggaaagccatatttgaacaaggtttcaggactacagacatataagggcaaccagagaaagcctcacttaatgaatgtgtttgaacattgtgaggaacattttaaaaccatcttataaagaaggtgctccaacattcagtcacaaaatgtatcaattaatcactcaaactagtgtatcttgaatattcacactgctaactagtcatcctttccaatttgtcagaaatgaattaggattcacatgtttgtgagtttctatttccaagggaattatttccacattatgcagtttgtcttcggttaacaaaaatgttttaaaagaatgttttcaataggcacttatatatacatatttgtgtaaagcaatggtctgcaacctggctgaaattgagaatcccctgggaagtttaataaattgccagtgctcgggcactggtctcagggcatctaatttaactgaactggggtgtggtccatggatcagcagcatcagcttcccctgggagcttgttaaaaatgcagactctcaggcaccaccccgtacctgcaaaatcagatcccccagtgctatgggtacattgtaaattgagaaacactggcccaggcatttttttgtttgttttttgttgtttttaaaaaaagctcctaaggtgattctctgtgtagctaagtttgacattcactgatatgtagaagctaaaaaatgtgtctttctttcagactgactaccggtactgttcaatgtggtagccgccaaccatatgttgctattgagcagtgtggctggtatgacggagattctgaaatttttgttttattatgtacttatgtcctaggcactgaaggctttaaatacatttctcattcagtcctcactccaacactatgaggctataggttagaggctagtattagccagtgcaggactacaatatgccatcttttatttccttttatgtgttttctaccatgtaaacgatgggcatttgccttcatgtaccttctgaactcatctaatgagttttgatattatacaatcacagggataataactccaccctatccaagcagctgttggagagtcattaaagggtgatgattaagcatgagggttttggagtcagactttctaggtgtaaccaagggcccctggccctgtcacttgccagcttgcccacaaccttgagaaggttcccgctgtcgagaagtttctctatgctttgatctccatgatcatatatatgcattttctcgcattaaaaccaagtgaatgctcagattgacattactataggacacttcacaaaaaaagaaagtactggctagaggtatgtttcctaaacacacatggcaaactaccctttcttaagctatatttgtatgctctgacagcatggctatggtgcaaatctatcaacaaacttgaccctaagaagccagttacatgacctataaaatggggattgtgttcattgttctgtcttagaaagtggaaagttctttgaataccttaaagcattgcatgaataataattgtacctgcaggtgtattgtctggattatctaccacccgtatacattttaggaccattttttatcttgactttctacaatgaagtttacttatgaaaggtgagaataggggactaagagattttccatcttgctttctcatccttcatggagaattccacaatagtagaaacggttccaaagtgagggacatgtgcactgaataaacactttctcccagaggtgtaggaagtggcagatggtgccattcaccgtctctcagccaaactcacccaggtggtgatggctgccatttgccgaacatttatgacatactccccacttcatgggcagcatcctacttagtcttgaaaccacccattaggacagcgttggtcttattcccatttttttagattaggaacagtctatgggagtgtagcttagtttgggaaatgctggtattcaacccagaaccatctgacttaagagtcttaatgtttaatcacactctgctccttccttagattctcgtaaacaccctagaacagttgcatatcctagaaattctgggtttaactcaaatcttgacaatttagaatttttctctcaagttaaattatagaattcccccctcaggttaaatctctgatttctgcccagtctagaagtcagcatttccttgggcatctatacatatttggctttatctatatcatcggtgtggcctctggaagccttgtcagcctctttctttttgcgatcttgttttaccttctagtgccatatctatgcaaaaagaaagaacttttaaatgaaggtttgttttgccatttaatagtcttgcttggggagtgacagagtggcaagaaggtgcttagtatttttttaatttaatttttgttttatcaaggaaacttcctttcttctctgtgaattcccagccacagataaacaggcttgtatcttataagttaaatacaattactgctatcaaacctagagcctttttctctctcccataaatgtctctaagaagctgataagcatttcaaggcaaactggagcttggactaatgctaaaattaaacataaccacccagaagacaaagagaccagatagaaatacataaaacatttgaggtggtgggaacacatggacacagggcacatagaaacttgcccccaaaacattaggttaatacatagctcaaggttatttataaaggaattaacatacacaaaggagctttttataattataaggatttacatcagataataacaattgtagtagccaaagatattatttatctagaattcacttgtgaacagggcatgcttttggtctacagggctgttgagcaaaagaataattttgctgcaaccctctgtaggactttataggatgcacatttacattttccccatttttagtagactatcttgggatttaaagaagaagttggaattttaaaaattagaaagcacatcatatttatttagccatatgttaaatgttataaatattatagtttagggactcagtaaaatgaataattaaaaatttgagggtcacttctaggtacaatgtaaccagggatgtaagataaagaatttcttgatttccaaccataatgcatctattttaattaaataatatctttcaagattagaaatacagtgtagtcacactttatgggatttttaaaattatacttatctgaaatagtgtgacataaataaaaatattaataacatctccctctatgtgaggcatcagtaataacatacattcttctgaattaaaacaatcatcaaatattgcataatttcaaagctggttagtgaattacaagttttgttttccctattgtcacatggaagctctagtttaagtagttaatacaaattctggcctgcagaagttgtctctaattacgaaaacttagaattattatcccagccataaaatacaattaccctgtaccgtttttcctctgccccagagctgcctgaacaccaagtgtcctaccacccatacaagagcatagttttatttatgggaaaagtttccaagttccagtctcttcaatttaaattttgcacaaggttgcagagtctctctagttatttaaagtctaaaaagaacactgagcttctttgagaaaggtggtacataaatatccaataataataatatatattcacatacagtatgtcatttatacttctataaagcagagaaggtaatgaaaggtgctctatactgtaaatcactcaatcgattgtaatcatattgcagctcatctcaaagagataaagaccttccactcctctaaaatccctgtcaatatcctagcaggctgaagagaggggaaagggggtcagaagaggaaggagggaatgagtcaaggacaaagcggcactttgagtcttcagttcatggagttaacatgaatttgattggattcccagtgatatttacagttttctccataagatgcatttcttttccacacggtacttttacagcctttcagtaagtccctgatgctctgtgttggccttgatggcatagtttactaagtgccaatggtagatatatagcacagcataagaagacttagggactaagtttataagtagcaaatgtcaattcgacagaacttaaatgctgaagtgtatatcaaacaatagaagtcgattgatcatgggctagcaaaaaatttatattgcactttcaaacagcagaaacactgtaaaaacctttttactaactgctgttgcctttaatgtaatagaagtattcccctatcctcatcaccggggtagctctgagtggagccatttctttatgcacttattcattcaccttcattcactattcaacaaacatttgttccacatctactttatatgtgaattcatactaggtgatgggtatatggtgaaaaatgaaacacagctcctgacctcaaggatcctcaagtgtagttgaagagaaatacaagtacacaaggaagacatttttattgagcagttattaattgccaggtagggtactgggttcttgtatcaagtctttgcagtagccccaaggggtagatattactgttatcatttcacaaatgagaatctggagcttctcctagggtcaagctagcacatgaatacctggaactgaagcctgtatgtcttagaaggcaaacccaaagctcccgtacgctgccctatcttgaacctacaattccacaaagtgaaagaaggtgctactattgaggtgagatccaagttcagtagcgggtacacataaatgcctaatggagcctgaagatcagacaggggcgagcatggaatacaatttgggatgtgaccttgaattatctggaacaatgccaataagctctgctcccctacctagtgtgaaagatgacatgacaacttatacctttctcattgaggaaattaatgaccatggaattctttcttttacttaaattttttttttacagttttattgagggatgattgataggcaaaaaaatcctgcgcatactttgatgagtttagacatgtgcgtacacctgtgataccttcaacacagtcaaaataaacacattcatcgtaccttattttacttagtgtcatctccccagtggttccaaggtagaagtattaatctccctcatttacagatgagtaaaccaaggttcagggaggttgagcacatttgctgtggtcactgtccaccaagggtcaactctgagattccacacagatatgtttgccctcatttgccctcacaacctaatacccaggttgcccactccacttttccaatgtcttccaagagcactccagtttgcatcatctacagagctcaaattcacatggttgacagatacaaattcacatgcaaatgtactattatttcctacatcccagtgcatgcagaacactgtaatcccattattaaacatttactagaaatgtgcttctgcctgatgcacaattgccagcctcaatgtttaattaaactagatttgttttcattttaatcacattagagaaatgtgtttttctcagagttcagtggtgaaatcttcattccaaatgcctccaagtgactgaaaactgtatatcccagaggaagggatgagggtattacaacctatccttgcataaaatattttaggggaaaaatattaattaataacaggtaagactgggatacactatttgtttttgaatcatcatagcatcctggaaaggggtcctattattattattaccattttagagatgaggaaacgaagtctgagtggttaagtaacacactccagtgttgcacagctagtaggtggcagaaccaacatttggatgtagacagggaaaccctgatatctttatttagattagggatcaccaaaccttttcccccaaaggccaaataacaagtagcataggctttagaaaccaacctatcttataaatataaatatatttagatattaacttcaatattttattaatataaatatgatatgatttgcatgatctttgttgcagttattccagtctgctgttataatgcaaaatctactatagacaatacataaatgaataggcacagctgtattctaataaaacttgctttacaaaaacaagctgtgatgaaccacgtttccccattaggtttagctgggggaaccctgatttaaatcacggatagttggaagcctacagcttttactaatccatcagctttattttttgaattgtcttatctgtttggaataaagagagcaagagtatctctaagtggatgggttaaatccctagagagacagagaatagtactaccgtgtagggtgacatagacctactggtgaggttaattcaggataaagaaataaagagatacaatatgtaagaaggacaggcactccatttacgtatagttaaaaatgacaaacaacaaaatagctaaataccatttttttaattcaacaccaaagacagacacagattccattctagagcaagatttgaagatgatggacagaaagcattgtttctttacttctgttacttctacttaataagccgtggtgatttaaatacacccctctctcctaaaaaaatagtgcttacttttcttttaaattcaagaattttgattagccaccctagcctatttctcatagcccttatgcataaaggtgccagttgatgccttgcattgatctttcttttctcctacccgcaccctgattgatatgtctgtcttctaagtcttagagagcatgcccttcattatctcagcattggttgtccctgtcttgctgctgagagcttcctgcttgagcttcagttccattttcaagccattgatctgatgttctgaggatggactagcccactttagaggtggctcagcccacttcatgctattgagttttagagattttagaatcagatcccctatttattaaagcagcaagaccaggctatcagtttttatagatgtgcatatgcctaaaaccatgtagtatttaaaataaattttgacctacatcctctattccccaccacgcctggtacccaccattttactttctctttctatgtatttccttcacttttattttttgctttttggattccaaaaagtgagattgtatagtattttttttctgtgcaaagttataagggatgaataagtctagagatctaatgtacaacataaggactatatttaataatattgtattattatatattgataatttgccaagagagtagattttaggtattcatacgacaaagaagaaagaaaggaaagggagagaaacaatcactgtatgagatgatgggcatgttactttgcttgactacagtcatttcagtgtttatatgtatatcaagattacatatataccttatatgtatatataccttaaatatatactttttttaaaagccaaactaaagcacactgggtttttatttacaaaatagggacccccttcacagtttgctgacctcaattttgactccaattaagttatcaaagttctaactaccagaatagaaagcatatactgccagatttggccctatagtgcaagaaaagtggtcacagttttcttaatcctcttttaaaaaggaaagaaacaaacatagtaggtaatcagtaaatattaaactgtacaactgaggtttttggagctttctgacttcaatgactgcatatacacaacaaaaatataagttgttatacagcatccttgacaagcattaactataaatacttttataacaaaagaaaaatatcatttactacaaaacttttaagcttttgctttagaaatgtttctttattgaaacaaatatgattttattgaaatattttttatattagtacgatgactctttattggtctcaaagggtggattgccaagtataattaaacaaaatgataaataggaggaagatttcagtatccttgacagaaaaatacatataaatctaatatagatatatatgtaaaaagtaaatctaaaatcttagccaaggtttagaaatcttattacttcatttttatacctttataaaactgttgcgaggtgctgtttcaaataaaataaaaatttatgtaagtaaaatacaagctaaaatagaactgaaatgtctttaggtttacaaaatgaatagctggattagtttactgaatttttttctgtggtatgggtggcactggatctctagaatcggtaaaaataaaggcaatatattgttctcagggagcaattgagctctcctagaggaggcaaaccaagtgaaatctaatagttttgcttcattctgtgactttcccccgctatgacctcagaattttgagctacaagtaggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtatcattgatgaacacataggccaaaacattattgaactattcagaaagtaaatctagcttattctgtggctgcataattatataactgtagctttctgtcaggttacagtggctttaattttctgatcaaataaaacaatcaatataattgtactttgttcctccctcttctggcttcgattctttgatttgtgccactcaccactctcattcttccaacctccccctactccactggcccctgcagctacttagaatagctagctgttgattaaagggaccaagagtttgagcagttactgtatactttcaaaccccactgccatttggaagtgaagtcccaactgacatagccaaactgtaaggacaaaagcaactctaatacctgctttcctttgtttatagcaactgctcaaattctcctctaaaagtattcattaagcatccttctctataaatctctgtggtagaaactgaataataggacttgaaccattattcaatcagaccaagtttaaacccaggttaaggaaagaggaagtctacacgtctttgctgctcactgtgtttagtatatatcctctataattcacaatcaaaagtaaatctttggacagcattcttgtttgggttagaagaaaaatttcaatccttgttcagaagtctaagcacttgtgaggattccaatatgatttttaaaggccaccatccctgatagtcagaaataaaaacattaaaccaagaagactgcaggctttcttctcacctgtccatctcttgtcctaattacaccttatacttactaatgttgtaagtgctttttgacaagacagcaatggtacatcaatagatactgcatgaacttgagtaggcaaatcaagtcactcagaggccttcttttaatctcttggatcattattgcaaagataaaagcaggtttctgaaggagtgaaattcaaaggaacctagtaattagaatggtgaaaataccaggtcacccggtccgtttccctgcttggttcagatatttctaacaatatgtactagtttaattttattcatctaatttaaaatgagagactttatctttcttccaccaagataatatatctgatttctcctctttggcttaaattttttttttcattcacatcttttattattagggttgtcagttgaaattattttgaataatttctttaaatcatggatttttttcttacatctcatatctaggagctatttcttgttgcaaggtgcaaggttctatggcacatacaaaagcatgctttcatttgggatatttataaaatctctctatacacacacacccatcaatgggcaaatataaaaagtattgcctttgtgctagcatgtagttaatattcaatgaatatctttacacgtaaaatcacctataatctttagacatgttcctcagatagccaagatttaatattacatataaagtcatatgaaatagcttaaagaaggaagaggcattgttattttatgtatatgtctcaaatgttataaaggttataagaacctttctgaacatcgaaaacttcaaagctaatagtttaatagtttgttggatacctgccatcttttgaggtggccaatagttgtcaactttttgagtatccttgagcactgaaggtatgtcaatgtttggtttcattgtgtgttaaggagggaattatagaagtagaatggagtaaaaagcttaaaaaagaaaaagcactgcttctaaggtgattctaatttcataggaaaaaaatactttaaggactaatattcaatacagagtagcggaatctgggtgccagataaatatttaacatttgtggataattttacataatcattggccactttcttaaaagtgttttttaaagccctaattttaaaaaatgctattctggccatcacatttacaatgtgaataatatttgagtcatgacgtaactataagttacttctaatgattgactgtcacttgagttgtaaatcacagcatttagcagtgctagttgtccttacttttggtaaccccttagtccctggatcttgatcattttggggtctttactctagagtctatctttgctctagagtctagctgccattcacatgctaaagaaatgccccttaaatagtacctataacatcctaaggaaatgatttctaaactcttctcaatgagtttaaaaaggctgctttttgctaatccataaactttaacaggggctgaagaggcagtgcctgctttttaaaaaccaatgttgcaggctgggcgcagtggctcacacctacagatgcatgcctatagtcgcagctatttgggcggctgaggcaggggaaggcgggaaaattgcttgagcccaggaggtgaaggttgcagggagctaagatcctgccattgtactccagcctgggcgatgagagtgaaaccctgtctcaaaacaaaacagaacaacagaaaaaaaggtaaaaccaaggttgcaaggtaggactgtttgtgtgtgtgtgtgtgtatgtgtgtgtgtgtgtctagttttgatctttaatgagagttttggtttgtttctattgttgtgtgttagtagggaatgtggtggaggagtgcctttctagtctaagtatacgtaagtgtattcatgaccagtattcaaagggtattcataccctgcagggacataaatggttttgttttggaatgttagggttaagaatgaaagtgatggccctgtttgctcagaaaaaaaagaaggtaatccttcagtgctctctgtgaaatcatgtatggaatgaaaaaattcattgatggggtgagaggtctcagtgccagcaagtcttactagtaaattcagaattcagcctgctgttcctagagatcttcctctccactcctcatccaaagagtgatagaaggaggtcagataagtaggtccttgtccctttagggagctacttaactctactcattatcgtcttggagtcaatccccacctcattccctgctcttcccctagtctgtgtctagaatcaaggatcagagaagcatcaacacatgcatcaacctttctccaattttccttccctttcccaactccctcagccttaccctctcctctcaggaactgcattattgcatctcttcttttggatttggtaattctttccttagaaagaggaacagggctaaggataggcaacaggggcccagctgtccatgtctccatccttggacccctaagacttttgccacacaaactcctttgaatctggagactgcaacggagctgcttccctcctcctgctgagccttcatggaaatcctcataggagatagtgtttcctttacccactctcggacccctgttcttcctggatctcctgaattcctggctatatcatttaggttcgctgcattgcaaaccactccaaaatttccgtggctcatgtgagtgtttttttctcttctgggttggcttggatggagctagatgatcttgatggcctcatgtacccctctggggtctcagttcagatagccgagtaggttcacatggctgggtttcttttctcatggaagttcacatggcaatctcaggtgtaggcagcaggcaagggcaagcattcatacacagatggctcttcaagcttctgcttatatcacatttgctagtgcccatatgcccaagcaagtctcacggcccacccagaaccccaagggtgaaaagatagattcaaactgttatgagaggagtaagagtctcactgccaagagacagattttgaaatgggattgtagctattttttttttttttccaatttaacacactggaaaagaagaaaggctctggttctactaatcatatttccctcgtaaattttctccttccaaccctgattcaggtctcaagctgtggttggaaatcagtgactttcactaagggattgtcctttcttttctttaggacatggctttttgaaattaatcttgattctttctgccatatcccaagccttacatttttttcctttttttctctatgtctgatcattttgctttaagtcaaattgattttttaaaaattaaatgcccattaagaaaattatccacattcatgttcccttggatgctttcaaatattttattttcctttgcttttggcagttacaatctatcagtgttatttgtaaaatgtcttatatttgtatagggtatgttctccctttcctcttttcttcttttctttttaaactaagatagatgtgttataaaacagcccccatgctgatccatacttttctctagacatttctgtgagctcagtactttgttgtttatcattatcctttgtttgtagccagatttgaggccatgttgcagttctcacaaacaaatcaatttgaattaatttgccaagtagaattaacgaggcattgtatgaattcaagacatactacaactacggcatcccctgaggttatttcttctctgggaaaattttgattcttgtaccacattttaatagtgtatatctgacctttgaatcttgcactaaatgatacatggctgccagctggtttaatttttgagaagccttaaaaattctatgcagccaaacaaataggagtgtagacaattctttaattattaactttacggggagaaagttgtcttcaagatcgatactctctgatgcttgcttgttgctaggagttctttttctaatgatgttctaagcagaagtttgagaaacatcaaaatagagaatatatatttcttagatggtctttgaggtctccacaacctaaaaatgatgggctccttctctcaaattataagctataaatcccagcaaactctactcccagaaactgtttttatttaattataaaatgggaaagcatttactctaaagagggaccatggtgattacctgaaattccttcactccctaaatggacatctacatctgtcactaatatattatttagcaaaagaatttccttcagactatgatgaccaatgcaaacaaaataaataagaaaatccagtcccctcccacccctcacacggtgaggaaatggtaatagagttcttcaaagaaactctaatttctgggtcttagatgaataacattagaagtgcttaaggaacttgaattctaagcccctttaatgttcgctcagaaataattaacaggagccagtcagaatagaaaactagtctgggaaaagtgtcctaaattttacactgtataataggatggatctcttaaactcgggactgatatataaaacttctccagtgtttcatttgaccaaaaattggcacacatttagctagatttaaaaaagaatatggtgatggctgagaactaacctgggctcattaaaaaacaaacaaacaaaaactcacgcatgctagtgtaactttctcttggatagcaatagcaaattggcaggtgaggaggatattataaataccatgcacagtgtatcttcatttccctaaagcagtatactgtaatgtacagagaactatgaagggatcttaaagagacctgcctgtgttccatcatttgaagctttctggttacactgtaaagtttgaggtaaactaaaataataaaagtaaaatttattatctcacagtttctataggtcagaatttgatagcagcttagttgagtgattctggcttaaggtgtctgatgagttgcagttggtatgaactacggctgcagtcatctcagtgctatctagacctgggagatctgattacctggaaatctttcactcacatggatgttgactggaagcatcagttactctctggctcagttccttgccttatgtatgtttccatagaacttcttaagtgtcttcatgacatgagtctagcttgctcgaaatgagtggtccgagagagagcaccttttatgactcagtctctaagtccacacactgttccttctaccgtgttttactctgtagaatcaagtcactaagtccagcccacaatcaaggttgaagaatcaaacctcacctcttacacagaggagtttcaaagtatttttagatattttatagctccatcataatcttcctattcagggactagaatgaatgcacaaaaaatatgcttattaaatttgcagataacacaaagctaagagaggtatctcctaccagaaacaaaaaatcctagagttaaacattttcttaccatgtttggatgctgttatgaaacaaaaagaatacatttaatgagatataaatacctgttggacgttcataaagtatgttgtatgaatgcaacgtggaacaatttctttgggaagccattcaactagaaactggcttgagttttagttagaaacaagcctaatatgcggtcctgttatgatgtggttgttgaagcaacggttgcaaatcagtatactagtcaggcctcctgtgggtggtgactagaacagtgattgttacttttagatattttgggaataataaattcattcttaggcaagggggttcaaggatggtctaaaatgtctacaattttataaacactggcaattctataggatgtatacagaaggattactatgtcataagtttcttgagcatcggagatattaataatagcatgactttcctgttgtcgggatgacaatgttcctgtgttgtgcagcggaattgtcctcccaaacctcctccctgtcctctgagctgtgtggggacaccacatatgtatgtttaaatgaacagaattttaaaaaatcaaatattctggcattctggcttcaaaaaccttgcgtttgatgttctctacttagaaataaataaccaaacatgagaggaatgagaggagatggggatggggagtgggaggaagagggtagatagaaataaaaggaagaacaacattacagagaagcagagatgacacagagggtggacacgtgggaaggcctggatcacaggggaaagagtgagccccaaaataacactgtggcttttgcagcaaggaggaaataagtgataagaggaaaggcacctggggaaatcttgaagggatcatatgtcaaacggctgaagagcaaacattaaagctttattttgaaaaggatatttgaaaatatttgacaccaaaaattctgtagggaagtaattcttgtggagtttgccttctttttagtttaactcttctgaatcaggtacttgttataacaaatcatatattgagggattattttgtgccacagatttgcaacatgctttatatacatttccttttaattctcaccgcaatcccatgttgcaattattattacgatccccttttaaatatgaagaaactaaaacttaaaatgcactaagacatggctaaaactaagcatggttaccagaaaggaacaagacaaaattcagacattgaaatcaactactgtagcttcagtgcatatttcagaataattgtggaaggaaaaaaaaagtgacatttgaggaaagaaagcaaattttacagtcagtttatgttttgttaatttataacatggcctttttgagaggggctcttaaataaagaattggtgccaggttaacctggcatactgaagaaagtttcatttgaagttgcttgaaaatattctcttaaattataggaatgaataaagaggttgcagtcgcctgggcctagttttattaacctaactgggattgaaagtatccttgatagaggaggagaaatgagcttcaggaagtgagttacaaatggcctcaaagtactgagaaaggataatgattggtaaaatatgttgtaattattgcatcaaagtaaatcattttagtacataatacctcagcagaaatggatttttgatttgtttaggatatgaaagagaagtctaatattaacatgtatgcacaaaacatgtatgttcaaccagcaacagacagcaaggaataggggcatgaacattcggatagctggacgtaatacaccagggttacatctccggcatggttccattcccattccatagcctataagatatttggacatgataggccaggtgtggtggctcttgcctgtaatcccagcactttgggaggtcgaggcgggtggatcacgaggtcaggagttggagaccagcctggccaacacagtgaaaccccatctctcctaaaaattagctgggcatgatggtgcatgcccatagtcccagctactcgggaggctgaggctgcagtgagccaagatcacaccactgcactccagcctgcctgtctcagagaagaaaaaaaaaaagatagttggacatgataactacatgtctacaggctcatcagagagagagcacaggcagaggctagagctcaatgcaaatatcgagactgaaaaaggttttggaaggctctcaaggcaaggatttaccctgactcccatccccctgctgttcaaggctccttactgggagaaagaactttcttttctaagccttaggtgagtgttagggaaggatcctaagaattaaaacaaatcacaggctctctcaactcccaacctcttttgattccccacaagctaagcccttgcctgagttattgcatttaatttggataaaaccatgcaatatagatattaccttttttaaaaaaacaaaaaacagatgaagacaccaagagtcatctagattaaataaattgcccaagttcacagaactgataaatgtctggacttgattcaaagtttgtctgactccatatccaatattcttttcactcatgtttgggccatctttgcttaaacagatcaactagcacagcctagagttggtaaacccatactacaactttaatttaggaaggaaatgatactgtctgctcgtatatatttgccattatcagaacatatccagaagacatgtagaggtgagctttatcagccaacttggtgtacgacagggtgatttgcacttctttccagggtctccctggctcaaggagccacttaaaaagctcccttacttaataatgcccttgtgctctgggtctattaatttacttcccacaagctgatcaattttctgttccaagacattaatttctttaccttggcacattaaaggatcaaagctcacaacatataaatagttctttttccttctgccccaaaggtgtgtagtgaggattaatgagatgatgcttataattgcattttgagctccttggtcgaaaggcactttataaatacaagatattagttttttgctgagatccatctatcacttacaagtggccaaacattctagatggcctttgggtgtgcaacacctccctctctgactctgagttggtctgggacaatgccagaaatgtggctcaagccaagttcagagtttctggagttcccttcctttagtgtcatatactttctctgaaacttaacttagaaagtgttctttgggggaagagacatggcaataacctctaaactgccctagtacttgagggcagcagtaccactacattgattttcttttgcctctgactttaatacatagcatttattctttgactgttcattagacccacagtctgattttttagtgtcaacaaagcaataaagaaaatttgttcctcctttatttcagggctcaagacaaaattcaaaaatgcctttggcattcattttgcacagacgaatgttgttaggatattcctattagcatgtccacgtgcttgacaacatttcaggtggtattaatagtctacctgcaagaaagtgctttctgccagcctggtgcaaattggcagaacctttaagccactctttctcagcttagcagcagtatatcatcattacctgtggctggaccaagaaatcacatttgtcaatgcctgaattgctcttttactttcagtggttttagaaatccactttgttttggaaatgggcttagctgagtatgttagaagatacagaaacatataaagtgatagataagggatttaagggaatattaaggatgttacattttctatggtcagttgatctttggaagatgacttttgtgggaccaaatagaatatggtcatcttttgaatgaaggactggtaagtgggaccaaatagaatatggtcatcttttgaatgaaggactgataaggtagtgagacaagggaagcataccgtggaactaatgagcttccttctgatcactagaaaagagtcgagtcatattaataatgatagtttaaatatgctgtactccctattattctatactaagtcctatggtaaattgagaaatggggaaactgaggccaagtgacttgcccacgatcacacagctaataagtgataaagttagaactcaggaccagatttgtctccagagcccatggtcttaactcctatgctgtattgattatggctttaagagtattagtataccttctaattaaataggacccatgtttggaccaataaagtgtaagcgcagtgttgtaaaagttattttccatgttatacaagagttctatttttcagttttttcacttgaaataattgtattccttggagactgttaataaatttcgagtctcaccttaaagaggaattgatgtatattgaggcctactcaagggtcagtttgctttccgtttctttcccttttacttttatcctaagtggattcacccaaagtggaaaatgtgaggttggagtgtaaaggttggaactatgaaccagttgggcttcaatactttcacctcaaagtattctgttcttcacaatattataattccacagtgcatgtgcttgttgcacacgtctccaggagttgaaatacttgatattagagccagtggtccaaatgaaaatgaccagaagaggccaaatgtataatgttctcaatcccttatcaaaaatagatgggaataaacacacatatatttaagtacaataaaatgtgactaatatgtttttttctaaaacccagtcccatataggtgtcggatccacagaagtaatttaagaatggtttatttgaagatctctttgtataatttatagatttctcagtgtgattaagaaatgaagttattacatttttttctctaattagtaatgcacgtatgcctccttttaatgatattatgatgtttactactcatagggccattctttcttgagtatagccatcactttctgttgaagaattgatttcactctttgtttaaatgtacatacttgttgctatatgaaatatatgactgaatatcattaaagatttagcaagaatgtaggtgaatttggtgaggtttgttcagcttttagagtagccctgtataagaatacttatatttagaaggttgtttgcgcttcagtcaaactagcaaatgaggcatggggcaaataactcattctcatgcacatgtttctaaaacagttcttactaatgtttgagataaattaaaataaacaccaacaagaacatgaaaagagactaagaacaatgttaatgcggcaacttaaacaaatttggttttccaaatgaccttccatctttcacaacttttaacagcatgcaagattgctatccttagtgccagatactatcaatctggtgtggaaaacttaaaacttttttctaaatgtctttaaagctgaggtggagaagaatgactctctgtcactttcagaagggtctaaggttgaatcatgaccatgctgtccttccccatgtcacttactgtttatctaacatagttatctctttttctagcctgtatcatgcccccagattattttctatggtgctttacgtttgaaagagagtagatgatgagggtggggatgcttaggagggacaagggccctgtgtatttggaggaagtaaattaatacagcttcttaattaatttggtgtatattaaattctagaaatttggaattttagttacttctgattttgccctgcattttgctaagaatatttagctttatacttgctatcgactacaccaatctattccgtagtgagtagaatgaaggtcattaatatatttaatgtgtagccaacaatggcagatacagaaaacccaaagtaatagaatacattcaaggcagatctggcgcaagccaattaccttttctcagtatagtattctgttgtgtctaaaaccctagaggatgaatgacatcctttatgatatctgtcacctgtagggtaggattatgagttatagatgtatattcgtttcaaaaaggtacacgttctttttctatgaaaacgtctaaaaagtttactcaactttattttgaatgaatagaatgttgtaccaagatctaccaaggtagaccattataatgatctctaatcgatagctatattctttcgccatgggctattgaaacaccaagaaattaacttgcctgtctctttttcctctttgcctgccctctccatttttttctatgagaaatgattccttgaggaaaattttaaattatccactgcagttcgaaactgttaattgttcctattgcattttatttttcaatacattaatatgttataccctgtaccaaccagatacagtcccaaaacataggctagaagcagattcatagttgcctcttttatgagttcttattttaaaaattcctggtagtaaagatatgagtcagcttgttagaataatttgtctgtatgagaagtgaatggggaaccttgtgaacatcctccaatattgctacccgtttcctatcctatacccccaccctcacaacacagaaggtaggtaccagtttattcccaggtggaatctcctcagccaataatgactcctatatggagatggccctgcaattgaaatgctttagcatgcccctattcatttggtctgatgctatatgcaattctaatattctttatggcttttagaattctttgtaaattgtttccaagccacctggtttgagatttttctttcatttttaatattggtagtttggaatggagttccccaagttgcaatataggcctatgaatcaaaagtaatgaattacaattcactaatttctgccagatcaatgtgaggttggttgatgagatagaacagttcccaaggcatggcttcatcattttgttatttgaagcatattcattaagggtgtatctccacagcaccactctccaagtctgtcctaattatggaaaccattcagcagtgttaataacagttacgaaggaagagggggggcatactggcagttaaaaccactatgtttgagccttgaaactaattagatatttcatgcttggaagaagtattcctaacaggctttatgaatggatgcttgttcagaaaggtcctcttacagtaaggtaagagaaagagaaagcaggagggagagaggaaaggagggaagtggagggaggctaaatatacaaaatcagtgtctattataaaatatcggtgctcaaaagtctacaaatgttgtaccactatattataattacctctatttcctttgacatttgagtttccttatttttaaaaatgtggaacaaatctggaaagatagtgatataaaagcttatctgtactgatctacctctttgacaaagataatgagatgcaaggacatcctttatgtaataagaagtctcccttggccatcaaggcttaaattgtcctctcctcctttcccctgtcggaacataaagctgttgcaaacacttgagaggagaagaaaagaaggacatggccctatgtttctgatgggaatacggtagattaatagtgcagcttgcgtgactgtggagcgagggtcccgtctcacatgtgaaactgatctggcaggtgaattagtcatgggtcaaggagatccttgtgtctcaactggcccaattaaggtgtggttgagatgagacagagagagagtgaaggtaaatccatttccgtaaacggccagacctcttaaggattcccattccatgccacttttccaaaacatgatggagtactgcatggctaagactaacctgacctttaaacctatcgaccaagggcagagtgacttcaactccacctctactaaagataaattgatatctatctctaaaaacttcataaaacaaaccaaaaaacctaggatgttttttaatgacttattgacttttcagattgttctttaagctgttttttaaactttaaaggcaacactgataatgaacgcttccaaatggtaaaacagaaaatccccttcaaatataatcggcctgtagaggagtggctgcaggaaaaaggtaaccgtcattaaaactttcattttaaaatcatttgatcctaaaccctcatttttaaagcctgcaaataaatgttccttaaatgataatcgcctgctgcataaatgactgttttaattttcattataatttgtgtcagcttccacctgccatatgttgataaatcatgctataatacattgccattaaaatacagttaaagggactaacttctagcctgctatcagcatgacaaacacaaacaagaaattccaggaacttctaaaacagaaatgtattatggcaatttaaccactgcatgacattatttattaatttgttttaaattaccttttacaccaaagctttctaaagaaattccaaaagggctttttaaacttacacctggaggctgttttggcttgtagcatgcttaacaaaacaaaaaacaaacaaaaaaacaaacaaacaaaaaaccatagattgactcttgtaacttaaactacttaaatattgtaaggggagcatttttttttaacatttgttcttaaagaaaaaaatgaaaaagatgaattttgcctttaaaacctacagaggcaaaattattttctaagagattaaggttgtgtcctagttgctgactgaaactaaaaacaaaaacaaacttattttacacttcggttgtgtgcatacacttgtgtatttgatgttttatgcaacaaaagtgtaagaagttaacataatgagttggaaaagaaaaggttcatgaaaggcaaaacagcagtctctgatttgctggagacaacaaccactgttaataaaagagggcagcggttataactgatgttagaattttcctgtatagcttctagctgttagaaaataaaccattgtttttcaatgaaaaacagtctctaagaagatacgtattctttgttgttgttgttgttgagccagtgtaagctactcttgtctcaacacctaaagggagctcttaacatttgtagagatttcattgagttatatagaagaagtaaccaggtatattacttagtatacaacttaaagagcaaaggactactacagttttaagttggaggaagacattcagacctttaaacgtggaaaatcctcacggagtgttaactgtttgccctgtttttaatgtatgtggtctaattaaaaataagaataactctaaaaagcaaataattttgtttagtaatcatcagctcataaagtccctttaacattaaagacaatgattgcctcactttaaacaggaaaagcaaactagatgcatgtctgagtctcatgtgcctgagaaacctttttgtttctttcaattttatgttaataatttttattttactccattgccttttaagtctaagtttaatagcatgccaggcattttcatttgtataaaccattataaagttattagtaggcttttagtttttcttacaatagaattgttacccgttggctttcacataaaaggtgctttcaaatatacaagttgaggggttgggatggggggaggggtggctgaggtgggactggggaagatatcctagtttcttaaatatatgtatgattatatatgcatataaatctgaaaagaattatttgcaaaccgtgagtttctcttctacattttgttctctgaaaaaaaatttttgttgtaatttgggtgagtaacatctatgcattctattgtcttacctcttcctctgcctagctaaccttcccttcaaaaggaataaaatataccaaagacttgtaaagacaatgaatataaaggataaagatagatggatgattagacagatgcatttggaagtatttggaatgcctctttggagttatttctgtcactggggtggagagctgggtcatagcattcccaagtctcttttctggctctgtctactattgactaactttctgaccttagacaatccacttaacctctctatatctcagatttcccatctgaggacgggcaaaataatactgcctattccccaagggtgttctgaggtttaattaattagtctttgtgcaacactgactggagacatgcaaagatttaatttaagcagtatgtgaacttgatgtccaaatgaggtaataattaatgacttccaagaggatgggtatctaaaacaaaaagtaacctgctacaattcctctaccagtgtttgttataaccaaattttgcattaagaaagataaaatagttctcagattaggatatatatgcataaatatgcacatatatatatatgtttttatgtacatataatggtcagttattataaaaatctgatcataagccatgagtgaaaataatgagaataatgagatctggcattgatttggggaaatcttgggcaaatgataaaaagaaactggtcagttcttcacattcttcatagggaatgaatagtgatggttttttctgttattcactaacccctgtttatctgagagataaattaatcagagtaagggatggcaggacacgaagagtgctctactgttcctttactgattgctagctttgccattaaccacctaatccaaggtacagggagctaggagagggttttactacagcagaagagcagatctagccagaaacagaccatgaaacaaacaagcaaacagaaaagcaaacactccctatggcaagatgaaaaactgaaacatagacaaccccctttactgtctcactccatcagtgtcttattctcaagaattgattagtcagatctctctgggaaagtagctgtagtcaggagtagaggggtagtttaaatcttgtagcccaggaaacctgccttgcctttcctgatgcttgggtcagtcttgaacaggcaaagagcactttgtggagtgaatgatggcaactggaatgaaggagactcatcatctctagccagtgtaattcagctttgcattttcagttttctctgatcctctttttatttgtaagcactggcataataacaccactggagagataagatgagaactattatagaggttatcattgtgaagtattttcaaggatattagaatgtaagattttctacctgtaatcaagtataactgttaacttatcaccagtgctgaactatacacaaaataaagagatggataaatattatgattcgccagcagttgtgtgcatggaaagtatctcttggcattaggctgtctaatgtaagatactgaattttttcctagaaatctcctgctaggcagctgcttctaatttctaattcattatgttaagctgcttcaaatgcctctgtggggttgagggagaatttattttccccttccatcatttcatgtcttttgtagtaagctcagggcttccagaaaaaaaaaaaaaaaaaactgtcatcaacaataaacagtaaagaggtatgaactccagcatattacttagtattattatgcattgaactttctgctgtgtcttgtgtgaagaggacagaggacaaaatacagacagtgatgcatatgcacaacacactaaatgaattgctgagaaaatgatgaaaatctatgagatctgttttgattgcatccttgggatctgggtaattctgtagtcattaaggccagcagatcccatattcaggttctggagatttttataaagtatagatcattttcactataacaaagttctctggccaattcaccatactgcagtgttgaaagcttccaaagggctattatttgtaaatcattcttgattaatgggcactatgagttgcctagtgtgcagaattaactcttgtctaaggagtatcctctgatcggatgagcattctcttctctgccacttccatttctttcattgttatacattgagaaggtatttcacattatacaccaggaattcaaggacagatcaacattgtgtagccttgaagaccatgtaatagtggtagatttttaaagcccaaacgtgacaatatccctctattcatattggaaattataaagcaaaaagctttataattttgttaaaaaccctctttttattaagtagtcataaataacaaaattgtttctagttatttctagctaaggtaattcaggtgattagattaagaatgagtggagcgttgtttgatcactaagtagagaaaacttcagaaggcgtatatttaattccattaataagtctttcttttttcctttcttcatatggaaaagcaaaatgaagtaatctggagacataacagtaaagaaggccttagcatattgctgttctgataaattgcaataaattttaaaaagctcttactttgagtttgcttgggaaaaaaatctcatacttgagagttttataagtagaaagagttgggaggaattttagttgggtttcattcttctaaactctatactggtatgttttttcattttgatacttttcagagcagtataaatggtgtcaaagtgggaactcgaaataaagtgaactattgatattcttcaactcattaacacacctctatgtcattttaaggagttttatatgttgctttcttcattaatatccatccattttaaaaaatttattaaatctgaaggacaacttccccaggactggagcattaccaatatgcttatatttcatactgagggaataatttagttgtgggaccataatccatcctcctaaaaacaaattaatagagataggaatttatctctcatgattttgttaaccagaaaatagaatattatgcccaatgaagatttataggaaatgatacgtttggtgactagaaatgatacgtttggtgactagtagttcatttttacaagtatgcaatgaatccaagtctcttaactgaaatttaatttcagctaatttaattatcagacctggtttttaaatttagttttctgagtcacctcactgagtttttttggccatatttaattcttttcattctcattattttacttcgtagctttaaacattaatgcagtaggtatccgtaatttattctggtcatcacctgatttgagtgtttctttctgtcatcctcaattatatacccaagaagaccataatacttcttatcattgaaccaagatttcttcttcctcactatgaaggaatagagacttgattgttcaagttatcaaagattttcagctagacagtggaagagataaccataatgaaatgttacttgctaacgtcagtactgaggttttgttgtctattttttcctccccttcaattgctcaaggaagcctgttatgatgcctggtccattcagaccaggtaaggcaaacaaggaaaacgtatgagaataataatgtttcctccacccaacccactaggccggcagttaaccatcttcaacactcaggcgcaaatagccattggtggaaaggacaaaggacgcctcttccaaggccaactctctgggctctattatgatggtttgaaagtactgaacatggcggctgagaacaaccccaatattaaaatcaatggaagtgttcggctggttggagaagtcccatcaattttgggaacaacacagacgacctccatgccaccagaaatgtctactactgtcatggaaaccactactacaatggcgactaccacaacccgtaagaatcgctctacagccagcattcaggtaggcctttttccaagtattaattgcgtctgtatttttatctttgcaacattgttatcatggtcattgctttatgtagctaaagagtttgaattactatgtaagaaggatgctggcagatactcatagtaatgagacccaggagaagagaaaggtgaagtcattgctaaagaagtcataaaagtctgtggcactcctgggttgttattcttattgtatttatcactgaaatggtaaagctgttattcaaaacgagcaatggactacactttcagtatgaaatactctctcctttaattttattaccttttcaaataacagaaagggcaagggagggaaggaaaatctgttatcatatgaaaagctatatcctagttcaatttcattcacattctccagatggctttgctataacatgaatctttcattattgaggtcaatgggtaccattaaatcaagggcagttaaagttagaagtgcaactactccttgtaaaatgcagtctttatgtttgttatcaaatcctgattaatcatgtgtcaggtttgtgcccattttgttttctttatatttgatcaagatactaattacagtagaaaatttgaaggtttgagtttggctataccggaagtccttgtttttgtggcagtttttttccacttgaaagtaattatatccaaactaagcttaatactttgctgactcccttggcatttcataaatctagttagtagggggtaggaggttaactgaattattagccttaaatgctctggcataccatgagacattccaattgctgctgcgacaacaattacttacccctatcctagttagtgtttatagaaaaatcagtagattagcacttgtcctgtttgcttctttgttttaagacattatccaggagctcagttgtgtctttaacatcacctttacactgactccaatggacgtggttaacttaaagtcaataatcaattataccacctatgtgttcccatttttcagaattaaatgtatgtgagctaggtaatggtaagtgtattatctgttgccttcctttttccttttccttgagcagaagtatccagacagctctttgcatggctccacagtaacaatttggagttatatatgctgacagtgtcataagggcaattttatcgttttcaaaaggcttctaaaaacctggttagcatagtactgttaccgtcacacatgctattacctgcatacctacacacatgctcacgagaaaaaaaatagctcttctctactgatattaaaccaataactcctgacaccttgctctactcactgaaaagaagataaaaggcaatatatatttctattatgactctctctagctcaagagcagatctgtttattgttggtgaaaggatagttctgtctgcacaggtcttggcagacttgttttgtttctgtcagaatgtattctgctaactctgtgggaagcagagaagcaaatggctttttcttcataggaatggctggtcctgtagttctttttaaggccaaattttcactgaccttgagatgatttaatgttacacggggattcgggaaccaagctgtagtaattattggttttttggctttccctcctgtagcacatacataaatgggaataaactgggtgagttcctgaactctttccgcaaattaagaaagtcagaactttggaagaaaagtagggtacaagatacaaaatcttgctagtgattataactctaaacgttatagaacctatggccattttagaggagatgaacaactgggaatgccttctccaatagcctctctctggcatgtgtttctttaagtccagtaattatcgaactacatctacatgcttttccttttacttccaccaagtctacaaaaatgagttataaacctgttgagactctttggttttaagggtaagtacatcctcttggaggaaagccaatagcctacaagaattgattagactgcgatgagggattttaaaagccctggattttttggaagactaactagaggaaataactttctgccaagggttttggaaatcttttttgttcttgaccactagtcatcagaactctgccctgtgctccattaaaaacttaaaagcctcatcttcaagcctagtctggtcttaaacacattctgttgatcacatcaaacctatgttaggactggggacccaacaactattggattctattcaaagtttaggacaattcccagactctagagactgcaggtaaggaaggtcagtcccagaagcattaatatgcctatgtgaccccactacttttcttagatgaggaggattcataaagttctgatctctgggagatacttcagaagtgagtggggaaaaaaaggtagggaagactggatttcatattcaccgggcccattattcacttttttatctatatgtgaaatcatacatagaacattttccaaatgataccactgttctgtcctcttttgctaaatttaataacattgtcaaagcaaagttttcctaaaatgagactcctctaggagaaagaaaataagcatgtcagtccaccagtataaaaacctgtctgttcaaaaatcctctagttctttcttaaagcataagcaaagaaaacatcctttcaagagttctttcctggtcaacctgaggtagtgttgatttcagatcaaaggaaaactgtaaggtgctttcagtgctgcttttaaccgtgtgtgaatgtgaacaagtagtttttgagttggtatgtctgtctagtgttatagcctcttagaagtaattggtgctttgatctttctgattccattttgttacaggtaagagtgtagaactatctgtgaataacctggctgatgttaatttactcatagcaatcatgcccaagcatcaggtcttgatcctacattgagaaggatagctctaggtactctattgaattttaaaaaatttaagatgtgcattgagaaagcaggtgtgtgagtgataattctcaagtaaaggcctggcacttcataggtgctcagtaaatatttactgaatacatctgaaaacaagacaggctttattacctactttagagtcatttcacaatggaaggtagcatagcttgaggaaagtgtttcctccacagtgatcagggtgctttggccaaatttgttgtatttttcagtagtaaggctatagcatagtgattcagtgcatgcacttggagctagattagctgggtttaaaactttgttcatcctcatattagcttacatgaccccagacaagtcatgtaagttctagttaactatttatatgaaacaaattttcccataacttggtggtttaaaacaattatgtcattagatttcaaaattctgtgagacagaaatttgggcacagttcagcaaggcaattcttctgtgccatctagagagatgattgtgttcactcagtggctgactttgcctggagggtctggctttatttacataccttgtgctttgctgggttaactgggaagatgggactcagcagggcccttttccctctctatgtattctctgggattctccttgtggtttctccagcaaagcagatgggctgtgtttatagaggctcagggcttccagagagagtacttccaggggcaggaagtagagggtgccagttttatatagcctgggctgggtaactggcagtgtcacttgtacaatatgctattagtctaaacagtcacagagctttcccagtttcagaggaggagacataaatatcacttctcaataggaggaggagtagcaataatttgcaaccaacctaagtctaccacattactaaggctaccatattataaagtagggagggtggtgtacttctagtggctatgttatatgattgtcataaggataactgagttgatataagtaaaatgcttaaaataagtgtaccattcaaagtaagactgcatgcgttttaaccattattattatattctgtttcccacaattggtgtattaaatcaagatcctctcaggcaaatatctgcctcagaaaatggggctgtgactaccgacagtagtggctatagtttagagtaagggctaggaagtttgggggaaatagagatttgaaggtggatccaagcagaatttaggggctgaaattagtcctggcaaatcaaaatttctatgatctcaggaacagacttctctgacacctcactacccatctttaaagttctgttttattttaaaccaacttagagttctatgagtctttgaaaatatgttctgtctatccacatgtcttttagggttgcaaagaagacaaatccagattccttaccatcgtggaatttacaatctaaatagggcaagagggtttgacatgagctatccatatgaagtagtgactcatgaatggctctttgtgctggggatggcaagtgttgcatggtgtggcttgactggatctcatgcactcattctactaggccttgttgtaaaaagagcacaattggacaggtggtgagaggaacatattcctggttggtcaaatgtcagccagaagctaagttgttaaaagcagagattataatctctgggagagatagccaagtccaagtagaacagagaatgcataagagggagtttgtgagtagcaaggggtccagaatcaaaatcttggcctgaaactttgccaagtgggagagggcccagaggggtaaactgaattgggttccctgtgtaccttactaccaggaatgccccaataattgcacaaacacttcctctacaactgactccaatattggtgggtaattattatggtgctgataggtcagcttctaaaatagaaaagttcaactcagtctacactcaaattcgttggtcttccttcaggatagaaggaaaaagtgagaaacaagtcttttaccttatgtctccatcctgagttatcagcagaaaaaaaaaaaagctcagtgtgttctgtgcaaatcaccatttggaatcatttataaactatttgcaggatactgatcatgacatactttttctgtgttgggcattggtaaagtcaccttgacattggcaactgctgcctgaaaattgccagaaaatcacaatgctcagcatggattggaactatccttataactagtcaaaatgaaagacttaagaggtttgtgagatttcattctcaagcttcacaaacttggtggttgaatgtgaaccacttttgcaaattccagaaggaagccacaatttctcatgttttgtaaaaattcttataggcaaagtactcttagcttttcagtgtcagactggagacagtaagaagcatgcttcagccttgatactgatgattacaaaacaaagaaaaaactttggattaaaatgttcatcctgcgcaacgtctgttctgggtagagtctcagtgtgttgaagagcgtgggcttttgcgtcagagtttctgagttggactccaggtttttccagttgcttagctgtatgtataagtctgttctcacactgctataaaaaactacccgagactaagtaatttataaagaaaagaggtttaattgactcacagttccgtatgcctggagaggcctcaggaaacttacaatcatgatggccggagagagaaaggagagtggggaaactgcccccctgatcccccctcccaccaggtccctccctctacatgtgcggattataatttgagatgagatttgcctagggacacagagccaaaccatattgctgtatatctctgggcaggtgattagcctctctaagcctcagttttactgtctgtaaaagtggccttacagtacctttcccgtaggctccttgtaaatagtaaagtgcaatcatgtgtgaaaagcaccccataacttttcagtaaaaattttcacataaggaaaccacttcaacctaagggactctcccagaactcacagatctccctagagcttagccttcctgtggggctggataagcccaggaacaattttgtttatactcatacaaactcacaagggcctggattgtgagttcttctaagggccccagattgaatcagagccccaagctcatcaatcaggagagattgctacggcaggctctttcatattctggagtgggaattggctttgctgaacagttacaacacatagactattctattaggttgaagtgtatgaaaccactatttttgtagatcaaaatggttaaatattagcaatatcacatggttctacgatgacacacagatttacagcatgttgttatcaatggcacttcgaggcccagactagaacctcagatattctccaggtcttcaaataatcaaactgccttgcactgggagacaagatagatccaccttatccccaaatactgtgctatagcaggatgtagatcacactgtatcaaaactggttatatttacccaaagaattatcccctctgggtccttccaccttttccctgctgccaccagcttgagagaaatgagataaggaatctacacagttttcatctccttgcttttaccactagacaacagagcctccgggggaagtttatttttaggatcagggctcaactaatattgattaacagccttacataatgtgaggctccagggtttgttcttttcctgccaagcctcataactggagaaggcgctgaagatttgtcagtctaatcagactttagctgccagccaagaaatatcttctgtcttctccttacccttacgcaggtactttctttttccctcttagagaataatttggggggagagaaattgcactctaatttacttgttgcctggtaagattctctggtgacatttactctctggaactgcacagttctaacaacaacagaaaagggagcttgatgggtttaccttcctcttaaagacttagatgttggcagtacaaataggcaagtgaaaagagtgcagtgtagtttgttttcatccttcctttaatacgtaattttggtggatggaacaggtgctttccaaaactaggtctagtcgatgaaagggtcctgagggcagacgaagtgtgaaagctcccaggagaattcatagagatgcccttccaattaggatgtaatatttacaggatggaatttccaccagaactactaataaagtgctggctcttatttctaggcatctgaacagctgggagggaagtggggtcagttcttggctacccacgggtggaggtccctgagtgtttttaaacctcagggtggtttttctaattacctaacagactctttagccgaatctaaagccaaaatccttgctgcgtggcatatggttctcctccttcctattgctctgaccatattttccaccacgttgctccaatcacacaggtcttcttgatccttcttgaacacagagcaagaagaagggtgaaaccggtgaggcaggattatgcaattgcaagcttagattttcatcttaaaattgatatttgactttttgcttttgcagatttttttcctgcattaatattgattttaaaatatttcagcaaatgaaaacaaagttttagcaaacccccgttaaatcttacaccttaagcgagtgtctcattcaatcttctcagccctgcctgaatgtgccaagcgtgcctgtgccttttcacctgccatttcctctgcctgcagcagcccttccctgctattcacagtactcactccctcacttcacccaggtttccgcttatattgcaccttccagaaaggaccttcttgaccgtctgtaaaatacaacactctatcgccttttcctgttttgttacctctcatagcacttatcactgcctgacattatagctcacatttatttgtttattgtccctatttagtagattgtgagttctaggatggcaagatctttattttaggcactaaaatagcacagtgcctagaacagtagcgagcacagagtaatacgcagtcaatgttggttgaaaggtataaatagtcaaccatccaccagtaccttctcagggagtccacaggccacacaatatttacaggctgaatccaagcccctgtttcccaggacccactccctcatgaggctcaccagtgagggtgggcaccactgggtttgctgctcttggatctttgctctaggaataaggagtcccagagatatctccttgtctctggtatgtaagattatttttgttagcttccagtcttgttgctcagccaaaagcaagggctaattctagcacgtatagttttcaaatcacttttggaaatgtaatatcacccacctttccctttccagtttcttcttcttcctttccaaataacttaatccttaattctcctaaaacccactttcaaatatatgcaaataaaaattacttggtaaggatggaaaattaacttgaggcttttttacttttttttttttttttttttggtctgttgagaaaagggcttgtagggtggtgcctgcataaactggccataaaaatatgggacaataagttgttgaaagccacaagaggcctctgaggaggaaagcctcctaaatgccatcatgttcccaggctcagagcgagatctgctctcttatctgtaaacactgtgttcaaaggagaaagactctgctttgaagcattgaaatgtggccagatatgctggctcctagtgaggcccactccccccagctgctctccgataaattaaagaataaatcagtagttaattttatgctgcttcagcacaaagaaaatttacctaaactgccattgctatagattaggtgtatgacacaccgcccccctttcaccgtttcacccctgaacatctgcttcttagagctaagtgattgtactcaacaaatagtgtggagaccagagcttggcgcctttgcagcctccattttacacttggccccctggcactccactctttatgcactcttaacctgtctattctcattcgtttgtcgccaccggacttcgggtaccctacgggtggtgctgaggctggtccccaacattggtctaatggctgagtatattgtgtgagcaccatttattcatgtctgaaaccctataatttgactagccccatatttacccatttttagtgataatttgaaaaaacattgatgattgagagaaggaacaatagctatgttgctcatcattggacatttagagcctagaatggtgcctgccacaaagcagggctcaaaaatatcagttgaagaaaaataaatgtgttaaacgaatgaaagtaagttaagcaaatgcttatcatcagagtgaagaggcagtgggggccaatataatttatttacaaagtaggcaaagggagttaggaggaagcagcctggtacggaggaaagtgcattgaagcaggcatcaggagacttagctcatgactggagaagttcttaaaaccatgactctaggcagaccttcatttctagctgtagaattttggccagggtcctttgtggagctatgtttttttattatctgaaatatggggatgatttccaacttcaagggtaggttaagataatataagtcaagggcttaaatgggtgcggctcaaagattattattgctgctgtcttaaatgggattataatctggtctcagctgataaaccagtattgcaactatattttcttttttattctgttgctagtttgtggtctctgatatggcaattagcttccttgggcctatgctctttcctcagaaaagaaagttttattttaacattatctagcatagtgtcttgggcacacacacacagggacagttaaatgtaggaaacaatgaattagaagaagtaaaagaaaggagaagaagtaaaagaaaggaaaaattgagaaggagagaaagacagcagcgatgctctgtaattattgctataagaattacgtgcccatttcatggatttgtatggcttaggttgagagagatgaataaaatatctttgatataattaaaatcataatataaataatattttttctatatctcccctctttgctgaaagctgttgggtgagacatcacaatgaccacttctatgtaaaaggtagattatagatggccctctgcatatgtgggattgcatctgcattcaaccaactaactgtgaatcaaaaatatttttaaaaaattgtgtctgtactgaacatgtacagacttttttcttactattattccctaaacaatacagtataacaactatttacctagcacttacattgtactagacattgtaagtaacctagagatgatttaaaatgcacaggaagatgtgtataggttacatgcaaatactatgccattttatattgaggacttgaggattttgccatccatgggaggtcctggaaccaatcaatcccccacagatgctgaggaatgactgtacttgataaatgtctcttgaatcatccaaaaaaaagaaaaagccaatggtttcaatttaaactgaggtaagaattgttttttttttttctgaaaatatatgatgttctatttatatataataggaaaacgacttcaagcagcaatcgtcacttgccaggcatcaaggcggatatttccattatgtctatgacaaggtggtgggaggggtgggatgtggtttcatacctttctggtgcatgtttgaatgattgtaaaaattagaaacacactgaggctgttatgacagccttgccttttgaaaccttctaattaatgccttgggttgtctagagagcttgttctgttagctaaatggtgatttgtaaggttctccttgatttcctcatcattcatggatgaaataattggggaaataaaatgattggggaaataaatgcacaccacgtctgtggtggctagcagtcactgagagaattacttgatgggaatttgattgacttgtgtgtataatgcaacctcttatatctctggccccatcttattatgtgtgtgtgtgtgtgagagagagagagagagacagggagagagggaggatgctcgtgtttgcttgcactatggagaacagtgcttcttaaactttaatgtgtgtatacagatcacctgggtaatcttattaagcacagattttaatgcacgtccggggtggtatctcagatcgtgcacttctaacaagctcccagatgatctcatgctgcagatatgtgtacctcactatagagtatagagcaaggctctaggaaatatttacggttccttgctgagtaatcatggtatctgtttacctatctcttccaaatggtcttcccaaacttagctcagttctcttcaagacaggaaattttgttaacccaaagtattaatgtaagtgaaagggtggataccccaactaaggattagaagagaaaactgtatcccatcagacaatgctgctccgggtttcagatgccccttcttcctgtcccttactttactgcatacccccaaggcagatggaaaaaaacataggtaaaatttaacttgtcataatatttatccccctttctgagaggtgacctccaatggaagcagaaggatgtgaatgattttaatccacggtaacaatggggagccagtcctgaccatcttaagcagtataaatgtataaaatgacagatttttctgctctgcctctccactttctcctcccggatactgagagagacacatattcatgcacccacaactcacactataatgcacaatgaaatttcacccagcctttatctcggggctgctgttctcatgattaatgccctactggctgggaagctattccactgaagacagacaaggagagaggaagatgcatgaaatatatctctgaggccatttctcattattattattatcattattagttccttactaccctatctatctatcctgttagaggatgcttgatctattggcaagggggaggggatgacatttgaaagcaggttttatgagggagaaatgaacaaggacaaagagagaaatagacagtttttatgaaagagaattaacctggatggggtttttgttatgattgttgtcctttatttgggggtttgtttgttttattgttgctgttgttttccatttaaagtcaaaaataatagatgcctccatctgcggcttctgatttttttccctagggatttatttttgcatgtgttcttttgtctttattgagtctctgtctgctagaatcaatatgatataacttatgcaaattatatccctgaccacttatgcaaaaaacagaataatttcgttgctctgtaacactcttaatataattacctccatatcctggttgatttcaagcttttgaaagggctactttaaaaaaaaataataaaaatctatttatgtgttgtataaaccacagtgtctgattctctcctgtttctcattcaaagaaagggtgactgctaaatgatttctggctctgtcatttaagaagactgcacagcagtggtcttagttgggaagttgggaccacaataagagtgctattgtaacacgtgtctactgataaaatggcaaattcattagcctagacaaggagtactatgatctggtttcaaaaatgctgtatacttccacagtccagtttatgagggcatgagatatataactgaggtgcccccatgttacttcaattttagtttgactttgaatttcattaaaaaatatttgagttatttgagtgcctagtatgggctaagtactgtcctgggcacttgaacaacatcagtaaacagacaaaaaccctcttttcttatggagaacattttctattccacaaacattgggtgtctcataagtgcaagactttggagaaataaagaatgaaatagaaatttttctgctttagaggaacacacagtctggtactgttcttaaatattttcagactacaagcggactcacttgcagcccagttttttacaaaaactttagcatgctgattggctagtacagttgcaaaggcagcagccatctatatttacagaggtctattccaagaatagggtctttaatttctattcaaaaaagaccaaatttcaaatgtaaacaatatatgttttgactaaaaaagacagaaaccgtaaagcaagttacaataaagtgattgaaacatatttcggtcctggagactaaatttgcaatgtttatggcaaatatcttcttgtgttggtttgagattatagttttatggaatgtttatattggaagaatctcagagattgagccccacacaaccagatgagcttcagagatgggccattctggtttcaagtactagtttcattgctcaaagctctacgtccaggggcaaattgctcaaccactttataaaaaatgtaaacaacaggtaatttcacattttaatttatttttatctaaacaatatattcacatagtttatttttagtgtatatatgtatatatatttatttcttatttatttcttatttatatatttatttatagagatgaggtcttactttatttcccaggttggtctcaaactcctgggctcaagtgatcctcctgcgttggagtgctgggattagaggtgtgagccactgtggttggcctaagtaatacagccacacaatttaaaaccttgaactgtgcctagatatcccctttggggaaaaggcatcaccttagttgctagagtgctggctgatggctgttggctaaatccttcacgaagaactgcctttgactattgaagccaccttgcccaaccaaggtcaagccccttcctgaagggtggcccatatccaattaatgatggtgaagggtggcccatatccaattaatgatggatgatggagctggggggatctatcaagactcagcccattgtctcaagactggataactgggaagggccttttagctagagagtttcctaaggccagctgaggtctctattgcatgaatgttcacctcccccttctgcccagactctgatgtcactctccccaaacttcccaaacacgataccgggcctcagactttgttttctgaaaacgcagctgaagatagatagatagcatcgtgagacttaaaataagaaaacaacaataacaaaagaaaaacagtagtatctttctaaccttgccctaaagtcctgctctatactggtaacccttttatatccttttcagacatttcccttcatagttctagcaatatgcttgcatttctatttcttgactttttcagtttgacatattaactaatgacttctgcttctggaagtaaaagttgagctttctcatgctctccctgccctacaacccacacacacttttttaccttccagtttcccagtaaaattctatcgcatttcgattaaataaatgttcagagtttgttattatgactttgtaatatcgcctattgaaaacaatgtaagatcatacatgaactgacttgttccacaactattcaccagctgcatagaatgtgccagacactgttctagagactgaggatacagcagtgaaaaacaacagactatatttctacctctgacaaaacattatactgttatgacaatttctgttttcctgtaactctttgtttgttaatgaataccctcgttatctcgttagcttatttttctagccacccatcagtgccacagccaacagctacaaaagacctcacaagataaaccgacaggactccattatttctttttctgtcttggaggtctcccttctggagtcgtctgacctcctgctttagtctgggctgggcgctcgctgagcctgcctcacagctatcatcctgcgtcttccttgctcgtcatgctggaaaatccctgggccctgctcctgtattaaatcctagtttcagctctatttatttcctcattttcaaggtgcacattgtcctgtagcctcctgagaaaggatagctaaaaagtaaaatcattgagacattgctcatctgaagaatgttttattccattctcacccttgacgataatttgcctgggaaggacttgtatcttggaaattatcttcactaataaatttaaaagcatccgtccaatgtttttgggcatccaatgttgcagctgttgacatcacagtttggtgtctaattccttgactgcactgatttttacttttttttttttttttttttttttttaccctctctctgaaatatccttatcagtggacctcaaagtagcacttacaactcaggtctcttgaaccacatgctgctgccccctatagttcttgcttttgtaaagttgtggttatttgccgattagctgccctgtgttggcatcctgactttggtatgatttgatgagctaagctattactaaactataacacacacacatacacacaaaaaatgaatagctataattaattagcataaagttttgagggtaaccaactttagtagagatctgagatatatataatgtatatatatatatatatatttgaacattttgccttgggttagagagggaattggtggtacagtaattcttactggaattgtgtagtgatagctagtttatatatacatatatatatacatacatatacatatacatatgtatgtatatataaactagctatcactacacaattccactaagaattactgtaccaccaattccctctctaacccaaggcaaaatgttcaactcttttttgtattcccttaagagcccttattttttttttcagtttcaccaatcatgttcatttcttagccacctcagaaagaatgagaattaaataatatgtataaaccctttgaattttttacatccagaaatgagcataagctcattcctctgcttcacaccagatgcttatatttttgagaggagcaaggattagaattgtcactctggaatttttatgctacaaaatgtcaatcaatatgtttgcatgtcactgggttccatcctacagtgtttggtgataaagtcttttcatttggctcccagctttatcaccataatatatttatttactttaccttacatgtgctagttggtagaagctgtagaaaaagaattactcccacatatttctttcccctaaagagaaacaatatattgtaagaacacagatggggctccacacaaaaagaatgccgaattaatgttggatggatgtacatatacaagaacttgctatcagtacacaattccaataggaattatatatacacacactgaaaatagaatttgattaaataattacactaggtacaagctacattttacttccattgaaggagagctaagtggaaactagtgtgagacaatcatgaatagaaaagtgcagaaggaatttgatgaggatgttcccagggctatttctagccagaaaacgaagctggaggctttgaagtaaatcaaaatatttgaagaagtaagaggataaatagcaaaactcacttccaacatcatactaaaagcaccatgcaaccatatagaaaacatgcataatttattttgactcaaataactatagggagattcttgttttttttaattaggagatttgaggtaactgtctagactacctatttttatgttgcattcagcaatatgtctgctaataattagagggaaataaattacataaaacaatgccagtcatgtcattgataaaaaggaaattaaagtgtgattgtgtttctctttctctctctccctcattttcagtgagctacatcctcttgttgtcctcctcacctgattaggcatttttgtaagggagtttgcctccgtcctctgttgtaaacattttccttacctcagcatcctttttaaattcaaaagacactttcctttgcaatgcactatgaaaggcgattgtgttagagaatatcagagatggctttgtcatgtctggtgctcttaaatccttttcttttttttcttttcttttcttgagacggtgtctcactccgtcacccaggctggagggcagtggcgtgatcggggctcactgcaacctctgcctcccaggttcacgccattctcctgcctcagcctcctgagtagctgggactacaggtgcccaccaccgcacctggccaattttttgtatttttagtagagatggggtttcaccgtgttagccaggatggtctcgatctcctgacctcgtgatccacccacctcagcctcccaaagagctgggattacaggcgtgagccactgtgcccagcctcttaaatcctgttgtgtcctaaagagtccactaaacgaggttgagggtatgatttgacaattgaacaaggcctcagccagctctcctagactgccccaaaactccctgagcagagagacccaggtggtgatggaagtatttttcctctaaaagactgtggagattctggcaaacctatattttgggtttagctttcaaggaagaggtggcatttgaaaagccaggggcctttgtagccattttattcactacctaatgtgaaggtggtggcagggaatggaaaagggaagattatttagtcgataaacacttaatggccactgcctgctgtgtggacagatctggatagagttaaaaagataataaagcaagtgtaggatgcctgtcttcatggtacttatatcatgggaagaaggcatgaacaaaccaattttacacataattattcaatcacaatcatgacacagtgtgataaaggaggacaggcttctaagacagcagaaaaggacctgaggtagtgttgtcatctggggaagctttcttgtagaagcagtatagaagctgtcctgtgcaggatgagatattagattgcaaaagaggacaagggccagtgttcccgccaaaggaaatagcctatgctgaggccctgctgtagggatcatactgtatcgcgttcctctggctttggactacgcattgatgctaaagtctggaagcataccatattcgaccaagtaaagtgaccagttaaggtccccacttaatgggctaaagataggtcattccaagagtgagcctcccattattatgactcatgacaaaggggtgtgggactggttggaaaagagtttccaaagctggactgcatcacatggtcatgtggaatgggctgcctgctctcccagtctgaaccctacctctgtgctatgccaaaggtgcagatccccttagtgaaaattggagacatgaatcatttaaggcaatgcctcacagacccatgtgcaaggttccatggaatgtgttaatatatcacactcatctcaattttgcacggtacatgaaactatgcttgctgatgagggaccatacacattgaacagatcatataatggttatggatgtaatgtcaataatgtcatggaacctatcatatgttgtaatatcaagaaaccttttagcatgtacatttgtctaggtttctggactttacagccttctggtatttcacttgcttgtgtctttcattgaacactaataaccagaaatcagcaacgtgaaaatttgattcttcttcctatttttctcatgccttactttggtctttctttctgcttggtggaaactgcggagttcagtggaagttttcctgcagtctaattagcccctctgtttaattttgtaataaaaacgctgaaccagaagctggagataatgtgcccaattcaattcacagatgtcaatttctttttaattgtaatccttttcttgagttcttcccactcttacttccctggcacagctgaggcttgggtgattacaaaactttcatgcctacgctggagattatgcctcctgctttaggattaaattcattcgttatcattgttgtaattattagtagtaacaatgggcatttccacccaaacctgatgaatagtagttttcacagtctttgcctccaaacttagcttatttcagttctttgcccagataagttcttcactctttaatggcagggagcattccgttttctgttgcatttaaatgctattttgagatcattcagaagacaaggctctttttcctttttagcaggttctcctgggtgtggagagatggcttctttccccagagtaggagtcaccacttagtgaatgctaatggggtcttttcttcgtgatgcgactgctgctttgaagatgcatttgaactggcaaggggcacctcttagctgcaatctcttccttagaagggtgccagctccaggccctaaaaagcacacatagctttgacttccatgctgactccaaaagaaccttttctctgcctttttgatggagtagtccctaccactaacagaacagcagtgtggcccaaccaacttgaaaatggaactggctcctcagcaacatgctaattctttcaaacttccttgtcagactcaaacctcgatgtgtcttttgttcttaaactgcatttgtagtaagatcttcaggaaaagcaatcagtgagagactgggtcaggcttttatttaattactttgcactttttttccccctctgaaccttctccaaatcaaaagaaagcaatgcagtttaattctgaatatatgaaatgtttgcactttaaattataaatgtctctcaacgataacaccttctgaaaataatgctccgtgggctctttagaagaatatttaggacagttcatctcaggtttaaggtgcccaagctactatagtgccctttcttatcttggttttatgtttttccactatggcttactgatataatttcctaatccttcttatctcaaatgtctcttagaccgttaaacctttgcctataaaatgaaggggtttgactttgaatctaaaggagtggaccatccctcaagcaccctagtctctcagcgcattcattccacaaacatttttttgggagagcagggtgattcctgctatggacccatcacccttgtagactctgaggctgcaatgaaaatacaataaaatcagtaattctagttcttatggaacatacattctgggagtgggggcagagactaccgataaataaattagcaagagaatataatatgcagggacaagtgctatcaagaaaataaacctgcgcaatgtcacacagaatgcctgatgggtgggtaggtagtttaggggaagttactctaaggaagaaacatttaacctgagattggaatgataaaacatgtcaggtctgtgaagtctgggggaagaacatttacagcagagggaacggttagtgtaaaggcctttaggctggaacatgttgagcagtgtttgaaagatgatgaatatggctgtagcagaagaaatctggtgtgaggtaagatctgagaagtggcagggactgaaacagacagggcctgtttggctgtggaaagcagtttaggttttataaaagtgcaatggcaaactattagaacgtactaagtaaaggagtgacatgatgtgacttatgttttttaaagattactctgccatgttgagaaaatattgtaaagcagcaagagaggaggcagagagacctaatacatggctattgctttaattctgatgaagtttgattgtggtttgaactagtatagcagccaggcccccactacaggcccacccagcttgatggcctcaccctgcatcttgtcctgtctctgaactgctaaatctcaaaactttaaagccctaatatcttgctgattaaccataatttccaaatcttatgcttaagtccaggcagtttttaatttttttttattttttggcttcagcaaatttttcatttgtctatatctataaagtacttctcatcatcaacccagattcctttttctctctgttgtgttcattctagatcattccaaatggtctctgttccttctgccttcaacctggtcttagaagacttctctgttttttatctctcccccattccacctccaactcttgatcagcacctatttcaaactctcaacttggtctcctttttcactttttacacacttggattttaaatgttaccttcttttagaaaacaatgctgaccagtcatgagtttctttgaattcctccatgcttatccacatcagtccttactttaggggaatcccttcgtccctttgtttgaaatcttatgctaattatctcttcactcgggtctcttcccaaggtttggacatcatttagtgttctcattttccactggtgccattaatatcatcccgtcatcatagacatatatgtgtgtgtgtgtgtgtgtgtgtgtacatatatatgtatgtatgtgtatatgtatgtgtatgtatacacgcgtgtgtatatatatgtatatatacacatatatgtgtattgtgtgtatgtgtatatatatgtgtgtgtatatatatgtgtgtatatatatatatatatacctttcccatttcaaaaacaaaatcaaaacaaaaaaggcaattatctatgaacctgatttctgtcccttctattagcacttactgtccccagatgaggacactctttcacttccccatatgctcaaatatcctgaattttatactctcactgattttactttctaaacaaggaatatatacgtattgtagaaaaaaatcactgtgaagtaaattccacccgtgatccaaccctccagagaaaatcgtgcataaaaggtcccgcagattcccacctgtctttctttccttccttatctaccaatattttttcacatgcatgcaacattctagtcataccttgttatactttcagacatgttctttctacttgagcacatacaacatacaacttgagcatgcttgtttatctataaaatgaagataatatgatcatttctgtaggagttttgagtcaaaaataaatttatgtatttcaaatgcttagaatagtgtctgttgcatagtgacctttcaataaaaattattattattattgctcttttgtccactttatctacctggaaaagtaataatccctcaagactaagttgaaatataacatccctggggagtgtattagtctgttctcacactgctaataaagacatacctgagactgggtaatttataaaggaaagaggtttaatagactcagagttccacatggctagggaggcctcacaatcatggtggaaggcaaaggggaagaaagacacgttttacatgtcagcaggcaagagtgtgtgtgcaggcgagctcccatttataaaaccatcagatctcttgagacttattcactactgtaagaacaatatgggggaaactgtccccatgattcagttatctcctccttaataatccccttgatgcatggggattattacaattccaggtgagatttgggcggggacacaaccaaaccatatcagggagttatccttctcctctgccatcctgtttcactctgccaggctccttttctcagtgcctccacaagtggtttacttgttgtgatgaacactatgcacagcagagagtttaaggaccttagtcatgtttcctaccaatcagcggttggcttcctattaaacctttctcgatgttctggacctctagagagccattctgtgctgctatgcaatctataatgactcttcaactaggtttctattcatttccaagtcttccctaccactgagatacttcaaggagatatgagtggatcatgaataaatatcctaaaactaaagacagttaagtcaattgcactctcaatattatcagactattttaactaatatgctatagacaaataattcttcagaatggtgtttgctttgtgtgtgtcataagagattcttgtctttagagaattagggaataatattaaaatgaataaatagtaaaggtgggaatatttttaatattattaaaataaataaatgattaaagtagggagcatgtttgaaggtccattttaaaaaatatatgtagacagaggaaacctaagagttaaaatactgagtgagttttgctctgcatcagtggaggctataaaatgcagtatttatctgtatatgagttctataccaatgtgatctatctctctaattagatagtcaactatttttaaagagctgcaaataagccttacaagaatgtcataaatgcattccatttagaaacatcttgcagataaattgtatttttattcttcctgcagcctcctgtagccttaaaagaataacaaaaaataaattcttactacctaattccagacacagatcattactaccagtagtatgttaatcatgcttgccattccttctccttcgatatcattatgctttaggatagaaaaggtgggtggtatgtgagcctccttggataaacaaaacgttggagtgcacaggcttctcaagaggtacaatgttattttcatgcaaaaaaatcccaagtattacaaaggggcttgaaaatgttgaaaacacattgtgaataagtagaattactaacaagagcactgtatcttttgcttcgataggctctttcaagatgtagacaaattggaggtaggccagacagaatctacgggaatgattaggggaattgaaggaatgacttcggaaaaaagattaaaagagctaaatacgtataggttggctaagtgccaactcagagaaaatgacattatgggctatagatatttgaaagtggctggctataagcaaagcaagggattacttaggtaattggattaaatcaagggggtaaacattttaaactcaatatctggatttattttgttgactataagaattattagattttagaactatcccataacctactgcttggattaaagcaagaggtagggtgtggtagcatgaagtctctaatagtttacccagttctgagcatcttgttgccaggaagcagatcttactcacttttaatccctaggatttagcacattaaaagaactccatagagagctaagtcatgtttagttcagcgagaagaaaatggtctgtggagtcagacattacagattttatatctctgctgttttattgttctataacagtcagcaagttacttaacctaagccttatccataaggtgcgtattaatatcaactttataggattgatgtgaagtttacatgagttgtcttgatctcttcttttacctatttaacagcggttaaatacacccctcctctccatcatcactgccattgtgttccttctgactttagtaatgtcttcaatggtttcctggattccaattttgcctatcttcaagtttccacaatatagtcaggaataactttttgcagcgcatgtatgagtaagcaagccctagcttaaaaactccaatggatcccattgcctgcaggataaaatcgaatatccttaggatgacaaacttcatgccatcatgcctgtctttctaattccaactcatattaccctacccttctcacataatgctctaactacattcacttgcttgagtttttcttttgtaccttgtacaaatgtataaacatgctggttcctctgctgagaacccactttccactccaatttgccatttctttgccactctttgtcttctgccttgcttcacactctttctaaaatgccaatctcagattttacctcttttgagattccaggtgcctctcccatgtgtttccacagtaaatggagcttatcattatcctgctattaattctactgtgttctaagtgtcttttcactctgcctctcctaatagatgttaggattcatttgggcagatacttagattagtgcctaccatttagtaggcattcaacatatttttagattcaaagaatgataaatggtagatggatagatggatggatgggtaggtaaaaagatatatggagtgtaacaaagtacctacaacataagaaattatcaattaatttcagttttctttccttggagttttgagattaagaaatgcacttcgttgtcccgaataagcatagtcttgagtgggctttagtcagagttatttgtgtgcatttatgtcgatactacccactccattctatcatattgggaaaataatgcaatctcgaaggaataggagtctaggaaacctaggatataagtgagcacataccggagaaaaatatgccaacatagtagcttggaggaaatacttggaaatatcttgcctttatagctagatatagaacttcattttttacaactagaagctttgtgacttctgagaccatgactgaagaaaaatggaaatgaagacaaaggggactgaaatgggagtggaagtaggaaaaggggatccatagacacaaaacaaacttttccttttacacactccatttccctctctggtgcttgcccatggcccagctatttaaccttaagacacatggccagcccccttgtctagagtttgccctaattgttgggcgcattgtagcgtcttagatgatcaattgctcatgccaaaagcagagtgttaagattcatgaaattcgagtctgtgctattaataacctgagcagggttttcatgcctccttcccctttgttttctcctttgccaagtctccattctcactcttttgtggatgtgtgtgttatggagacgaatgaaatttcagacacagcaatgaattgccacctaaaaggatacaccccagggtcttctgtgttcctttgcagctgtgtgataaattgccatctccaaaattaattgttaccttttcaggaagtgtttactcattttcatctcctcactggcatcagtgaacctctgagctagaaaaaccaactttcctttcccttctcaagcccttgatatgcagctagaacggcaatcagtggagctgacaagggcgagcagtggtacctccgtgttgttctctagcccatgaattcaatgaacatccaggctatgcctttcatctcaactgccttttaatagactaacccatttctctttacttttggctccacattaaaatgtctataaaattttactccaagctaggtcttccaggtttacggaagaaggaacatacattcagcaaaacagttttctctttttgttagatttctgctgttctcaagagctgaaaaaaagtgtgatacttcacatgtactctttaaaaaacttactaagcctgctcagcttttacacagggtacgccggcacacaagtgtgacctggtccttactccatcctcaaagataagttgtccccacagtctgccaaaaagatgtccctgatgcaatgagaatgagctggagtcctgactgtgctacatttttagtggtatcctaactctctattccacagacatcagaaaatgtcacaacatactctttgtaactagtccctttattatgtccatgaatgtaatatatacaatgattttcaaagagggtgatttttcacccctcttctctccctgccccacatacaaaggagactttgcctatgtctggaaacatttttggttgtcacaattgaaaaggaatgtatggaggtgttgctgttatccagtgagcagaggccacagatgctgctatacattttataatgcacatgaactctggaatatataaatcaagtaaatctcagtattctgccatgtactctgggagatacttaaaattataagccatgacttctattttccaagcattttggagaaaaacaaccaattttgtttttgatttctgactatatggtagagttcagctacacagtatatggtactttaacaaagctatacggtagctgcaagacaacaccatggctgggcccttcagagcctcataagtgtattggggacactgagaatctagtaatagactaacacatatgtaccaccattgagtggcatcaaacatgctttcatttagtgctgaaattgatgatataatggaggctagaaagatctaataatgaaaaaaagaggaatttaaccagtcttgaggtgatcaaatgaggaagcagaaaggtaggattgattgtaatgtgtgcacagaggagtgaagcctgattacctgtactactcattgccagaccttcaagaatcgcgtgccaagtgccaggtgcagaagttgcaaaactgtttgggagatcaaagagaaaatatcaacctggctttcaagtcttttcagggtgctttcttagaaaaactgtttttggtcttgaaacatgggcaaacattggctgcgggccaagaaatttatagttcctgaggaactttagattgatacatgtctgacaatttccattttgcaaaacaagagaaggcaaaagtgggcttggaaggcattcaatctttgatgttgtctttgcttcagctgagcagaagtgagaatttagacacactgagccattaccagagtttaagaaaacttaccatcagtgtggtttccccctttctctcagtcaagcacatgggtgtgtgtcattgtaaaaggactataggattggaagtggacacgtgaattccatttcttactctccactaactacctgagtgacattaggcaaacttgcaaatgtggaagttgggccgggctaggttatgttccgctctaaccttaaacactgatttccccattgactttcttgttccattcaaagagattaggaggaaaaaaaagtggtatatcccaggcacgttttgtgatatttcagtgaaatattgaaataagcaatgtcagcagcctcatgttctcgctaatggtctggtatactttatgaataaacaacactagctttatattactggatctcatttccagcagatttataaaattgtaactctacagtgttttctgacagagcttctggaaggggaaaaatgacagtgcagttgtttgctaacatctgggtgtactttttgcaacatggggagaattgttccaaggcagggagctaatctgattcatatctctacctagaagcacttaaagaagctgtcagatgattcccacagtgacaaatttgagtcccaaggagatgatggagtgaaatcagacacattttgggaagaaattcctactatcttttcaaaggataaactcccacagtatttgtgccaatctcttttacagcattcctatctcaaaaaccagagacttaggctaattttttttgtttctgttattctctaatatatttgtttaaaaaggaagttttaatgaaaagtcagtcatgtgacttagagaattaaatgtagggctctagcaaggatttgctttaaaatgtttctctccgatttagttgctgcacctgggtaataactaccttggaagtattagtgttgtttctctgtcataaaattgacatgcttggtgtggataagaatatttgattgtagaactgcttctacctaactgcattctgttatactaacaatttggctagcagaatttttttttaaaatcctccatttgcagctttttgtactctgatcacaatatattaaatcccccagaagaactactaccttgaatacaaagcacatagcggtgctcttttaattgatttgtaaaggttagttgctcagtactagtggaaagtttcatgattacttaattgaattacctgcttcccccagtagagtgcttactgggcaccatacagtaagctgagagttttacatgcctggtactattatttccccagtttacagattaggaaagcaagatgtagcttacaaaatatgctgaaagaccactggcataaaagccttttaattccttgctgaaaaactccctgggttttgaaatatgataaactacatttttgttgttctctgaagattcaggttcatatagtatgacagttttatttttgtgactctcaatcatatatgagataaatgatgggggaaagagaccgctttgaggtcaagcagacctatgtccaattctaacatcaaggagaagccacgtgctttggcaaagtttgtgtatttacactgttgggaaaactaaaagtaatttatataaagtacctagcatagtatctggcagggtaggtgttcagtaaatgttgctggtattatttttgctagtgataacattattcagccatataaacacatagcactaaggttaagcaaaatatgtattgacattacagcatgcctaggtatttattgcctaaaatatatttccgataagcttttcttagcatttgctgctttctactaagagttgagtgaaactacgatgaccacaatttagtctacttatttaaacctttaattggttggcttccggtaaattgcagtttgaatgactagcccaatcatgtatgagtagccgggaatattcgataggtatagaattcttcctgcctaatcaagtcagggataccgatgttaatttctgaaataaatactttctcctctcaagatctacccagtggttcgttgccccttgggatcacttctacttttcaacaaagagcaagggacagtaattgcaacttcagggtagaaggagagtttgcatgcctggcccagaatgaaataaatgtggaggaacagagcccaaatgacttgtatgtttcaggtacagctccatgtatgctgcagatgatttgggttaaaaaaaaaaattggccagcctaaactttgaggcaaagaaattgcatttcccaatgtctcatttctctttccttttactttacttcatctactgtgaatgacccttatttttttgttgttgctttatggcaataaataaacgaacccccattgtgcaaatattatgctcttctcattggcctggagggaaattgctacgagagaaatcctggacttttttcccctttttagaaggaaataccaggttacgaatggcccttctcagtctctagattgagactaggattcttctgtcacctcctcagagccctggatgcagaaagcaattcatttcacatgtgtgcaaatcagacacagaaattctgcaaggcacctcttggcagtaaaagtggactattaactctcaaattgctggcctctactgagaggcaacttctccctgaagccaggtgggagtgtccctttgaagccttacacaacccgacttctgttgctagggtagagtactttagagcaagagtagtcctgcggtatgttaactgagtaggtgtttcccagaaaattaaaagcaaaagtaactacctggaacagtctgatttttaaagcaaagcaggatctttgtacgtttaaaatttagtccagctacttgatagcctatagagcccccaactccttcttccagcccagggagagtctgcagtgagcaaggtaagaggtagctccagcattttcagcatggggttaggttggaagtcccagttgacagggacagtccttcctgctctcacctgccaaaatctctctcctcccaggagatagctcccttttctccctgattgcttcctctcatgaggagaaggtcattggcgctcaccacttccagggcaaccctttatgcaagcagtgggtgcctttgaaaggcaaaccgcagcaggaagactttgaaggcaagaagagactttttcatctttgcaggccccagccagaacattggttctcagtgcagtacaagcagtttcaaagttatctcccttgctgatatggatgtgataacatggagcggagaggtgccataatgatttcctttcaaatggctgcctcaccatttatctttgcacactgtcaaagactgatattgtcgggagttagcagtggcatggaataattaatctcgtacgggggaagtaagttcttcatttgtctcctgagaaattagcactgcattgacagcaaaagtagatgatatcatcggaaagggaaagggaggtgatctttgtaactccagatgccaaattgtaacattgattcagttctgtgaagttttgattgaacacctactatgtgccaggtgctagagatacagatacagattcctgtgctacagtagatcataatcccttgagggtcacagcttatttcaaaatccttgtcaccttgacaaaatgctcaagaccaccatggtgacatgtgtgccaccatcattattattatctaaagagttttaccaagtgtctgtatcattaatatttattgtaaaggctcaacttttataagaaagaatccttgtctcccacaccaccagtgcaaagtagattaacaaagttggcatttatttattttattttttctttaggggaaaatcaagaagttagtgatctagggctaatggggatattgtgttactcccaatatgtggttcccatatttggattcaagtttttcctattttccaatcagtgggaggagaaaaagaaaagcatgcctgcttatatcctattaaggccacacctgtctgcaaaacaggtgggatccatgtgaaccagaagcaagctattaaggatgcaagaaaatgtagtgactagttggatggccatataccttgcttaaaaccagttagggtcttttatttctgaaagaaagaagggaaactagatatttggggatgataagcaatctccccacagagattctgggtgaaatcctttttgcttctctgaatttccaataactcacctcttaaatgagagaattgaaggaggtgtgctgtgtagtccttttcaatttcaaagtcaaaataacaactctaggctcctcctccttcctcagcttctcccaggcagtaggcacagtgatgggctctgtgctgggaattttgttttgagcctgtttcttttatttggaaacatcaggtgctgaacctatcctggattcgagtgagtgcagggcatggctctaagaagcattttgtggaaagagtcaagcttgtcatcctcctcctttgaggcactaattgggctgactgggccaagcaaaacaatggtatgatccatgtgaaccaaaagcaaattattaggcttggagagtggtgggtagtcagagaagcacttctgttgtagacagaaaaacagcatcatgcttctcagaaagaaagggggctgctatctgggtggaaagcttagaatcaagggagaattatacatgtttttaatggaccgaggaagaagccagatttgtgtatgcggagtttgatagggaagggcttctcttctttttcctactaaaggaatagtgtttttgacaaggtgccaaaaatctaggccacagcatcccactttgtgccacagcatcccactttggtgagccataccaggttgcaggaaattaattgctttagactttgggctggctgagtggggcctgaagccaccgtagtccctgggcaagccccctcccactacacaggcctcctccatctccctcattttctctgtgtgctgtgatttggaaaaaattgacaagcacttgatagaggctaccaaccaattagaattggttcacacgagacacttgggaatgaactcagctggtcactatggtgatttaactaaattgtgttatccagacacattagtgaatcaagtctggcatttcaattttctctataagatgaattgtggaaagaagttcattataataattaaggaagatttatgcagtgagtacatttttatctctgtagcctgttataatgctggtattttgtgaccaaaaaaattgagttgtagatattaactatgtaattccacaaactgtgctcccgaacgagttatttatatagttagaatttaataaatggaaactttttgaatgcacctgcttaggaaaatattgaaagaaaacttactgtaagtttttcagcacagtgaacaatcatcccccagtgaacaaaatgctagccttaacccggtcagtaaattatttggccataggcagatatctcatctccctgtaaaggaaagccagtttcctccactgtaaaatgagtcttagtaggaaagggggcattagcaaagtaatccctgtgcctacccaatcgttctaatgtgatgtttcctttggaaaaaacctacaactcagaaatatattgaatgaaaatctccctattacaggaagacactgcgggttgctaaggagtgtggtttctgtggttggagtagagaaaaatagtggtgttttctgagatctcaactcaactgtgcagggtagatcgaatgaacacagcacaagccacagccactgttctgcttctgcctgatttgcttctccagaaatttcccagattacaacaatgccgaagtgcccattggctaccacggagataacttcataaattgttaaacaggcagagctcaggtttaaagaactgcctttattttgagctgtgattttacttgtgtttcagacattccctcagatattttatttaaaagatttcacaggagcatcatgcaaaatggtaaataataaaacattctataaaccacacatcccatctaggactaatcattatattttccaatttaacattcattccttccagatatgttcttactcgttctttaaaactatcataaatggaaagctaccatttaagcacaaataaaactcttaagaaagctaagaaaatctgaactcattaaatatttctaactagtgaactccttggttctccaaatgacctattttttcccttccttcttttttttttttttgtatttttagtagaaacagggtttcaacatgttagccagcctggtcttgaacacctgacctcgtgatccacctgcctcagcctctcaaagtgctgggattacaggcgtgagccactgagcccaccctccttccttccttttttaaattagaattttttattttttatttttttttttaattttttttttggttgcttttagccacctcagttaccttgaccatccgatttcacttactgtagccagatttctaaagtatgtgtttctgtggcttttccatagtttttttccccaatattttggcagtggttgaatagaatccttttattcctccctccctcacccctcccaatcagctccacctatagatatagaaatacaaagtgaacaaatgtgccatgcaacttctatttttgtgcccgttcttcctctttgtctctatttttgcctctagcacatagtatcctggtaaactggatttttttttaagagacatggagaacacagtgcagtgctcattctctctcagcctctctgtttttactgtaatgaatctattctacataccatgttctcaggatcccactgtatgtctgataaactaagtcaagctaaggtcattattaccaataagtaatcaataaactcaatgtttaccctaagtttgatacggtaacttagttattttaagaggaaattttaagttcttgtgtgtgtgagtaagaaggagcatgagaatagggaaagggccgtttcacagaagcggtcctatctggttggcctcaattgtgcctctcaggcttgtatctcatctgcttagctgtaaggccagtcctgttaggcaagaaaaaatttaatttgcaacctagtttatgaaaggataaattaagggaccttgtgggaatttaaatcatctaaggtaatagaacatgaaacttgcctagattaaaaactgggtcttttgtgaggtttcattcattatggccccataataatagctacatgtctatgcacttttgagcttgggtctgtttaaaatacttatttgttatttcacttaattcccacaataactgtacaaatatggttctcttgcctccatcttatatatgagaaaaattaggaacaaaaaaacttaagaaatttctttcactttctatagctgataaactttggagatcagtttgaacccatatactcttaaacactatttatacagtattaatgtgatttgacaaaagtggcataaagagcaatgactctttaagactcaaaagaagatgttcagatttatattttgatattaatattaatatcagcaagataagctgttaaataagcattacatgtaagaatcctgaccttggataaaattaaatctttgtcataaatctactactgtgacaaaactgcaaaatatgcagtgaataattaaatccagatgtctcttccggcaacagcagcagcaaaaactggaggtgggggtgaagggaagatggaagtgacagactccatattcataaaagctctgatgataaatttttttaaaaaaatgtgtttgttttaaataccagtcttccatgaatcctaagaattgcacagtaaaaaataaaatctgcctaccatttaacagcccgcaatacaaaaatcttactgtgtcaaatgtaatatgcatacctggcttcccaatttggttttcttaaggaggagtaatttagttgtcattaaactctttgggaaaccgttttaataatgttctttggttatcaggggtatcctttttttccttaaggcaaagaagagaaaacgtgccgctaaaacctttactgtgtgtggtaatgaagttggtccatttctgtgcaggattgcaacaattctttatcacttaacacgatcggaggtgtgagagcagacagtttctcaaactgcaggaaaatgctgaattcaccgattgctatcttgacacaatgaagggaccatacattatatgaagcccacatttggtttgctgttgttgttttttttttttttataactgtgattattttttgatggaataataatcacagaaaaaagaaaaacctgtaagagaagacaccactgtatcatctttttatggcaatatgcaagagggtagaaaaaatgagagtgtctaaatttatcttattttcctgtgggattttcagcacagacatattcctaccactacaaggaccaaggacattcacttgcctgcttgctctgataatggccagtagctggtcccaatgttgatacaattaattaaaatgataaacatgactctagctagcttcagcacagtaagagtaccacagcattttctggatcatttattcaagattcactgacttggagtcactgatggtaccaatcattttatgaaataccttccactagagacagaaaaacgttgttttgacaaattcatggtctgcacctcccccaaaccagtgcatttctaaacagacttgtttttcctctaaatagctttgccaatccggccaacaccccaatatttctttatattttgaaaagtaggtctttcacctgctgataatggaggatccaattctgtgtaaactctggaattctatttaaaattgcagattttaaatgtagggaccaagacaggatgtaggttgtgtcaacttgggaatgctgaatgactgaactgtcatgacatttacaatccagatgtcatggcaagctgggagacaagacagcttggttgataattagatggcagatgtccatgcagtctcacgtgatacacgttactttttgtatattcaagatttgggactttagccctgaaagataggtgatacatcatcttctctatacaataaaaaatagtttcaataattgtatattattttgttttgctttttttctcatttatttggaagtagcaaatacaagaaacaaaaattactcataacccctatttttggtgtatctctatgcaggcaaatatactgatgatgattattttcattttttgaaaatttagattctcacactcaattaaaaaaagaaagcctgaggaaattaaatgatttctaaaatcacccagctaattagtggcagaaatgagaccagattccagtctcttgctttcccgaataccttattctggaattcaattataagtacaaggcatcccactcttggcttcctttctgaataaatgcttgcaccaaatccccagtggcttcttgagaaagctggctacaaatcttcaaagcctcagttgaagaattcttattaagcctactaggtaccaaagcaatagcctgaagtttggaaaaattctagttggtgaagctagaattttattcaatttaaagaatacttggtaggggggaatgtaatgaattcactccctagcctttcttgaactctacctatttaacaccctatttctaatacagcagcttctcactatagaatgttaggtttatcaaatctctcttccaccctgttatacggcattttccatcccttggatgtttcaagtccaggaccttgggcttaaaggcaaaagtaaaatctattacacatttgtagctttgtacaccaatcagggaaaagtagtaaagtgggctattatgtacattattttacaatgcagtatgttagttgtcaattgttacgcaagactaattttttccacagcaaaaaataaagctattttaaaatattttggaagcaagtcatggttgaagagaagcatcccttgaaaaattagacttaaagctgcaaacttcccggggttgacattagcttgaacttgatgaaaaaggaaaaattttaggaggatttgttcagctgtcttctgagttatgaaagcaggaagaaatgagttttacatattgcctggaggtaatttgtgtacatataagtcaaaaacaattaaacttcaaacttcacacacagccactgtcctgtaaagggtggtagtgtataagcagaagaaaaatgactagaagagaacagggttataaagcatccagacatttcccatgtgaggatcttgaaaaacttctgcagccctgtgactggattctttctcctgatctaatagggctgtttggaggaagtatttctactgctcttgagttgttgctagttttcctttgaatatcctgctcagttccctgccccagttcaagcttccttccaaaatgtgtttaaaataattagctcttcctgttggtataggaaaaaattagtcacacataattggtaattcacatattgtattataaaataatgtacaaaattaccacccttacttctttttggagggcctgtggcttgtaccaatggatttatcttgttccagggcattgagaaattttgccttactgatggcatcaccacttacatttctcaacatctttgcctcccatcagaccaggatttcagttactaggtatcctaccttgttccattgatctgagaccctcattaataccctagctgacagtcttaactcagcactgtcttctattttctaccaaatagaatacaataatcagatacattttactctctcttctgaataaagatattaacaaaatttccatgagtacttataagggtgagtttccagaccaacctagatgagttaccaggatatatagtttgaaatattaactttaaacatttcttgatttttctgaccccatcaggtattttttggaaactggtattaggcttgtagaaatggacaaggagctctaccatgcttgaagatggtttaagccttcagcaaaataattgagagcttcctcttctgaatattccgaatacacaggtctatcagttagtgtatcatgttatgtgtagatgtgtgttggggtgatcagatccaacaccaggtcgtgggggtgacaaaggccggcaattcaaaggaatgagaaaaagacagtttgagagagaaagtgggaccagggggccatcgcgagtgtggaggctgtgaaggccccaagttctgggagcccatgttatttatgggtgctcaaacaggtggtgaggatgtcgagtgaatgagaaacatatggctgtttgacataatgggagtactagaagcaagaagccagcaagtctagcagacatgcaagccctgcctcagcttctctcccaacactcagcttttctccaacagatgtgtatgaataaggcttattaataacaaagcctggctccacaggtgagagggaagatgtaacttaatctactggaagtcaccaacatagccctctaaaatgagtcattattttgactcaaaaatgaacagattaaaaaatgtttcagctaatcctcttagctatttgatgtacatcaagcatccagatgttcacaacatccaagctgcaattttttgtgtgttatttaaaagttttacacttgcatatattattcctttcctcaaagacaaagtatagaacccaaactggactttttaaattcactccttaaaagtgtggtaacttaccattccagagctggtgggtccccgattattggcccatgggttgtccactttgtggttttgctgttaggaaatgttggctgatggcttccttaaccactcagcagttaaccaacaataacttggaatgtgtctaataagtgcagcctaatcttaattttattgggagttatctcagctaaataatggaaaatttgacaaacctaattaatgaattatccactgttaaatcttctgtgccactgagtcctctttttagtaaaatgattaaaaacattaactatagtggtatataattactattaacaactattatgccaatatatattgttattcctgcctaagatactatgtctcagcacggagtttatattaggtattttattttaacagttttctaattgctgccactttttcgtcagattgcatattttgacccacaacattgatttcaccttaatgtcaccagtgggaattaattatctgaagcttggcataatattaattaaatccatatgtcacatcatggtgtggcattcttttctttctttcttttttttttttaagtcagggtctccctatattgccatgctggtctcaaactcctgagctcaagcagtcctccctggttggcctctcaaagtgctgggattacaggtgtgagccaccatgcccagcccattgtgcagtgttcttacaaaagtattctaacaatccaaaatcaagactacttccaaaagtggcaggcttcatatagaatccaacattctgttgcaatgagattgggatgagtgggtttagaccaacattgatatcaaaggccagtttccctttaaatcaaaatcacctgtaaactagcatcttgacattcaagatcccaccagggggatctagctgggaatgtcaccatgcatgtcttgagagagtgcattagcccacctgcagtaggttgaaaaatatcttccaaggataatttcttaagctgtatattttaccttatttagaaaaagggtctttgtgagtgtgattaagttaaggaccttgagatgaggaaataatcctggattatctgagtgggccctaaatatcctcaaaagtgtccttataagagtgaggcagagggggcatttcccccgccacacacacacacacacacacacacacacacacacacacagaggagaaggtgatggaggcagatactggagtgaagcagccacaagccaaggaatgctgacagctgccagaacagtcaagaaacagattctcttttagggtcttcagagagaatgtggccctgctgatgtcttggtttcagctcaatgatactaatttcaaatttctggcctccagaactatgagaaaataaatgtgtttttgttttgttttgtttttttgagacagagtttcactcttgtcacccaggctggagtgcagtggtgcgatcttggctcactgcaacctccgcctcccgtcttcaagtgtttctcctgcctcagcctcccaagtagctgggattacaggtgctcaccaccacgcccagctaatttttgtatttttaatagagacagggtttcaccatgttggtcaggctgatctagaactcctgaccccaagtgatccatctgcctcggcctccccaagtgctgggattacagacatgagccactgcgcccagccaaatgtgttcattttaagtcactcactttgtgccaatttgttatagcagccacaggaaactaatacaatacttgtgccaacttaagtaacagcaccagccaaagtacataaagtggaaataaaggtatttttagaaagtctcattactataaaatatggtgtaaataaaaacagatctgaatatgcaaattgaagtttcaaaataagtctcctgccatcccatttcaaagacactggaaatcttaagctcttttctttacaaattctgaaactatcattgcctgtgggttgggttgaaatgaaggcacgtgggtgtttcaagggtatgttctgtgacaaagagacagaatagaaaaatccaaagtcatagcctggagctaatacagtaatatgaatacataaaacaggaaggacaagaatataaaagtgaatttggggacctgagaaagtcaagaaaatgattggagaaatacaatttgggagaccactttagaacccagccctcactgggcatggtggctcacgcctgtaatctcagcattttgggaggctgaggcaggtggatcacctgaggtcaggagtttgagaccagcctggccaacatggtgaaacccgtctctactaaaagtacaaaaattagccaggcatggtggtgggcatctgtaacgccagctactcaggaggctgaggcaggagaatcactggaacccaggaggcggaggttgcagtgagctgagatcatgccactgcactgcactgcagcctgggtgacagaacgagactctgcctcaaaaaaaaaaaaaaaaaaaaaaaaaaaaagaacccaggcctccaatggtgcgatcaggtgccaggtactcttgtctactgtgctgaccatatgctgttgaggtcatcaccagctacgggaaagggcattctcataggggcaagcccaactctatgtatcttacgttatttaccactatttcccaaataaacctgtttcaaagaataccatctttaatgtctttcacaggtacctatcctccactctgcatccttttccatgctatcacttgcagtgaaggtctgttcaccccttttttaacctgtcttccatcttgagttccaatttccagctgccctctgaatatgtccagaggatgctggctgctgcctcagactcactggatgaaacagtttcctgttttctttactaaaactgccaaccttccttttccttgtttgagttagtgtatcactgtcctctagcccctgagctgaaaccttggaatcatctttcactcctccctccccctttatattcagtcaactgacagtaccaatatttcttctcttctccttttatttcttttgccactgtcctactttgggcactaatctctcttctgaagtataacaatagcctcccaactggccactctgctttagctgctccatggtccaatctcccttgtcacatgtgttatctttcccaaacactgtcacaacttgtcagtctactgcaaaactttccgtgactcctggggggcctgcaggagagagtttcagatttctgagtctgccttcctggctcttcacaatgcagcctgagtccatcttttcaaccgtctctctggatacataccaacacttgccctttgtctcaatgaatgtgcctgccacttttgtatctccttacctttactcatattgtggtttaactatgtggttgtcttctccaccctgacaatagatacatctattgtccatcagcccaatttacaacttttgcatctcttctgatttctatcctctgctaatgacacttattaactactgcctttccactggactttgcatttagttttttatatatatatatatatatatatatatatatatatatatatatatatatatatataaccttacttctgcttttaaacatagatcattatttccatgtctaccttccactttctccaacactagattgcaaatttctacagggtgaagcttatgttttcatcccttaacacccagcttaaatgtcacctcacatactgactaatgctttttatctcagttctaaaacattattaatgtacatcacataatttaactccattttgaaaattagttcttgttccagtatcttatctcttaaaatagactggaaccatctcaaggttagagaggatccactatattaaattcttatatatccctcagtagatggcactttgttggatgatttaattgacgtatcttcttaaaaaataaaaatatctggctcttcaaataattagctttgtgacctgaggcaaatcatttatcctctaggacatttagtttactacatggtgaaataaatgataccttcattccttaaatatatagatccagtgacatgttgctttgaatcacagaatttggtttcgtgctaaatctaagaccaaaaacagagcacaaacaattcagaatcaacagcatgctttctggaagcaatatgaaaggtgttattaatagaattcagcattattctaatttcctcttaaaatttcaagaaatatatctgacatttgtcctgtcattgtaagttgaaatatgtgtgtgtgtgtgtgtgtgtgcatgtatatataattttttgttgttgtttttgagacagtcttgctctgtcacccaggctggagtgcagtggcatgatcttggcttactgcaacctccgtcccccaggttcaagtgactctcatgcctcagcttcccgagtagctgggattacaggtgtgcatcaccacactcagctaagtttttgtatttttagtagagatggggttttgctatgttggccaggctggtctcaaactcctggcctcaagtgatctgcccacctcagcctcccacagtgctggtattacaggtgtgagccaccatacctggccaaaatgtgtatacattacacacacacacacacacacacacacacagagtatgtatacgtatatatctgtatataggtaagtgtgcttatatgtatatacacagacatatacacacacaacatatacatatagatttgttgtctagatattataagagtattgcactaatgtttctataaaacaccagttcacaggcttctgtcttctaacaatatccttatacatatttgtcagccactatttaccttaaaatgaaacagaggggagcctgatatataattacggtcactgtgctttgttctattttgtttatccctttgcaatatagtgtggcagacagaaaaatgtatgaaattaattcttttggtttagaatgacattcctatcattgttagaacaagggattacattatacactacctctaaactcaaattttctgagcactttaactattaaatagcaataacagaaagcattgtaaatcttttggagttttgcatgataatgtacctcttgttaattgaattgagagatgattgccctatgattacctcgattcatttgctgcataatttaccataatgataattaactccttgtactgaatgaggtaagatgtgtgttagttagacaccccctccctcccttcttgcctttccttctttccctccctattttagtgtttaaccattttacacacaatttgagacttgtttcagaatctctccacctatattatcatgtcaatccaagtatttctaaataaaagtagaagttgggccatgtttttaaaatttctagctaattgcctgctacttggcttattgttgtgatctaattatgttctggtttttgaaaaaaggactattgcctggcccactgtatgacatttgatttatgtagtctcacctctccctaaatagcccatagttcacaatgcagcagagcctatattaccgcaatttcttctgcactgaaattagacaattatgaagttagtagattattaaactaacgtatgctttataaatacttcttcattctaggataagggagaaggaagtatactgtaattcccaatatgtaaatgccctcacacatttgatagttgatggttccattttttagatgaaaaaactaaagcacaaagaagataaacaatattttgttctgccctataataaaataagcaggcaaatatttatggatatgattctgggttgcctcaaaactttcagggtcagggtaggcaggcagttggagatatgagataatgttagccatgaattgtggctatttttgtggcacctgggtgatgagtccacggaggttcatcacatgattttatttacttttgtatgtttcatattttctataataaaggtattttaaaggaatatatttaggtatccacagtgtgtgacacctgtcaaggagcacatgctagaggcctggctctgccagtgacataggctacgtgactgtcggtgggtcacaacttcctagacttcatttttccctcattaaaatcaaagtattagaagagatcagtggttcccaaggaggtggagttgcttagggaactgtctaaaatttcactgacaactcagaaatctatttggatttagaagctggaggggaatgtatatttcaaaataacttctcaagtgactgtactgtgaccattccttacacacaaacttgggctaacaatgagaatgacttaaccccccaccccacaacactttaataggtttaggatgggttctgagaaataaagatttttaaaacattccccaagtgattctaataggtggtcgacatgccatactttgagaaacacttttttagctcatctcagggtcccttccaactctgacacctcatgatattacttgagcattcttggttctctgcttctatgatgtactattccatgagcaactggagatttagttacaggtgtatacaagtgtacaggagtcaagaaaatgatgctaagtttcttgcactgactgaggaagcaaggtagaagcagactctggcttaattggaattcatgtttgaggcctctgggccctcactaggaaaaatattcaatttatatgtaagcatatgtataatacacatatctcaccagcattctttttgggaaaagagaatttccaaattaaatttaacctatcaattttatactgactaagatgaacacattattttaatatattgtttcctcttgcttcctaatacttacattgtatagagtttcattctttatgctaatcctaatgcatagattggtaaattgagattaatgagattcttcctttactaccacctgtttttaaccaaatgcctacatgctgcatgagcaggaaatgaggtgactactgttgttggccacagagcttcaatatgtcgtgaacaagggttagatgtgaatgtcagaaaaaatgttatgatcaatttctgcctccaacaaggaactacaaatatgggtcacaaaagttctactagtagccccaaatacattttttgaaaggagacaatataaataaagctgaaaagcagtcacaacgctttaatgtgtcattctcttcttcacctttctatccacttagatgtttcctaccccccaaaaatgaacttatgtcacatcacacttgtgactcccactgacatctaaagtagtgtgagccacacagatagaagcacaggtaaatgcctcaaaacctagttattatatttgaaggaatttctgattcagtagtgtttctgtaattgttactaacatcaacgcttcgcttgcttctaggaagacaggatggtaaattcctaacaatggaattgcaaagttcacagtgtgctttaaggagtccctttctccataaacacagctcttgtgatggctttgcagattttgtttctgcatttagtgtagataagttgaacaatcctaattcctgagttctaactagtgatagagcacattatattgttaagaataatggatgttggagaaagtcaggacaaaagtaggtatgaggtgtccctggtatgtggccaataggaaccacggtcctgaagtatccggagcagtccggacatcctcaagtagacccaaatcagccctatcaggagccaacagaaaagcttgctagggcaaggtcagaagataaatttattagccaggaccagtttaagtcaaaagttgaatataagtcatatctttagaaaaaaaaaaaaaaagcaggtagaaaggcacattgtttttagctaactctacaaaaagttcagagcgaaaagaaaaacagtgatgcagaactaggggagaaattaaggagcaaacattccaaaaatagaatgagttgtacacttggttaatttcattgctcagtgatgcctccatagaccagattcttctctctgccatcctcagaaataggctctagggatgctcttagataggctattctgtatgcaagaccttctgtagctgttctagatgccagatcctgaaatgacaacattcagtgaacaataatagctcttcttctacgtcatttccttagatgtgaagaaaccatttccagcaaactcccctcatgtccacaacacctcattaatcaggattaaatcatatgttcatttctaaaccaataagagaaaaagaagtatcgtggctatattatactgaaatgcaattgattttggagagttaaaaacaaatccaaaccagcagcagagcctggggagaatccacgtctccttctcaatccacaagacatgatgggtctgctgcagtgtggtactaaatttggggttacaagaaatttttggcttattagtttcctagggcttctgtaattaagtaccacacactgagtgccttaaaacaactgaaatgtattatctcatagttacaaagtctagaagtctcaaaacaaggtgtcagcagagccatgctcccccctgcaatctgcaggggaataatttcctcttcctagtgtctggtggtttgcccagcaatctttggccttttttggcttgtagttgcttaactccaacctctttcttcctcatcacatggtgttctccctgtgtgcccctttcttcatatggctatcttcttgtaagacactagttatattggcttagggtctcactcaactccagtatgatctcatctaacttaacaaattacatctgcaaccttcctatattcaaataacttcacattctgaggtagcggggattagaacttcaacatatgtatttttgggtggaacaaaattcaagccataacaggcttctatagacctctctagttttactcagtctagatcccaatccatggagtttgaccaaatgagttagggtgctattccctaaacttgctgaaacataataattgctagaggcccttagtaaaatacagattcctggccctcacaacagatgtactgaatcagtctctctaggggacatgcctagaaatctgctttttgacaactgcccagttcaattttatgatgaagcaagtttggaaagcatagagtcagggtgctgagcactttttgagcatctttgagcactttttgaccatgttattcctggctgtgaaagaattctttttgtatgaaatctcatctacccataacaagtcttggaagctgctcttgtcatcctcatcacagacctgcagaaatggaggttaggtaagagtggggctggaaatggagctaggtccaatctcaaaatacatactttttcaatcatactaactcatcatgttagtagtaagttaaagaatcttgaatcatatggtccactgtagtttacttttcttgccttattcccaggagttttgtttttatttgttcttgtccttggagggaacaaaagacagctggtagctgttccctgtttggttttgcatgtattcaaaaggcatcatcttctactgctctcttactcctttactttgtggtcatttgttttgcagctatttagacagttacttcttaaagaacccctaaaactatttagacagttacttcttaaagaacccctaaaactatttagacagttacttcttaaagaactcctaaaactaccatttgttcctctagaaaggattaaagatttgctgaagcaaagttctcctgacactttacctagagcaaggctgaaacaaaagctacctacacctgtattttccttctcttatccctcaagtacacaatagggcatttggctctcagcagttgatgccaagttctgctagggaagaaatgagacttcagagctccctacaagttgaaatggagtcagaaaagctacatatataaatgtcagaaaagctacatatataagctacatacataagctacttataaagtttctgcaaaactacctcaaagggcaggtagttttgcagaaactggagggacactgttttctggagcactctgccactaggattttacttttagtgtaatgaaggatcactgaagacttttaaaccagacggtgacatgataaaatttcatttcagaaatttcatttctgaaaattatgatggctgttggaaaaaagtagattggaagaagcaagaaaatgctaggttacttcacaacttctccaggaaaatagtgcagtgggagaaccctgaactcaggaaatatggcccatttcctgcactatgtttcccaattcaaaatatcctattgtggaattctacagctcaagtcaagagccccttctgaactacaaaggacaaggactgatctactaaagccgtgtagtaaatgtgaggaatttgcctaactcagccaattgatgtgtcaaaatctaaccaatgtgtctaataatctaacatatattgttattgatttcaggttttaagaaccagttttctaaaaatgaaaaacaaaatcaaagcactctagaggaagtaatcatatgtttaatgtcataagtcactgattgtatacttaatagtaaatggtggatatgaacttgggccctggagtcaaacttaggtggctcggtcatgcccttgatgtgtgtctttgggtgggctactgaaactctgtcttagtttcatctataaaatagaatgctaacatcgactttatagggttattgtgaactctaaataagacaacaaatggaaacccaacacatgttctcactcaaaagtgggagctgaacacgtagacatggggaggggaataacacacattggggcctgtcggggagggggagggagagcatcaggataaacagctaatgcatgtggggcttaatacctaggtgatgggttgatagctgcaacaaatcaccatggcacttgtttacctacgtaacaaaccttcacgtcctgcacatgtagcctggaacttaaaattaaattaagtcaaaaaaagctaaaagcaagctttatgccaaaaaaaattttaaaaacttaaaaaaaagcgcctcttaaagttataagggagggtacacagtaagcacttagtgagtgagtgttgtggttgctgtttttcttaataaacatatttttatccaaattattaagcagaaatattggactggaaaagggtaaagtgtggattattaacggttgacattggaagagcaaagagatagagatgttccatgtggttcctttgccaagccatccagatactcacctccatccttttggtcatttcccctaatacacagtatatttatgatccccttctgacaaccccttgaagagttgcttgcctcctgcacagtgctgagttatggacgatgcatttgaagccatatattcactctgtcttccccacatgtgcctagtaactatggcagagctcaataaagaagaggccagtggcgggtttactcatttttaaaaaaatttccttgttgttcttttctgtgattgtaatggctagcactggtactctttccctctctctccccttcttttgccatagagctattgtcaaatgtacaaatacatagtgaattgcgatggtttctgggactgacagagagaaggaacctgttttccccataaatgctgtagaatgaagggtttgcaaacattgtgattgtggcagattaaaaaaaaaaagtcaagcaggctaaattgaaagggaggcatgagaaaagctggtgcaacctgtcagctcctggtccgaaagaagctgatggtattttttttaatattgtgaagagaaggaaaattttttatagtaagtctatggatctgctttaggaggcttttctcttgatctaattgagctgtttgaagtgtgcttgaaagttctcacccagcctgtgtcagccacctgcctgctacaagctgtgagaagttaatcgtcttgggcattgttaggaggagactgtctggtatctgatggctttccattctgaacaagggtgtacggatatggaaaatgtgtgtgctcacatttgtctttggggtgtggggctgcttcactatgcatgagagcacatccacacctccatccagatggtgcctgctcatagtggcagtgctagataaattcatgtcaaacaggcagataatccaaaaaagcaactgtaagtatccacattgctgttttctgcttccaagcttcagtgttgtttttttttttgtagtgacagggtattactatgttgcccaggcttgtctcaaactcctgggttcaagtgatcctccagccttggcctcccaaaaatctgggattataggagtgagccaccgtgcagtgcctggttttttaacatgctattcccttgcctgaaacaaccttgccatttgccatcaacactggcttcatcttccaatctctttgcctgttgcctcacattggatgtcaccaatctgggaagcctttgtcacccctcaccacattgaggtgaggggtacctcatattctctccctgttccttgatttcccattcaaagcacttaatgcaccaaacatttttttttattgcatgtctgaatacattccttagtagttcaacattctttgaggttatatcatgttcatcacagaatttaaagcaatctcctgtgtatagcagattgacaataaattagctatgaaaacaaatgaataactatggtttgggaagaaagacattgtctgagcacacagaattctaactcatgacttgtgcactgtcaagaatcacttgctttcagataattttgatgagtctgattttacgcttttcagtttgtatgtctcatgatttgtccttaatagactgaagaagtcctagcccttataattgaccagtgcctggtaggggaagggcagcagagaaggactggattagaaccatctcaaatgcttctattctgattagtacttagggttggttggagagtaagaatagggactcagcctagttgaaggaaagcctgtatagtggtgagtctgagtgacaaaccagggagaagtaataagacaatttatttctatttttttatcctacacctgaaatgtaaacaaggacacattaaatttttactggttagcattttttaagtaattatgtgctcaactatgtccttatatttgcattcttaccaatgtagactctgttatggaagtaacccatgctgctgctgcctttggacctgaatctctttttgcccttgtcccatttgtgaatttagactttcagcaagttgtctttatgattctctattctatgacatactttgtgaattcatctgtaatcaaatctgtttgatgaaggtcacaaaagctaagtcaacatgagacctgaaagtagaacctgggggtactgattttcctacccattaggaaacagcctccccacccaatcagggcaggttatagtattcaatgccatcttgtcttattgactgagtcatacatctctcattccgcaaagtcagggtcctaaaatacttctgtggagtcgcaaggactcttcctcattagccatctttgactttgtcattgatactattttctacctgtttctgataattaaaaccccccaaaaagtaaaatgtcagggtgaccagagagaaccttagataggacagctaatctcttgcttctagagaaaggtatgaaaatatactgtgcttattatggggatgatggtatgctctctgaattgaaccttaccttttaacatgaaatttctaattgaaacaaagctgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaagtattttattctctttgaagcaattgtgactgggagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccctttatttccttctcctgcctaattgccctggctagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacattgattgatttgcatatattgaaccagccttgcatcccagggatgaagcccactcgatcatggtggataagctttttgatgcgctgctggattcggtttgccagtattttattgaggatttttgcatcaatgttcatcaaggatattggtctaaaattctcttttttggttgtgtctctgtccagctttggtatcaggatgatgctggcctcataaaacgagttagggaggatttcctctttttctattgattggaatagtttcagaaggaatggtaccagttccgccttgtacctctggtagaattcggctgtgaatccatctggtcctggactctttttgcttggtaagctattgattattgccacaatttcagatcctgttattggtctattcagagattcaaattcttcctggtttagtctgttttggttactgcagcctatactacaaggctacagtaaccaaaacagcatggtactggtaccaaaacagagatatagatcaatggaacagaacagagccctcagaaataacgctgcatatctacaactatctgatctttgacaaacctgagaaagacaagcaatggggaaaggattccctatttaataaatggtgctgggaaaactggctagccatatgcagaaagcagaaactggatcccttccttacaccttatacaaaaattaattcaagatggattaaagacttaaatgttagacctaaaaccataaaaaccctagaagaaaaccaaggcattaccattcaggacataggcatgggcaaggacttcatgtctaaaacaccaaaagcaatggcaacaaaagccaaaattgacaaatgggatctaattaaactaaagagcttctgcacagcagaagaaactaccatcagagtgaacaggcaacctacaaaatgggagaaaattttcacaacctactcatctgacaaagggctaatatccagaatctacaatgaactcaaacaaatttacaggaaaaaaaacaaacaaccccatggaaaagtgggcaaaggatatgaacagacacttctcaaaagaagacatttatgcaaccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggaccaagaactagaaataccatttgacccagccatcccattactgggtatatacccaaaggactataaatcatgctgctataaagacacatgcacacgtatgtttattgcggcactattcacaatagcaaagacttggaactaacccaaatgtccaacaatgatagacaggattaagaaaatgtggcacatatataccatggaatactatgcagccataaaaaatgatgagttcatgtcctttgtagggacatggatgaaattggaaatcatctttctcagcaaactatcgcaaggacaaaaaacaaaacaccgcatgttctcactcatagatgggaattgaacaatgaaaacacatggacacaggaaggggaacatcacactctggggactgttgtggggtggggggaggggggagggatagcattaggaaatataactaatgctaaatgacgagttaatgggtgcagcacaccagcatggcacatgtatacatatataactaacctgcacattgtgcatatgtaccctaaaacttaaagtataataataataataataataaaaagaaatttctaattgagttgcctaagcctgcccacctgtcattctcatatgcctaacacgatgtgagattttatatatacagtcctctgtatatatattcacaggttccccatccacagattcaaccacccatggattcaaaaagcaaagcaaacaaacaaaataacaacaacaaaaatacaaattttaaaacacagtataacagccatttacacagcagttatattgttttaggtattatacctaatttagagatgatttaaagtacatgggagagtactttaaaaaaaaagtacacaggcatgggggcagtggctcatgcctgtaatcccagcactttgggaggccgaggcaggtggatcacgtaaggttgggagttcaagaccagcctggccaacatggtgaaacccctgtctctactaaaagaagaaaaaacaaaaacaaaaacaaaaattattcaggtgtggtggcacatggctgtaatcccagctgctcgggaggctgaggcataagaatcacttaaaccagggagaggcagaatttgcagtgagttgagattgcatcacttcactctggcctggacgacagagcgagactccatctcaaaaacataaataaataaagtacagggaggatgtgtatagattatatgcaaatactgtgccattagggacttgaacatctccagattttgtatccacaggggtcctggaatcaatccccttgatggatacagagggaagactcactctcactctctcttgatatatatatatatatatatatatatatatatatatatatatatatatatatatatatatgcacacatacacacacacacacacacatatatatacacacacatacacacacacgtatgtatatttacatgtatttataaactgatattttattcaaatgtttcaactggcccctaggaagaaagatccactctgatgtgttctggctctgtgtgcccacccaaatctcatcttgaattatcatctgaattgtaatccctgtttgttgtgggagggacctctcgggaggtgattggattatggaacggtttccgcatgctgttcttgtggtagtgggtgagttctcacaagatctgatggtttcataagaggctcttcccccttcgctctgctcttcccttctttaagctgccatgcgaagaaggtctttgctttcccttcatcttctgccataattgtaagtttcctgaggccttcccagccatgcagaactgtgagtcaattatgcctttttcctttataaattactcagtctcaggtatatctttatagaagtgtgagaatggtttaatacactctgtaaaagcaaaataatcactcttcagaagcagaaaaaaactttttataagtgactcaaagtcaagatgacccatttctcatttatatgatataaacctatacatatcctctcacgtactttaaatcatctctagattagttataatacctaaaacaatgtaaatgctatgtaaatgcctgttatactatgttttaaaatttgtatattttgttgtattatttatatttttgttttttgaatctacggtttatatgaatatcattctctctccctctgcatctatctgtatctacatatgtatatttgtttttttcttagaacataacctagattcctctacagtgtaaatcccttgctttctggttttctgcctaataaaaggctctcatttctatcttggtctggaaatacccccacttccattttttatgaagtaaaaataccgaagatttttttttttttttgctagaagtagtttactgtctttctctacaactcattctaatatttttcttttcaactccctaccattcttattgtcttccagcaatgtctctatgatcatagagagacaaactgcagccacacttagccaggatcatttacatttacttgcatggctctgtgtagcttgctttttatgctaggcaggttcctgaatagtcagataggaattgaattcttggaaatcatgccattgtttaaggatgaggaagaacttactattttaatgaactttattataaaccttttttctaagcaaataatcaccccttactttatcttatctcctatgcaaatcctgattttcacatttaagctttacttaacagtgtcaatttgtatagttatctttaaacaatggtcagtccccactcttataattgaaaagtaagtaattttcatttactttctggcttctacctccagaaaatctcttacctctatctttattttggtaattctcttgtagggactttaatagcccctggaaaatcatcatagctctgcttcaatctgaaaacataactggcaggcatgagtctggaacacatacgagggaacgaagtacccagagccaagttaaatgaactgttgatgacttttctgaaaatcatagtaaaccatgatttcctcacaaaatatagaagtgtctgatttttggcatttaattctcaaacatactcagatacactttccttcttcctctcccactctgggttcatatcatcatataaatcagaaatgggtcatcttgcctttgagtcatttataaaaagtttttcttttctagctctgaagcgtgattattttgcttttagagaggatctttctttctggggccagttgaaacatctgaacaaaataaaaatcaattgaatatggatatgaaacttaacttgtctttttaccattaaatatatatttgaaaaatgtgctcttcttttatagcttttgtcacatcagcatgtaccaattccaaccagagaacgaaatattaatattctgccccaaagtgctgttttccagcctgtgccaaagcagataatgccagtaacagggagttttccaatctaactttcttataccagtcaaattatccatttcaaaaaagcatccagtcaaagtgctcccaataagtgaatattttgcctagagaattttgggcttgagttatccatccctctgaccaaaatctataagcccactcacccaggagatctgagaatgaaactaaatataaaaactggctttactactgggaacccgaaagttcagctagtgagggaaggaaaacaaagaatagaatgttttccgacaatccttgcttttgtgagtggtcagcagatgttttgtgcctctgctgtattccttagctaagggttcacatgaaatgtaccctctgaaggctgtggccttgttggaacgccaaattagtagttattcctcatgctctgaggtctagcttcaccttcagaaccaggtgagcttggtccccacaaagccctactggtacttaagcttcccatttcaagaggacatttgggttcactacacctctccaagccgtctgattaattgcagctgtgtgcaaattagttttcttcaggggctctctcctgctctcagattagcaacaacgtattcagatggaaagcaaataaagatagttgtaaaatgaggacacaaaagagatgcaacatgtttgctcttgatgggtgcattgatgtcagaacaactagggggaaataagaccaccttggtactgttatcatcgtcctgatgatggtcccgtcttgcagaaaagcccaaacagaagcagggcgttgtctaatcactgatgggtttcctgatattattgagaagaccaagcaaaattaatggtgatattatatctggtgaaattattataaattctccctgcagttttaattagctctgctctttttctcctcctgttttaatccaaagcatatgtgtatgtttgtatcagcaatttcaaaattctgtgaagcatttggtgtcatccatctagtttcaaaataggtacagcatgatgcagtgggaagaatgctagcctagaagttaggactcctgagttcctgcctaggtctgccgctaagctgtagtatgaccttggacatgacctttcaggaccttgatttcttcttatgtgagatgaaggattaaaatccaacagtttgttaaatcactctcaactttttagatactattaagtttaggatcccgtggagaggcctatcatccgagagaccatcctatcatcaaaaggtgaatatcaggtcaaagcaaaagaaaccacattaatttttttctgttgtcagctcacaaagctattttaagcctttggacaataagaaatatactttttttcccctccaataaatatacattatccattaaagtagagtgtgttgtgaactgaccttaagggaatttgctagtttttttgtttatttttgttttttacaggaaactaagtcctgtggaacaaaatagaattaccttcatggagcaagtttaacaaattgtcttcatttttggtcagcaggttgatttctaattccctcttattccctttatatgtatttttggcttcctgtctttgttttgcgttgctataaagaaacatgtgagactgagtaatttacaaagaaaagaggtttattagggctcatagttttgcagcctgtgcaagaagcatggcaccagcatctccttctggtgctgcccctaggaagctttcactcatggcagaaggggaaggagagctatgtgtagagatctcatggagagagagggagagcaagagagaggataggaggttcaggcagtttttaacaatcagatttcatgaaaataaaagaactcactcattacctcgaggaaggcaccaagccattcatgcgggatctgccccatgaccaaacacctcctactaggccctacctccaacattggggatcacatttcaacatgggatctggaggggacaaatatccaaactattaaattcctaaaggacataaaagggtgaactgcacaaggatactatatctccaaacaaatgcccagttaggtccaggacgtgttcaacagtgtccaaaatccaaagagaaccagagatagtgtggcttagtagaaggtaaactgattatacacactcagcattgcaagaaaccttaacgggactgttgtccaaccacacaagcattattcaaaaacctttttacctctcaaggtttggttttctagcatgggttgccaagctacaactgcccagagaagtcatttaaactgcaagagactcagctttctcatccttggaagagagaaattggacaaaattatctttaattttttgtttgccttaatatcctcttattctactaaacattttcagtattacagaaatcagctcttggaggaaaagacattgcagggggtgggagacaaagttggtgataccatgtaataagatttttttagatagtggcaagataaaatgttttgaggtttggcaaaaccatctagtagtttcagttctccctgacagtaagaagttaaggaggccaatttctctttcaagtcagaacttcttgttataactgggtagtaaacatactttttaataagaagtggctaaggcttaagaagaccaactgctgatacccagaaatagccaaagaatacttcattactgacagtgcacactttgatagacctgtcttttactattgacagtattctttctctgctgtttttacaagaaaaaaagcccaatgaaatgtaaaccttgttttcttcagttattggtcctaggagtattcagagtaaataaaaaaaaaataccttacgtatacttctataaaatcttttatttgagcaattaaaaaaagctatcttctttcagtcttatcaaggagagcaaattcctcctagaagtcttatttctacttctaatgacaattgctttattatgtgacattcaaaggaaaaacttgaagtcatatttctagtaaagtatttaatttcagaaataatttaaactgttacttcaaagcaaatatctgctattcctgacataaagtttttacccaagcttggtaataaagttatcataagaataatatggattattctcaggatggaatagaatgtcttgattaggaagaaacacacataagaaattcatttttttggaagaaagaaaatctgtgctgtttatctggcaatggaagtcagatcaaaatatatctatatgacatttgaatggggtcacgtgggaagacaagatctgtctgtatgaatatttttagcttctgaatttgacataagaataggatcaggaaaatgaattctgtgttacatgactaagatgcatattagaactcaggcaagatgattcctgtagttggtctactgggaaattaccctctgcctacagctttcaaatacatatatatactatgtgtgtgcatgtgtgtaaatttccaactgagtacatcagcacataaaatacacttgtccaaggtaaaaaagacaaacagttattaatagggcaaaaataaaatggggttatatccaaccatggcataatacttctcattagaaaaaagtgtggcgagctaattaagacccagtgatagttagaaagtctgagaacatttatctttaaaaatggagtggtaactaactaaaagaaggacccagaacctcctaatacaaatatcagttatattccctgagatttaaaaatataataattcttatttctaattcaaaggcctagagtgtaagtagggataacttaacctttttttttttttttaagcctctgtgagaaataacgcagctgtttggcccgtggtattctctttaaaggaaagaagttacaaagacaagaagaaaaaagtggaagagaaaaataaggagaaaaaatattcaaacagtacataactaaaaaaaaaatttttcacaaacagcaaggggaatcttgaaacaaaatagatttgttttaaaatgcaaagaaagagccttacccgggatgaattgctcagttctcttttgttggttgagttcacttccttccatttctgctaactttgaccagctgctaacaagcaaaagagcttcatagaggccatctacacgtgttctcttctgggttatcgcgatgctgacaaagtgcacctaccgcaaattagaagagcacaaagatttctgtgggtatgcctgcaaaactctggctgcgaggcatcacctcagctcagtagccttggatttacatgtgcctgcccccctgcccatggttactgagggtggcctgaggatggattcacttcataacccttttccataattatgtgaataacaaatgagctctatccaatagagaaaaagaacacattttaatactttgtgaagtgatcatgaggaaggggacagaggagttgagatggccaagagagatcccgccctctggagatgtaatagaacagtgacagataatgcaaaaaaagatttaatatatttttatatatttaatatttgtcttctgttgttgaccttagcttttgagtcaacagtaactaagaagcattttgtcatccgacggctcctcttcctttggccttctgtattgtattatctgataaggaagcagcgaacttaaagctcagttcaacgcaatgatccttcatcatagctgggtgtgaagaatgttgttccctcaaatatgacacaaattgtttggtcaatagagaagagaactgcattctatttttttccaaacatctgttatactccaaaacctttctccttaggccatggctgtctgaccaacagtaggtggatttctttgaaatcttatcttctgtagaactggatctcatcctggccaacatggtgaacccagtatctactaaaaatacaaaaattagctgggcgtggtggcaggcgcctgtagtctcagctactcgggaggctgaggcaggagaatggcgtgaacccgggaggcggagcttgccaagatggcaccactgcactccagcctggcaacaaagcgagactctgtctcaaaaaaaaaaaaaaaaaaaaaaaaatagatctcactagaagtattctcaattcagcagtagtgtccagttttgaatcaaataatttatattttgattatgtgtattaagaagctaaatctactcatatacaaaaggaaaatctttagcttttcatgtgttctggctaaaggccagaattaaaaggaagaggatgtcttatctatcagacatttttgtgcctttgaagccataaacttgagagaaacattagcttgttcctgaccctgcactcagcataagcatttgcttgtagcagtcactcttgggtgactataaattcacaaagtcaagaatttgcatcctgaattgatttgtgtaagatgtctaggggaatgctgattttatattggaaacaaggttagggggaagcctcaaaactgcctttatggagttctgtatctcagcatattataattcttacttctaccatactccagaggaatcagtctgggtgacttcataaaacagtattagaaaaattgctagcactacgaaatcaagcaggttatggcagtatattccttgtaagaaaattagtgcattaactctttccaataagtgattgaattagttttgcacataatctgatttatgaaatgctgcactcgcatgctcaagtagttagaaagtgtgtcgaagcagatgttgaactgaagaaagaaggttgcttgaaatgtaaaggtattataaaatggctaatctgtgggtatgacccaaagctttcagagatttcctggcttcactttttttttttcaatttaataaattttttttcttaaaaggtaaaattgccaatgagttaaatgttgatgctctgatgttagcaagactgagttcatatgtccatcgcttattaactccattttcttatcaatatgtttggcttctgtaagtcttattttcttgtttgtgaaaggaagatctaataatagaactggccttatagaattgttgtgaggattaaatgtggcaacccatggttattggtttcgtgcgatgcctgtcacaaagaaaaaacccaataagttgtagtggctatttttcatcttctcattatcaccattacttaagagagaggcaaagtgatagtatcatacaaacattttcatggagagttaaatgaacatctgttttttcttttcttcaattttttaaaaattatactttaagtcctgggggacatgtgcagaatatgcaggtttgttacataggtatacacgtgccatggtagtttgctgcactcaccaacctgtcatctacattaggtatttttcctaatgctatccctcccctagcctcccaccccctgacaggccctggtatgtgatgttcccccctccctgtgtccatgcgttctcattgttcaactcccacttatgagtgagaacatacggtgtttggttttctgttcctgtgttagtttgctgaaaatgatggtttccagcttcatccatgtccctgcaaaggatatgaactcatccttttttatggttgcatagtattccatggtgtatacgtgccacattttctttatccagtctatcactgattggcatttggattggttccaagtctttgctgttgtgaatagtgctgcaatagacatacatgtgcatgtgtctttatagcagaatgatttatacatacgtgtgcatgtgtctttatagtagaatgatttataatcctttgggtatacacccagtaatgggattgctggatcaattgtttttaaggacaggttgcataaaactgactaatgccattcatgacagtgagtttcaaaggcagatagctatcttagtccatttagggtgctctaacaaaatgccacaaagttaggtacattataaacaacagaaatgtatttgtcacggatctggaggctggggagtctgagatcaagaccctggcagatgtgatgtctggtgagagcttcttcctggttcatagatggcgacttccagttatgtccttacatggtggaaaggacaaggggtctttctgcgaccagtttttcaagagaattaatcccacttatgaggtctctgccatcatgacctaatcacttccccaaaactccacctcctgataccattacactggtgattagctttcaatatataaatttgggtggcggggtggggcacacacattcagatcatagcaatggcagctaggaggaagtaaattttgaatcctcatttccatgtaaagacttcatttgctttaaacaatttatttaacttttattgtgctttttctgaaaatgaaataacatttagctacacacagggagggtatgttgtttctaaagtaaaaattaactcttttgtaaatgtggcattgtttaataatagttcaccctgtccaatgatacttagcttttttatatatgtaaataaattattaggttactggtttttctttttcttttggtgggtggggggggtgttaagatcttattctcagtcctcaaaactctgttgaacagggaacatctgccctcattttcaaccttatttctttagtaccaattgcagccatgttataatctttgttttcatccaggtaaagctgagggaagggaaggagaatccactgagaaaaagattttccccaaagagtgactcagcctttgaaaagaaaatcagctatatgaaaagggaagagtatttaatcattcggagcaataattgcattgtaaatattagctcagctgataaggagtagagaaccaagagaatgagggagccgttacattgttttatcttgtttgatgcctttactcagtgctctagcatgggggccatgtctagggagggaatccactgcagctacatttaaggtcacctaataaaccgtgctgttttctttcttttcttctagactctattccttcattttttttttctgaactttaagcaaggaaactgccagtcatagagcatttccttatacacttccatgttactgttatgcagagaaatctgactggcaggctgatggccaggctgctctggaggaaagtaattagctatgtgactttatctaggccaaaaaaatgggataaaaaacatgcaaaaccattcacctatacagacctgttctcaaggcagtgtttaccctagtgcatctgctaattcctttcaagtctggaaaactgttttgtttgacatttttggaatgctgtgatctgaaccattagactatttttttctcctttaaggtactaatattctgatttttaaacaattaaatatgctctaaatttgtctcgcccacttctacatcttcttccaacatttacatagacatccatgcacattcatgcacaccacacaactacaagtcatttcagacaaatggtcttatctaattctttttagtgtttccattttattatttgtcaaattgaatggaacttccatgttttgccctgctgacatttaggcagacttgcataaaatacaagattatttctagctggataagaagctcagctatcagatagtgttgctgatttatacagtaggaggaaggagaaaagaccaatgggtgagtataataaatagaaacgtcctgaagcaattcacttgtagcctatccaaatcttgcaaactctgcataaaacatcctcccagttctctttcaatggaacaatttttcttttctttttctactcttcactgaacatttcctgtattctacatgcaacagtgcaccttttacattcgtttggcttatgtgctcttgcaataaccctttgctgtgtggtaatatctcatttgtgggaacttctgtgacactattaggggacagatacaatggctatgtgcctagcaatgccttcaccgtgctctatttaaatagattgctcatttatttgctactttgctcatcaccctgtctctcattcactataatatctttagcaaatcacatagtgccaggtaaataaatggtactcattcaatattgaccatatggatgaatctctgcttatgaaatatgagagccccgtgcagggtcattctgtccaggaactcatcttctctggcggtgtgagaccatatgtttaacatgaccagtaaggaagtagaaggaatcttccactactttttacattcttttttctttcaaaaagttttgtaaacttcaagtatgtaaaaaaacagttcttatatgttcatacagtttgctttcaacaataactccacacatgtgcattgacatgtaaagatgtttccagtataaagtagaaaaaaatgggttttaaacatcatatataaaattaatcaattttttaacatatagcatacctgtattcaggaacatgttctttggttattctcatttaaacagtcccctattgttgaatacttgatctgtttctattgtttcattttatatataatatatcctataccaaatatcctaatataacttctctgtgtgcttgtctaattattttgtttagataaaaggtttcatatggtgtccacttcatgccattatgtgatatgatttgcctctcagcctctaggaatgggtttttctctaaggatagtggctgccactctatctagtggctgaagtaatatggcttcatgtcatgtggctaacgattcatgccaaaggttgtccgcatcttatgtatcagtgagttatctgacacccctaatagacgcttatttcttttttcaaaaagcttgttcctgagctgaatttccatgatcagatggtggcaagagccaagtcttctcacataaagagaaatcacattgaatctgctacctacgaccactggccaaggggtcttgtcatcattgcattctggggaattggattcaatttaaaaagttgaagctgcttgctggcttccttcctggtagttttgaatgtgtaatctcacaaagatcttcttagctctggcaaagctgagcctgtctaaaacatttatgttagaatttacatgagttcatttgtgctggcgtcaaacatttcttgagtatttaccatgttattggctgatcttaaagccaagctacaaaggactagtaggggttagcaggcaggcaggaagaagaagggcatggttggcagagattgccacatgcacagaatatagtggtgaacctacatggtgcatttggaattgcaagtagtctggctttgctggaagtgggtttgcaagctgaggagtaacaagaaataaggccgaatagcataccaggaagtggtagatggcagagacccctggatcaccgtgatacttatgacactacttgctcacttgttttttggtttatttcctgataagctttgagccagaacattaatgcaaattcttgttcttgtgtaaaaattactgcaatgacttcccattgctcttggagaagacaaaatccttaatatggcctacaaggtccagtacaatctgtctcctgcctctgtagtcttattcttcactaggtctgccttcttcctcccagccctactggggcccattctctgggcttcaatattacagaccttactttaatttcactaatgggaaatgttgctgccttccaacaaagggcttttgcatgtgctgtttatatgaaatcctcttttcttcctgccactcttgcctattaatgttcttatttctcagcactcacgttatttttttactcagagaaatcttccctgagttccctgaccatgtcagatttttcacttatatgctgtcataacctcatgcatttctcttttacagtgctataaattgtcagtgacacatttgtgtaattaagtgatgaatgttcctttcttcctaataagtaacatcatctataccatcattattaaatcagccagcatcagctggggtacttatcatatgtcctatactgttctaaacacattatatgtattaattcacttaattctcataacagtccctattaaatggataacactgaggaataaaaaaagtaagtcacccaaagttacacagctgataggtgatgaagttagaattagaaatcaggggggaggagccaagatggctgaacaggaacagctctggtctacagctcccagcgggagcaacgcagaagatgggtgatttctgcatttccatctgaggtaccgagttcatctcactagggagtgcaagacagtgggcgcaggtcactgggtgcatgcaccgtgcgcgagccaaagcagggtgaggaattgcctcactcgggaagcgcaaggggtcagggagttccctttcctagtcaaagaaagtggtgacagacggcacctggaaaattgggtcactcccacctgaatactgtgcttttccgacgggcttaaaaaatggcgcaccaggagattatatccctcacctggctcggagggtcctacgcccacggagtctccctgattgctagcacagcagtctgagatcaaactgcaaggcagcagccagactgggggaggggcgcctgccattgcccaggcttgcttaggtaaacaaagcagccaggaagctccaactgggtggagcccaccacagctcaaggaggcctgcctgcctctgtaggctccacctctgggggcagggcacacacaaacaaaaagacagcagtaacctctgcagacttaagtatccctgtctgacagctttgaagagagcagtggttctcccagcacgcagctggagatctgagaacgggcagactgcctcctcaagtgggtccctgacccctgacccccgagcagcctaactgggaggcaccccccagcaggggcagactgacacctcacatggcagggtactccaacggacctgccgctgagggtcctgtctgttagatggaaaactaacaaacagaaaggacatccacaccaaaaacccatctgtacatcaccatcatcaaagaccaaaagtagataaaaccacaaagatggggaaaatacagagcagaaaaactggaaactcttaaaagcagagcgcctctcctcctccaaaggaatgcagttcctcaccagcaacggaacaaagctggacagagaatgactttgacgagctgagagaagaaagcttcagacaatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgatgcgatcaactggaagaaagggtatcagcaatggaagatgaaatgaatgaaatgaagtgagaagggaagtttagagaaaaaagaataaaaggaaacgagcaaagcctccaagaaatatgggactatgtgaaaagaccaaatctacgtctgattggtgtacctgaaagtgaccgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcagcagaaactctacaagccagaagagagtgggggccaatattcaacattcttaaagaaaagaactttcaacccagaatctcatatccagccaaactaagcttcataagtgaattagaaataaaatactttacagacaagcaaatgctgagagattttgtcaccaccaggcctgccctataagagctcctgaaggaagcgcttaacatggaaaggaacaaccgataccagccgctgcaaaatcatgccaaaaggtaaagaccatcgagactaggaagaaactgcatcaactaacgagcaaaataaccagctaacatcataacgacaggatcacattcacacataacaatattaactttaaatgtaaatggattaaattctccaattaaaagacacagactggcaaattggttaaagagtcaagacccatcagtgtgctgtattcaggaaacccatctcacatgcagagacacacataggctcaaaataaaaggatggaggaagatctaccaagcaaatggaaaacaaaaaaaggcaagggttgcaatcctagtctctgataaaagagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagattttaacaccccactgttaacattagacagatcaatgagacagaaagtcaacaaggatacccaggaattgaactcagctctgcaccaagcggacctaatagacatctccagaactctccaccccaaatcaacagactatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacatactagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctaccagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagagaaaaagagagaagaatcaaatagatgcaataaaaaatgataaagaagatatcaccaccgatcccacagaaatacaaactaccatcagagaatactacaaacacctctactcaaataaactagaaaatctagaagaaatggataaattccttgaaacatacactctcccaagactaaaccaggaagaaattgagtctctgaatagacgaataagaggagctgaaattgtggcaataatcaatagcttgccaaccaaaaagagtccaggaccagatggattcacagccgaattctaccagaggtacaaggaggaactggtaccattccttctgaaactattccaatcaatagaaaaagagggaatcctccctaactcattatatgaggacagcatcatcctgataccaaagccgggcagagacacaaccaaaaaagagaattttagaccagtatccttgatgaacattgatgcaagaatcctcagtaaaatactggcaaaccgactccagcagcacatcaaaaagcttatccaccatgatcaagtgggcttcatccctgggatgcaaggctggttcaatatacgcaaatcaatcaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccagtcacaattgcttcaaagagaataaaatacctaggaatccaccttacaagggatgtgaaggacctcttcaaggagaactacaaaccactgctcaagggaataaaagaggatacaaacaaatggaagaacattccatgctcatgggtaggaagaatcaatatcatgaaaatggccatactgcccaaggtaatttacagattcaatgccatccccatcaagttaccaatgactttcttcacagaattggaaaaaactactttaaagttcatatggaaccaaaaaagagcccgcatcaccaagtcaatcctaagccaaaagaacaaagctggaggcatcacactacctgacttcaaactatactacaaggctacagtaagcaaaacagcatggtactggtaccaaaacagagatatagatcaatggaacagaacagagccctcagaaataatgccgcatatctacaactacctgatctttgacaaacctgagaaaaacaagtaatggggaaaggattccctatttaataaatggtgctgggaaaactggctagccatatgtagaaagctcaaactggatcccttccttacaccttatacaaaaatcaattcaatatggattagagtcttaaacgttagacctaaaaccataaaaaccctggaagaaaacctaggcattaccattcaggacataggcatgggcaaggacttcatgtctaaaacaccaaaagcaatggcaaccaaagccaaaattgacaaatgggatctaattaaactaaagagcttctgcacagcagaagaaactaccatcagagtgaacaggcaacctacaaaatgggagaaaattttcacaacctacttatctgacaaagggctaatatccagaatctacaatgaactcaaacaaatttacaagaaaaaaacatacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaagatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgctataaagacacatgcacacgtatgtttattgcggcattattcacaacagcaaagacttggaaccaacccaaatgtccaccaatgatcgaccagattaagaaaatgtggcacatatacaccatggaatactatgcagccataaaaaaggatgagttcatgtcctttgtaggcacatggatgaaattggaaatcatcattctcagtaaactatcgcaagaacaaacaaccaaacaccgcatattctcactcataggtgggaattgaacaatgagaacacatggacacaggaaggggaacatcacactctggggactgttttggggtggggggaggggggagggatagcattgggatatatacctaatgctagacgatgagttagtgggcacagcacaccagcatggcacatgtatacatacgtaactaacctgcacaatgtgcacatgtaccctaaaacttagagtataataatgataaataaaataaaaataaataaaaataaaaaataaaaataaaaatacaaaaaaaaaaaaagaaatcaggcagactggatctggaatctgttctcttaacctctctctctgctcaccggtaggttatagacctaacataaagtagttgctcaataaatatttgttgaaagtataaatgaataaactaattaataaatactttatatgtgtcccactcttaactggggaaaattgggtgggtagatacaaaagaaccctagtagactgttcgctggcaggaatgtgttctagaggattggggaaagagaaacccccgaataactgtacgtgatttatgatgaaaatctttcaagtagtggaaagttataaaatgctaaccaaaagattagttatttggtttatatgttgatcactgtgatctttcccaatattgactggggtttgttgagtgtctgtaatcccacaggtggatgttcatgatctgaagtgacaatggtatatttgctcagcatttcctgtacctgaaacaacccttgaaaactgaaatagaaagagcaagtcaatggtaatatcatccagcactctgccaggcttatggcgaccttgcttacccgaaagcaaattacttccctctcatttctatataataagtactttacggctttgtgttttcatgcattgagatttccctaggagtctgagaagatgtccaggaataaaagagggaagaacaatgattaaactatttctaggactttagacattggattatattcagaaacccataatcagaccgttaatgaatgtcttcgcattcattatcagactctgaaaaagcatatccagtctctccatggactggccttcacatatgctttgctatctggtagaaatatctgcccaaaagattattttttatggaaataatagtgcacatgcagattctagatattattttctatttatcaactgcattcaggcagtgctaagtagatgactgatgctgaaattttactagatgatctttgctctctattttgttatatgacacatggggcaaatacgtgagatgagcaattagtgaaattctggaagggacagatttatgtcatactattgaaagggacaggaagtggattaagtatgatatatatatagtatgtgtgtgtgtgtaggtgtgtgtgtgtacgtataacaagttagtttccttttcctaccactgaaattgttaaatggaatggtgacgtagacactttacttctctactcctggacttactagtaaagaagaaatatataaaagagcaagatagtattgatctggggtggtactatggtatgtattaataccataccgtaattctatgatctattaatgtcacaaccagctacatttagctggcttttatatacgaatgtgcatagtactgttttgtattaaatatcaccagaagatatttgtcacataaaaacagtgagattaatgtttatatattttggcactcatgctagagttgaatgaggttctgtctgtggggataattctaggtatcctggaaaacctccacatatacaccaaacccagaatcaattcagataggcattactgttcgcagtcatctaatttcaagttagggtagtaggatatggattggggggcgtgattcttagtgccagagaaagattaaattattcatagggaaagatattcagcctaagatggataagactgaaatcaggtgcctggactctagaggattgggctctaaccgaaaaaaaaaaaaaaaaaaaaggagaatccagtaggaattcattgagtaagccaaggttacaatctgctggacttcagaggtagagttctagatgcccattttaccaccctaggtcagaagtggggagcagagagacagaaggctataagtgaggagacagtactgagacactaagtagacattctagccaactctgtagaggattctcatgttatgagctgaagtagaaaggctatgtttgaagattctgtctgattttgggcatcttggttctagatctatcataggtgcagattaaattgtttccaggctgtacttgatagttggtaaggatcaaacaataccctcacataacttgtcctagaactggttgtgctatggcatcattgtagtcccacatcctagcatggagcctaaaaaaaagtaggttcttcataaatagccaaggaatgaattaatgagtgatgggatgagtgtgagtggagaaataagcaaaattcctagaaatatggggtgggagtatggcagacaaacgttggcatcatccttcaaggaccagatcaaaatgccacatttccactacagctttctctgagttaattacttctctccactgttactatggtgatgtatttattctgctttaatagcatttatcaatcattttgtggttatattttatgatttctctcttcctcctagactatgaaatccttgactgtagaattgttggtttgtacctacattactgcagatagtatctggcaagggctgggctctcaataaatattgaccaaattgaggctgtaaagattccaatggaccaatatggcttgtgacccatgcttcatttacctaaatgaggccacaaggctctgtgatcacgtggcagtcaaataacaaaactctccaaaatcaggatttcttcttccattccttcaggttccctcccccatgggcatggttatctcatcctttacctcctggaaattatatattggaggttgtcagtgtgtgctgttctgtattgccctatagttaatgcacttctctgacgtagaggactgagctctctatagaactatgcagtgtcaaggaccctctgccttgacatagatgcttggaccacactgttaggtaactgagaagacaaagaatgtggctagaggctaaaagggacagagcaggaaaagcatgaagggcatgaaggaaggagcttgaatttttttcccaatgtactggggagcccaggagtggcatcactttgtactccagcagtgacattttaatttacaagccaagaatgcactgatcgccaactgcaaaaattgatttggttgttcatctgattcaacccatgtcagagtttgaaagtaattatgatagtggggctgataggcaggcaattacatttttgttctcttgctttctggctccttctccctctctttcccttcccacacctccacctgcaaggttgttcttgtcaggaaggcaatgtaagcaggagacgagagagtaatctttggagatgtggtatatggactcttgtggcagaggctataataaataatagtatggctggttctttatcctaatttttgttagcctcttatgaactctaaccagataaaagatgcaaactattttgtctccttctttaaagtacaaaatagaaaaagcacatgtactgtaaggcagtttctgtttctgatttaaatttgagttgtctttgcaacatctatagattcggtgtctttctaaaaaggtttgctccaaatcataatacaaaaggaacctgggatagggagagatttaggcaaagctaaaatccatctgagttggggagcagattccatgggagactgaaaatgtgtttcaaactgtagtgcaagaaattgaacaaagtattggaatttttctaaaaaaaaaaaaaggttcctttgctgaaagtagtacctggcatgtaaacctaaagtaatatagaagatgaagtggaaaagtatatcacaaggcaaaaattactttttagactgatgaagagatggatggatggatgtgaattttttttatctatttcttattttgaaggttatttatttattcacaaacactggaaaattcagtgtttttcactgagcaaaatagcttgtctggtccaaagccagtaaaataagaattttgtgggtggggtatctactccattagtatagcaaatgttgagatatataaattattttaatatatttattttattgacaatataaaaaaaaatttaacaggctccacaccaaggtcaatagaattcagaagcacatctgtcctcccaggaaacttgtggtttaactatttactatagctacctcaagattttacagaaaaaaaaaaaaatgagaccttctcttgaaaactaccatatcccagatctaggcttttctatgcactgtaacttctctataaacctcctttctactgactgccccacttcaatttggcacatacaccctttaaccagtaagcatgtgcatgtagtcagtgtgtcagacaggtttggctgaattgatataagactggtagcataggctgggcgtggtggctcacgcctgtaatcccaacactttgggaggccgaggcaggtggatcacgaggtcaggagtttgagaccagcccggccagcatggtgaaaccctgtctctactaaaaatacaaaaaattcactgggcatggtggtgcgcgcctgtaatcccaactactcaggaggctgaggcaggagaatcacttgaacccaggaggcggaggttgcagtgagctgagatcatgccactgcactccagcctgggcaatagagtgagactctgtctcaaaacaaaaaaacaaaacaaaacaaaacaaaaaaagatgagcagcatggaacatgatgttggcatgaggccctactacccggcagcagactatcagggaataaactagataaacctggaaaatgttttaacttcagtttattttattcacattaagtaatggagtagcatgttgtttgtttgtttgtttgttttacctctaaacctcctgtatagcccccttttaaaagaagggcaggggaagaggcttaaaatatggtagtattgactcccaggcctgttcagtctatacgaattttcaggctgtatagtttaaaaaaaacattgttcaatttcttatacgtttttactagtgatattactttagaaatgggcctcgaaagactcaggttacttttagatttgttcagggtttaaagcttcttttaggcacttcttgggcttcttctacctttcactgtaatatagtggtgaagagaaagactttggaatctgatagatttgggtcagaattgtagttttgccactcattacctttgggtaaccaagctctgtgaacctcagtctcttctgcaaaacagaaatggtgacatatttcctaagtctcttggcaggattaaatggaatacagtgcacaaaatactcagcacagtgcttggcacatagtaaatgccgaattaatggcaatgaattgttgttgttgttgttttctttttgagacagagttttgcttttgttgcccaggctagagtgcaatggctcaatcttggctcaccgcaacctctacctcctgggttcaagtgattctcctgcctcagcctctcgagtagctgggattacaaacatgggccacccatgcccggcttttttgtatttttagtagagacagggtttctccatgttggtcaggctggtctcgaactcccgacctcaggtgatccgcccacctcggcctcccaaagtgctgggattacaggcgtgagccaccatgcccggccaatcaattgttattgatttattactgagattgctttaaataaattcatccttatttctgttgtagtctttaccttgtctccagatctttggaagtctcaggttcatttgtctggactttgggggttttgtttaaaactgcctagtctctgcagccacatcctccaccactgtagcacatgatcaaaaaacttttctctgaggatactgagtatttcttagacctatgtcactagctccctgggaactctctctacccccatcccatcaactctctgaccacaagttttcaaggaatcttcctcattatactcatctatcattcttgcagttttctgtctcatcttgagctgttggtcaagagtagaccagagtatccatttctcaactcatttcttaataaggcaacaccatgttcaatgggcattcattgggccagttgaggctcctctgtaattttattttattttttgagacagagtcttgctctgttgtccaggctggagtgcagtggtgcaatctcagcttacagcaacttccgcctcctaggctcaagcaattctcctgcctcagcctcccaaagttctgggattacatgtgtgagccaccacgcccacccttctctataatttaaatgttatctctctttataacattttcataagaggatccacaattctattttcccattcacttataaagaacaaaaatatatccctaaggttccacaagtacctctggcctttggggaaaaaaaaaaaattcacagatgcttttttgaggaggtaattatttgtttgttgtgtccttgctattcattttgagatagatactcaagctctacacctcttagcttatataccagtttcaaatttatgtctttattatttattataaaatcttttaccagctgggcatggtggctcatgcctgtaatcccagcactttgagaggccgaggcaggcagatcacaaggtcaggagatcgagaccatcctggctaacacagtgaaacccggtctctactaaaaatacaaaaaaaaaacaaaattagccaggcgtggtggtgggtgcctgtaatcccagctacttaggaggctgaggcaggagaatggtgtgaacccgggaggcggagcttgcagtgagtcgagactgcgccactgcactccagcctgggcgacagagcgagactctgtccctaaataaataaataaataatctttaccttgaatattgagatgggttcaatacaatctcaatttagaatacttaaaagatgaaaagttccataaaataaattttctaatcaacagaaaacattttgttaagatgttgctgatgcaaataattctagcatgtatcactgttagttttctatctttgaaaactatcattcaactaccatcgtagttactagacttccattcaggatcttgcatgcctaagagtcatttcactgccaaaaatgaggaaatatagaaaactgagctgtgtttttatcatctaccatttcaaaaaaccctgtggaaaaaatatttcttttagcaaatctcagacattatcttgacttatatgtaagatgtacctctctctttaaatccaagtgcattgaaacttctggctcataaggtaatttttttttttaaataattaactaaacccttaaaactacatagaagtctactttgttttataaattaaccccattattttaggaattaatatagctttgtcttgtgagatgctgaagttatttttcctggttcttaatattcagtctttccgcttatctatttaattcctgatcactagccaaactatatactacagtttggttcatccaatttaaatagctggcctgtaactaagaaaagaaaaatatattttgtgaagaataggtatgaggtagagaaattagtggtagtatgatacgggaaaagagtaatgtcaaaatgcatggtaatttatgtgatatgccgaggactgcaagaagtcaagaaagaaacataacaagctaacagctgtcaccaacaaatagcaattaatttcagcattcattcccttgctcatgcttcatgaaagtatataggtaaacaggattcgtatcatgttctattttcttctctgggcctcaggcttccagccctctgagctactgtcttataacattctgaggatgtaagaaagaacttgatcctgttttctttttcagtctggagcagagacacggtgaagttcagtaaggtctgacacccattagcattttgtgtgactcaggatacgaatcaaacctactgttgtggaagcagctttccatataaatctaattcccaccaactcctgccaccaccaaagctaatagtcaagtgcttgtattgctgatagcaaaggtccaagattattcttattgttttactggggctacttatcaaaatctatttacttgtctattctatggatggggaggtggtaaagaaaaggcttaagtgtcctacagagattcattctatgctgcctcaaatgctttgaagcagtacaatttctcttttaactgcctcgatgtaggtgaagagtcttgcaggatatgttcactgctgaagagcaagcctgcctcattcataaccactagtagctgacaacctttggattctttccacagcttgaaaattcctccattccttgaaagcaccctgcactaatgctcgaagtattaagtgtgtttttatttcctagaaggatgcattttacacaagtcacttaaaagcttctggaagctttaattacaggttgactaatatttagaagaattgaaatacccctctctctcctctgtggtatgcatgagccagattctggttcattaaccagaagtctattacttttcccctatagtttcatggagtaaaatggtagatgcaaaccaagagaggtcaagggacctgagcttggttctgtctttgtcacaactaagagtctgaccttggatgagtcatggtaagactctgtgtcatatataaagagtattctgagagtaaaacacgcatacaaatgaaaagtatggttattatggtctcttgaatattcttagatcaatttcacccattggatggggctagtatatggttgatggatggtatttgtttcatttatctggcatgcatttaaatcttcaggtgcattaaacgaacaacacaaatttggtatatgattttcatgctctcttgcatgatagatataaaatcttaatcagtgattgtctggaaaccacagtctccaaaatgctgcctaggagtgctaaagagctgtcagatctaacttatatgagttgacaacatagagaagagaaagaagttgaattcagttaaacctggaaggagaaacccatagggtggaattatctgaatttgaatttttctgagttttattcccccctacattatgacacactaataagtggtctaccttgacccagagatacgaattttggcctcatttgtagaatagcacctggattcaggaataactccttgaagtgtcccccttaaatctctatgtggcattcaatgttcacttactcatagaccaaggagataaggacatttatcttctcaggtaaggtccctctgttgaacactgaaacaaaggggttacattaccactgcctatctttcagaaaaatgactgctgtgatagcataaatgtcccgagagctttgctttgatagaagtgtgtttttaatgatatgattttggtgtctggccctctgtggatagcttggcatgtgtcttgttctatttaaacagcactgactgataaagtggacgttaattggcagttagtgacgaggctgcaggtctttgttacccagcctttcagctaactgatcattaactaggaggaaatgtgtgacccagaaggtcattactgttattacgtgggaaaatacatttaaatgttacagattgcttttttatgaatcaggtgagcatttttagaaaagagagagcttgatttacaatggagtctgttttcagtcctgctcttttcctgtccctttgaagactaaacggtatatttctagattcccattgctgtattgcctagaacctcacaatgttgatattgactaaaaaacagaaatttcttcaactccattaagagcttttccaaaatcttaaaatttccaaataaaatcctttcgtctggatgccactcactttaacaagctttgagtaactttttttaatgaaaatgtgatagaaagtaatgtaactgcatatgttttattatgtaaaattctgatagtatcatgtatgtctttagaatttccgttgtcacacattgtctgtgctttgtaggattttgcagattaagccttagcactcattttgtgaggacagtgaatcctaattcctcttcttcattctttctgtgacctttttgattttgcctctttagtaatctcctcactgcccttgtaatgcaaaaaataagaataaaaatggtctgtttgggtgctgtgagtcttggcaattaaaacttcacatgaaatttgtctcctgagagaaaatattattctcccttttaataaaaggatacaattaaatactccctgaaacctctctccttcaaatatattgtcttatgtaaaagatggaaatggagccttgtttagctgaaaaactgaagagccaaaaacatttctaactataaattagtttatgcatattaaatatcccagccttagctctaataaaaacaaaaaaaatgtgaagcatggtgtgctctgtggttattaacctgttgttgaaaccctgacttcagttctaggcccttagcatgattacttctttccttctttgggttgcatgatgcttcaaggtctagaaatgccaatgtctttcccaaggggttttaccttttacctctgaagattgaagaaagcaactgagttgttcagaaatctctttaaattagatttaaaaggtactgggtttatttttgcatgtcttctttattttttcctccaaagattaagattgtattttagaaggctcttttggctcctttaaaaagaaagtttatccttgtatcatataggactgaaggagataggctgcagtttgaaggcaagagcatctgatctccaaagaatcagaaaatctcttcttttgttgcatttgtaggtactttttgttgtgttgcttttttttttttttttttttttttaatacaggtaaagttcaaacgagcacagcatggtccaaatggtgtttaaagctgtctaagtttcctttatgtaactttcacttcaacaagtatgttccagctgggagtctatcgggctgttaaaattaactttattcttcttttgttattctcatgcacacacacatacacacatgcctacatgcacatgtgcacacagacacacaggtgtgaacatgaccatttaatcacatccagcagggctgaatgtcactctgcggggctttattgactgttgtacaggctaaacatttcattcagttgcaagacagaaaaactctgcaggatgaatttcaaaacagagagcagaattgttacccacagataagaattctttgtaaggctttcaccttctcataaaagtgttagttaagaagaggtgaaaacaggtattccattcatctctgaagtgtatgcagtaatggcctcattcggctgagatttcccagcagcaaaaaatgtgcttggcagaacagttgctctaaatacctgggacatacattctttctaggattaaacaaataatacttgctgccctttgtataaaaagatcacttttctggtgcaccattagtgtacatttgatttgatttgtttgttaagcagcaaaggtgggtttccctggagccacttacacctcctctcggtcctctttgcctctggctgtatatgcatgttcattctaccacctgatgacttcatgcttactctgtgttctaactaaatcgaatgagtctcttattcccattccttcctttttactttcctgcctctaggcattaatttgtgccatttacctggactatctgctcccacctttgactattaatatcctatttattattctatcaaagccaaagaccatcatccccatgaattcctctgacatcccactcagaatctatctctctttcctcagagcacagttttttttctttttactatcatttaaggacagttaggccaaacacttacctacttaattataagcttcttgaggatttgggccacttcatatggcttttggttttccccaaagcattagctccaaaaagaaaggttgaatgaatgattggtgagtcatcaaccttggcatagttgggactaccctttgagaccactaaccagaatttttctcaatgaaatgaaatttattccccgacaaattgactgcaccatgttagtctccttaacatcatctgctgaaccatctcttaagaaacactttgatactagatggtaaataaccactgtgtcaagacctccaagtgccctttacctccaggtcacctgtgttcctgcagcaagacacacctctgtccccaccatgaggcagaatgaggcttgggacagataagacttccagaacccagctccagcactgtggccactgtctgattaatcagttcttcttctgcactgataattaaatactcactgttaaattttatattacccttgctagtatcattgttataaccaatgtgacagccacaaaagagaattaaagctatagactgtttatggactgtcttcacttcagcacagcagggaagaaaccagggatctgaataagtactagggatccttgctcattttcccaatttggctacaaaagttaatgaaattggggccaacgcttaaaatgcagatattgttatggatacattttatgatataaatagagatacacttgtttcatggaggggtaactagggacttagatttcatttggacctatgtgtgccgagcaattggaagcatattaaaactgttttatgtgtaagcatttattgcttttgcctataagatgttgcttatgtgggaaattaagagtccagtccaatgtattcctgggtatacagcttatgaaggcatttaaaacctaaagcatatttattctgcatttaaaagtgtttagagactgccttgtgtgttaatgtgtgctgtgcgactagcactatttaaatcctatccccctgcatgcattaatgtgtgcgtcgaagggaagaagagcaagggatgataaactctgttaactgcccaatgttcaactaagatttatgtaagaaagaacagtctagtgcattaatgtgaatattctaagatagatgtttatcttaatggactcagaggtacttacaaacagcataattgctgaagtcattttacagggcatttattcagagtgattacactactcttacttttctttacataaagaattccacttaagggtttaagtgagacaggctagtgtggccaaagaatcataggttcctcctatctgctgctcagcgctaaggctatttgaaaggaggagaagcaaaaccccaaatctccattttggcactttgcaagaaattggtccaaatgttcaatcactccagttttcagatctacatgatatttgacttactttaaacctatagtcctgcaaataagaaatttatctctctggtacatggttgtagaattcaaacattagttgtttatggacttttatggaccactgaggcattttctgtcttgaaagcaaatgtactcttccagagaaactcctgttctttttttaaagttttatttttaactgacaaattaataattgtatatataggtacgacgtgatgtttcaatgtctatattcattgtggaatgatcaacccaggataattaacatactcatcacctcaaattctttgtagcaagaacatttacaatttattcttttacatgaatgaattttaaaatatataattttgaaataggcaattcattattaactctagtcaccatgctgtgtaatagatcagaatctacttctcctgtctgaaactttgtagtcttcaaccaacatctcctcattccccattgacctttcctttctcagcctctgataaccaccactctactctctatttctgtgagtttgactttttagatttctacatacaggtgagatcatacgggatttgtctctctgtgcctggcttatttcacttagcataatgtcctttagctccatccacattgttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaaaccatccgatctcatgaaacttattcactaccacaagaacagcatgggaaaaacccacccccatgattcaattacttcccaccgggttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaaacataaagttatgaacttaatacccttgttcagagaattgaaaacatttaatagtcagtatgtggaggcatttatagggacaaatggtaatggaagatgatactacaaaattacactggagtccagaggtggaggatcttgaattttaattttttttaagtctagacttttgatagtgagataaatttgaaccaacagagtgaaacatgaaaactatatttttatcctggaagtactttctagagttcattaacaggaggaggtaagggtagacagggagtctgggtagggaattttaggattcatccacataagcaaccagggaagtaggaatgaaaactggagtaacattttagagatggctttgcaggacttggtgcctggaggtgtgacggggagcaggaaggatttgttacaggaaagaggtcccgacttagaccccaagagagggttcttggatctcacgcaagaaagaattcagggtgagttcacagggtacagtgaaagcaagtttcttaagaaagtaaaggaataaaagattggctacttcatagacagagcatccccaagggctgctagttgctcatttgtatggttcttgatgatatgctaaacaaggggtggattactcatgcctcccctttttagaccttatagggtaactactcttgtcccttgatgatatgctaaacaggccatggcatttgtgaactgttatgtcgctaatgagagtgtagcagtgaggatgaccagaggtcactctcatcgccatcttggttttgatagattttggctagcttctttactgcaacccgctttatcagcagggtctttatgacctgcatcttgtgctgacctcctatctcatcctgtgactcagaataccttaactatctgggaatgcagcccagtaggtctcagcctcattttacccagctcctattcaagatggagttgctctggttcaagcacctctgacagatttaaagatgaccctgagagtttgggcttgttcctagagagtaaggacaccatagacagaggccaggaaggcagcagagggaggagttaatcaattcagtctgggatatgctgactgctcatgtttccaagatatttaatcaaaaatattgtcccttatgtgttagtctatgttctattactataaaataaacttctgagactaaataatttatagagaaaagaggtttatttggctcacagtctgtaggctgtacaagcagtgccagcatctgcttggcttctggtaaggcctcaagaagctttcactcatggtgaatggcaaacagggagcaggcatgtcacatggtgagagagggagagagggagcaagggagacaggaggaggaggcgccacccttttttttattatttaattttttgagagggtggcacgatcatggctcactggagcctcaacctcccatgctcgagcaatcctgctgccttagcttcctgagtggctgggactacgggcctgcaccaccacacctaatgtttaatttttttttaattttttgttgagatgggatttcattattttccccaggctggtctcaaacttctgagttcaagtaatcctccctccttcatccccaaaagttctgtaattacaggcgtgggccactgtgtctggcccaggctctttttttttttttttttttttttgagacagagtctcgctctgtcacctaggctagagtgcagtggtgtgatctcagctcactgcaacctccgcctcccaggttcaagcgattctcctgcctcagccacccgagtatctgggattatagatgcatgccaccacacctggctaatttttgtgtttttagtagaggcagggtttcaccatcttggccaggtgggtcttgaactcctgacctcatgatccacccgccttggcctcccgatcttgtgatccacccgccttgacctcccaaagtgctgggattacaggcatgagccacctcacccggtccagctcagactcttttaaacaaccagatctcatgtgaactcattactatggggagggcaccaagccattcatgagggatccacccctctgagccaaacacctcccaccagccccacctccaacattagggattatatttcaatatgagatttggaggggacacacatccaagctgtggtgggcattgtaatcacggtggagctttcctcatcaggctgatacccaagtcccacccctgggtattgctagaatgtcacctggtgactaatgagtgccaaaggaggagaccaatcccgtggcgcccttgcatcctctctgcttgtggttgctctctctgtattgttctctctgttatgattggctctaacttccattaagagaaaacttgacctgcagtgactgaagacaggatacattttcttaaacaagaattccgaagtttagagaacataaaactgcttaatttggctcctataataggagccaaatttttattttataataaataattataataataattatatattgtaataattataattaattatatattgtaattataattaattatatattataataattataattaattatatataataaattattttattctaatttattttataattgtcaagtttaatatttgacaatatctgagtcagcttcccagttcttttcttggctttccccccaacttgccaccttatgggcacaagctgattgctgcagctccacatgtcccgtgcaaacccaaggaagaagggaaagcagtcagaccagccaagtctttttcgttttatcaagaatagaacaagcatttctagagcctctagaggatttccttgtttagctctttgtccagagctaccacatggccacttttagttgcaaaggaggcttggttaggccggtcacattgccagctctcgcaaggaggaagaggggaatggatattgacaatgtctgcaatagtcatcttccctgctacgctgaaagcactttaaaggcaaggaccaagctccgtcaggccatacttatgtccgtgctatgccacacttctcacctggcactttgctggacatatgaagacctgagatgagaagggtttgaggagacacttcctgcccactgtgctaagcactttcttgtgtcttttgggttctctgagcagctgtaggagtatagaagcctccagatatacgttaaactctttttcagcacctctcaaaacagaaaaaaaaagcaagaaaaagactacaagctgggaggaaatctatgctgctgtaaaaatagaatagggctggagtgcattcttcagtaatgaatgcatgaaaagcagcctcttcaattataaatgtggcttctcttgtttgttgcccagtaattctgttttattgatttctgtttacttccaatcacctcaaatgagactgtgttgcttagagatcttgatccctaaaagtttgtcattaaagctactctgctgtatttagttattttttgctcaaagcatttgaatcaatatgtatacaaacgaaacactttttcctttgctccctagaagactacaagaaaaaagaatctagaaaaactaaataaagatgcttagatttttttaaaaaaagtcccagcaaatgacatattgatttctttcaaagaggcagagtgtaaattaaaaatatttttctgacacagtttttaaagatgccactgactcagcagagtttgtgcttattgactttctcttcctagagggccagggtggaaaggccgcccacttttcctaagatcagctggctttcaaaatcctttgagggaagttagccttaaagccaatgcgagcaaaggttcttgattccctgtgatcaggtctgagttccggttttgtcatctaccacatcacttctgtgtataaaaaggtgttgtaatttttttttccagaaaattatatggtcatcattctttttcaaagtggttgcattaaaacccagaattctcagaggtggaaataaacaaaagctgcgcccttattagagaatactctctggaatgttattaaatgggtctgggcagatagagaggggagttagagtgggagcatgtgcattaaaagagccacaccaatacaggaatactagtgctgtttcctcctggtacctttgagagaataaagctagtttagacccacagtcggccgggcgcggtggctcaagcctgtaatcccagcactttgggaggccgaggcgggcggatcacgaggtcaggagatcgagaccatcctggctaacccggtgaaacaccatctctactaaaaatacaaaaaaaaatcagccgggcgccccagctattcgggagcctgaggcaggagaatggcgtgaacccgggaggcggagcttgcagtgagccgagatcaagccactgctctccagcctgggcgacagagcgagactccgtctcaaaaaaacaaaaacaaaaacaaaaacaaagacccacagtcatgaggctaggagggaagcacgagggacctggtttcaggaacataatctatttgtcataatttgagtttctgaaaccatgtcacactcctttggcctgttcaaaatcatttttcagaactgttctcagggttagctatataatttgtggaaaccaatgcaaaataaaactaagggcccccttgcccaaaaatccagaaaaaaaagtgttaaaagtgctagaatagaatttcttttctctttcttcaatagtctatttgttatgttttttatttgctattgaatgacatttaagtaaataaaaatgtaaattagcatgaatattaccattcgtccttatattgtgtgcaatgccagttttaaatccagatataagagcattcagctcaaatgcagaatcattgaaataacacaatttgtatgtcatagcccatatatgcatgtgtcttttgttcttattggaagagtggaaatgccatccaaaagtaacttactgctttttgtttcacttcttgatgcatgcacattctaccaacgctttttaacttcagcctaccgatgcatcaggtagaaccaaaaacaagaggtctcttgccctgtgcaagccaagcctttctgattagcaatcctagagagaacaggtggctcacgcctgtaatcccagcactttgggaggatgaggcaggtgaattacgaggtcaggagtttgagaccagcctagccaacatggtgaaaccccgtctctacaaaaaatacaaaaaattagcagggcgtggtggcaggcacctgtaatcccagctacttgggaggctgaggcagaagaattgcttgaacctgggaggcggaggttgcagtgagccaagatggtaccgctgcactccagcctgggcgacagagtgagactctgtctcaaaaacaaaaacaaacaaacaaacaaaaaaacaaaaaaaaaacaagaagaggtctccgggttgccctatctttccctttcatgtcatcgtctttactgtaaatggttggttgatacagagacttaagaaaggatgtgataggttctcctgaatgccattgccttctctctgtcttctaagcaacttctggttcaaagggagagcatgagctcctggggatgtcagtgttcctactcagcctgtagatataacatccttacctattatacagaggacacgatatagaatccggagagaggaaaagcaaaggaggccagctttggcctgagaacttaccctagtcactcttgcctagaagacagtaccaacctcccaaggagaaacattgggggataaattcaaataaagctgtttgattcagattactcctatatgtaagtgaatccacaggatcctgtgccattggggcatcaggaacactatatgaggatgagcagcaaggaatggaagtggacacacacattgcatgtatctcctctgcttgctttcatgccgcactgttccactgaacttcacttacaaaacacaagtgcaaagataaatgattaggaatttcaagatggtaagagcagagcatacaacctaacaaagggtctttgtgagcaaaaaaccctgtggatgacctcatggatctcatgcctgtgattacacctgctacatttccaacacccattttgacagcaaatgagtgttgctgtttatgaactggaacggggaaaattattagcctcactgtctatcagaaatgagaaacaattcatctcatctctttccacatagaagttctgttgtgtttgcttttgtaaattattttgaatcaatatctaagatgggtttatctatttactactaattgcagcctgggaataaggatgtgacttctggggttgagtgggcccatctgggtttctgaacttctcaatttaatagcacctgaagacattccctacctagagattttttatataaatcatagagctttatgggaacccatcctcccacatttctctgtgggaggttggtatttccttctaggcatgaatagggataaattctcaatcgaaagctgacctcctctgcatttttcctctactgggacttcataccatgttctcaaattgactctcatttttccttcatagttctgtctcaaacttactggccacagatcacttgtaactccctattttattaagtccagtttcaaataccaaaacttgctttaacttctgctattgctgtaacacctgtctctgacttttctaacattatattacatggctgagtgggatatactttttttttcacagtgtaataaggaaaagatagccttgtatttctagaagttgtattttatattcacttcattgcatttgattgttctggataagttttctgtgccacatactaagttttgggatgtactaacatgcactcttttcttgtgtttacatcttcttgagcttgcatctctttcttagagggaaggcatgagggaggaaaataagaagaaagaaagggaaaaagggagggaaaaaagtagatttggtctttggagcttcagttaaatttcccttataatggttagaccctaaatactcaaaatgagtatttgtggtgaaaacaaaagagctgacagtggaaacacagccaagcctttctaattagcaatcctagagaggacagcaccaataagaaagaagagcagccatcaaagccaggcctttatatgtatgtaatcaacaggcatctgatctagattcttaaagatggtgtggtttgggtgggtgattttatttattttatttttctgtctcctaaataatatgtaatttcttcaggccaagaaataaattgaaaggatttagagggatttgcttatcagtggaacaccacgtagcattacattcctcctgcttttgggaaggtacattgaagtttggttaatcttctgtggttcaatactcctcttccctctgtcagcctgccttgaacaacagattaatcccttttccacccactctcttctccttcctccctcccctctctcttgatctacccttccctttttgagcaaatagaagaaaaatcttaaaagtggggggaaaaaaaaattaaactgctgcactacatttatttatataatcctagaagacctcaagggtagaaataaaggatcccaatcctcggcacaaaatttggccaagcttagcttggtttttctactgttaattaaatcttgagtctgcaaagggatttccttaaagactaattcattagcaaaagttattataagtcacgtcattctttatcctgctctagtatatgcattgtggaaaagaagaaaaagaatatgctggctattgaggatgggtagaggttttagggagtgggtgatacgatttgcttgaattcctatgtagtctgctgtctttagtgacaatgaataattactgttgggtgacgcttatgagcccaacactaattttaagattttatagctaatgatttggcaactaatcagtgttttctggtttgacttggcttaaatctcagtagtctataaagtccatgaggacaaggaccaggtcagcctggtcccaagcacagtgattgactggcacatcataggcaattaataaacacttgtcaaggaaattagtgagtgaatgagtcaatgcaaatgtcagtacaaatgtaaataaaatcatatattcagaatatttttttaattcagttttagagagctctgttccaataacctaattttggtcagacagaatgcaatatctttagctcagggtgattctctttaaagctatctcatttcatggctatatgagcaagtaagttatgcatgtagtcatatcttggcaagtgattatcttcaggagtaggtagagggaagaggggaaagtaatagctggaagaacccatggcataaaccttgtaagacagttttaaaattcacagggtgttgttccaatcgaaatacttaagctcatagacataggatacaagggtcaccttagatagtatcttaacaagactagaattctgtcccttcacctccaacattcaggacctgcttcatgagatgcccccatctttcacacctgagtatgacaagttagagtcatttatgtttcatttgatcataacaatgtcagtggctttcaaaggtaactataaatgggatgtttaatcagaataaaataagagtataggtatgacagtcatacaatcttaccacactgtgaggttgtttctgtattgggcttaaattgagtgagtgagagggatgggggagagagggagataatggcttctaacaagcttgcccaagctctatgttttttctagttttgattacatataaaaatcattggcaagacatagtggctcatgcctgtagtcccagcactttgggagcccaaggtgggtgactcgcttcagcccaggggttagagaccagcctcggcaacatggcaaaaccctgtctctacaaaaaaataaaaataaataaattattcaggtgtggtggcgtgtacctatagtcctagatacctaggaggctgaggcaagaggatcacttaagcccaaggaggtcaaggctgcagtgagccatgattacgcccctgcactccagcctaggtgactgagagagaccctgtctcaaggaaaaaaaaaaaaaatcatccagttgtatgtgtgggtattagcactgatcaaagatgagactgtgatggccacaatttagtaaagaaaatcttaatagatacatttaaaaaaaaggtcaaacttttcaaatctcattaaaggttataggtttacttagagtcaataggtattaggtaattgaaaaactcaggcagcttgtatttaaatagagaatgaacattcataatgaagctagatgggtcctctctcatctgagatattcagagctccaactccatctcagaatgaaggtatagaggggaaagaactaaaacagcaaacatttaaaggaatttaattctttttagcgtggagcagctgcagagatgtatggctgttttctgtggggcttcagaatatttatgggcctttcccttttcctttttcaccggaagaaaggagatcatcattcttgagtgtgttatttataatttcataaagctgttctgtggcaggacttattttatctcatactaaatctcaaataactgtgcttccaaggagatgggtggggaaaattgattatccctcaaaatgattagcctattaccagtgtaagataaagagctgaagggtggaatttgaagttacaaaaggcagttgggcagtaaggaggggacagagtgaaacggtcttgagcagttctgatcacagctcacagcagtagacacttttctcatgcccaataatggattaataacgaagaacagtgtagaaccattgccaagaaagggtaaaacccttctgagtacataattagaagccaatgattatagaagcaataactcactggaggaaaatacgtcagatttgtgaaacttagggaattggaaggtaaatatacccataaatttacttgggtggacagagttctgagctttcttctgtcccagctttattctaaggtaatttcaataaacaatgttaggaggaaaaaaagaacataaatgcaataaaaaatcttccaggaaaggaatacatagggctcctgccagacagatattttattgaaagttattataatacctatctttagttttatgagtcctaacacagaacaaagtaatttcaacacgtggattaaaaatatgaaatacatattttaacatgtagtagtatgaattattgttttaaatataggacttggctaatatataggggcagaggaatatttttctccccttgagaaagcaagttaaggtgcttaatatgcattgtgaaactgcattgcagtcatactcatgcactatgttctataaaccatgtgtagtagcttccaaccaaatgggacagatgacactggtgagatgcagggagtggagaaaggagagaagtctgatagggcaggacatgaaattcatgctcagtatctaagttttcaagaacaacatagctcaagtagtggtcacactgtcattctagtccatcccttccctccagtcatcctctactactagtgggtgtataaataaaccgtgttttagacctctaagcctttgcaaatactatttcacctgaaatgcccttctccttctccagcccacccgtcctcacttccttcccctgtctcaccactgcctgtccctgagggctcatttcccacatgctctctgccttcttgctatttccttccttcacacattaatgcttcctcttgtcagagcattcggtttactacatcaagtttgcctgtttacttgcctgtctcatcagactgtgaattcccagagcagaggaactgtgtcttatctatagctttatcccttataactgttaaagtgcttgacatataggtgtttgaaaaagattcattaaagtaatgaatgaatgaaaaaagcaccttgatgacatataccactgacagtaaatctaacagcccagccactgtgaaaattatttggtgggtggtcatagagtttttaaaaaatgcttccttgaataacttatagagaatattggtatttgacataggggaaccatcatacgtcagcactttaagcatagccattgaaagttatgagagctttagacaatcattgtgaggggaaaaaatgtgaagatgacattgaacgcaacttgataaacattcccaacgtaactatgaatagaagagtttcctaaagcaacactgtttcctggaggagcgtggatggtggacagttaaaaataacaattcactacaagtgtttatacccttggttacagtgaatactaaattaatgtgaattaacagctcagcacaaagcctaaatgtagccagtgtttattaagtggtaaatgttattagtaggcatgagtctagatagtctagatatccatttctttgcaggcatactaactgctctttcttctaagtaattaaaagtaattacagacaatggttgtgattataggaaaatacacagacatgcagcctaaggctaccacattttattaaaaggcagagatccaccaatttgttctacttatagcaattctattctgagtctgagtctatctgcaacatgaaacctgttttacaagccatggaaagcaatcaaagaagtgtgccttttctttcaaggttcaacatcagatcctgcatttgcttacatctgaaaaagaacacagactgaaaaagccaaaacaacaacaacaacaaaaaactgctaaaagaaagccctgggttttctgaaagtatctttgaatccaattgccattaatttaggatatgatcttaagccgctcatatcatccaaaagccttggtttgtaatgtttggattttctagatgttagggacaaaagtagtttcaaaaaagtctaagtgtagcattcctaattctaagcctttttgcaaattaaggcctctggcagaggaagtctttccatactacacagtgttctgtggcaggtgtggccaatgttgcatgccaggttcttgaggaaaacattggttaccaaaacaggcaaagagggactgagatgtttgtaactgctttgggagtttcagttggctgtacctctaagtggtaacgatgaggtctgaaagacacaaaggaaggaactgaattcatataagacccacacagattgtctagattcacagccactgagaacagatcacctttgaatgattgtttaagctctttatgagtacatttttctttatcactcctcatggcaggtgcaaccagaaatagtatgtgtaccataaaatggaagtaatgaattgtcagcaacaaagaacacttctaatgtggggtaaatcgtaacaaatagagcacataggcagataccaaatttatttaaattaggagtggctatcaggcttggaattactttgattgagaggctgatgttgattaattgtgaagttaaactatgatgttgattaatagtgaagtaactaagtgacgtgtgtgcacgcacacacacacatcccaggtcactttctgaatctacgtagaggagttgggattcacagttgtgctatgtctagggccaggcccattcttacgacacactgctggatcatttccccttcaaactcctttgagtctgggcaccattgctaggagctactggtaaaatgtggttctgttgcctgggaagaacactgtattcacatgtactcatatagaagatcaacagaaaacaaatctttgggcaaagtggagcgcagagagggttaaaggtggaaaaagggggtcagaaggtgaaagatgatgtgtggggtctgcaatggggattaggggcccattcatgggatggaattggaggtagagaaggggtgggagagtggggctggggatggtgtcacctaaaccacaggggagagaaacttagtagtatgagaggaagccaaggaagctgagaggaagacagtatcttttcaacctcagagtctactcctttttctgaaaaaaaaaaaaaaaattacatttcttcttttggcccatgcaaatgaagaagtctcctctgagttaaagattcaactaatattatgttaatgtatgttttggtttctactgaagttatgcattgttttttaaacatttgttcaatggcctttaaactttattgccaggctttcagttcttgaaaggagctcattagattttcattaactcaccagctttcactcaatactagggaccaaagtcctaccgggccattctgcaaggcccttacagtcaaatcattaataatttccagttgaacacacttcagcagtgtattctcagcctctttattaccaccatcctaaggagttttttcagataagttttccccctaattgcccttttcccacaacatttcaattccaaagatatactacatattcatttatgtaactgtggccttttggagggtcacaaaccattgtaatatttaagattgtccctcagcccaaaccaaactttcctgcctttggtgggagacattgcccctataaagaatgcatgcttaaaaactactaaacaatgattgtggtccttccaaaatagtgttttcctcttataattgccgtatttatttcaacagttaactcttttcccacttaccagctcctttccctaagtaactagaagtagagctattatagggccccctctcagcaggaaacaccaagggaatatgcttaccatgtctctaacacaaataacagccccccaggatgtaactaccagtttcagttgctggaactgaaatgaacaattcagtagtgtgtgttttttttaagtatgtttaaaaattcttttttcggtgtggagaaggagagcatcaggataaacagctgatacacgcggggcttaatacctaggtgatgggctgataggcgcagcaaaccaccatcgcacccatttacctatgtaacaaacctgcacgttttgcacatgtatcctggaactttaataaaattaaaaaaataaaaattctttttttctgctagccttgaggagcaaggtttgaattatacccctttcagatgtagaataaagatcaatattgttgtgtagggcacttctctgccattgttaattaaatcaatgaattatctaatgtggtttttccagttctttgctgtgtccagtaattccatacctaggatgtctatttaaaaaaaggatgttttctggaactcctaagtagaaaggctgtcatatatattcatttattagggttgtcataacaaaatatcccagaccaggtggcttagacaatagaaatttatttcctcgaaattctggaggctagaagcctgaaatcaaggtgtcagcagaattagtgtcttctgagaactctccccttggcttgcagatgactatctgccagcgtctttatatggccttcctcccactgggtatgtctgcgtcctactgtcctctttttagagggacacaagtcatattggattagggctcatcctaatgcttcattttaacttcattacctctttaaggctttgtatcaaatacagtcacattctgaggggctggggagtaggacttcaacatatgaattttgaggggacataattctgtccataatgtaagaccaggtataaagaagcctattgcaagccacaaacacagaatttgactaagatgtatttattcaaattcccactatgtgttttactagctgtatgtctttcagcagctcacttaacctaactgcaattctaattagtcatgtaatagtcatccctgtcccaaaagacggttgtgagaatcacgtctaattaataactgtaactaaaaagtgtgtgtgtatatatatatatgtatatatatatatgtgtgtgtatatatatatgtatatatatatacatatatatgtatgtatgtatgtgtatatatatatgtatgtatgtatgtatatgtatgtctaggacagcatctggcttgtagtaattgctcaatagaaggggagtggtttattacctcttcctcttgaatttggatccagactttagtacatttgggaattggaagatcaacaagtcagtaaatattggtcacatgaagaaggggaaataaatgagcattattgaactataatatattgagtcttcttatgcacatagtaggccaaaagttttgttttttgcataagatctgtagattcattcattcaatatttattgtgcatgcaatatgtaccaaatacagaaagcagtcatctcacctactgtatggagggctcttctcacagctgatactcagtctcctatatttcttgtaatagattccctgggactggggagtttctgcgagactcagaatttaaaaggtgcctcaagtcgaactactattattgcagtcagaactgtttttgctctcttcaggaacagccttacctgtgttcagggactattgtgtggtatcatgctactggtctacattaccaattcagctattgcagcaattacatgaaggaattcttgctaatgataaaagccattatgcagttcctaaagagaatgcattccacagcattcattaattatgccagcctgtagatgcacaactaccacggcatacacttgagaccacacaccataaggattgaaactctctcaaagccacaatgtatgtctgtgttgctttgcactcttacattgcccatcctttacaacagcccttctcctgtccttctgattcctaaaactcaaaaccagaatgaagtaaggctacaaaatgtcatttatggggatgggtgaggcttaagtctcctggaaccatcttgggtcactcagctctacggaagacccccctaagacggtctagacccagagtcattctcagtcacacagtagttaagaattcttcatcctacggtatgccctctctagaaaaataatcgtaatgatgggagatgggacacagtgataaatctttgatgtctttgttcattagtttccttatctctctctcttctctctcttcccctaccccattattttctctttgacataaacagccaacatcagatgatcttgtttcatctgctgaatgttcaagtgatgatgaagactttgttgaatgtgagccgagtacaggtaggtcaggtcagtcttattttgcttgctttcttttttcttttgcaaaaaacaatacatacatatatgtgattatacatgtgttttatatatagattatagtgtgttaatgtgtgtatatttttatatctatatatgtataagtatacatatataaatattatatcaatgaaagcatcaaatcccatggaaagagcaataagatcctacaaaaattaagtcagtctcttgatagctaacaaaaaatcatggtatatgacttaacattgggcaagcagatgcccagacttaccactggagcagcaaatgtgtaggagccagtggcagctatgaaattcacagagggtgggaacatgaggaaatatatgttggaatgacatcaagaaaggatgaacccatggaggagcttaaagattggtaagtggagccataaagattggtaaatgacttaaaactcatgaattattctgagctaagagaaccaaaaatatatgtatatatatattttccatgggatttcaacagcagttaacatggtattatctttgtactaattttgttaactgtgtgtctagaaaacttgtgcaacaatatagtaaacacaaaattagtgctgtaccatgccgtgtcaacagctgtgatgcttcaaaatgtatctactgtgctgaagttgagaagactttagcaatcagaagcttcaatgtgttccccatttggacccagatacattttgatgttttatggtctttctttatagtgagctacatatgacctaatgtccagcaggcaattgcagtccctgattatttcctatcaacttttcccagttgtctgttttgagacttactataagttaaacgtttatatgtatataatagagaacagatatcatcgaatttctgtgtatgtttaatagaattaatagctggagttgggccaggatcttatttctgtgaagactaaaataaatagaattttctagttattttttgcattgctttcagatttttttccttttaagaaaaggaaagccattaaaaattctcttttgctaattctagaaaatttaagcttcatgaaaaaataatctaataaaaataaaaaccttccatttctgacccctaaatgatttacaagatttcaaatctgttgaagcctgactgctttggtttcttgcaagtggaattggatccaggaagttctgtgggttcatacccttagtatgacacagggacacatcattaatatgatagggcttccattctggagtgtaatctgttccattgggagctcagctgtgtggagggaaagtaaatgtgatctggtcagggctttctttttcatatttttaggtaataatctgtatgtgctatgtgaggttttaaccctaaaagggcagatacatccgaactataccagaacttgggtgccatgttttcattaatttattcattcattcattcaataaatatttttgagcactcaggcaggatacaatatatctctagatttgagtccttcctattctgttttttttttttaagaaattagctgtcagagaatagaatagttttgctatctaactcctcgcgtaattcaattcaacagatatttttgagagtcaactgtatatgttaagcatgtgctagatattaagggttcatatattaataggtcacaatcctcaatacgtacattaaattagcttgttttgtggcaaaccctttaagaaatctaggctttaattttatatatatatatatatatatatatttttttttttttttttttttttttttttttttgagatagggtctcactctgtcacctaggctggagtgcagtggcgtgtttatagctcgctgcagccttaaactcccgggctcaagtggtcctcctgcctgagcttcccaagtagctagaactacatgcaccactatgccagctaatttgttttattttgtgtacaaatgcggttctcaccatgttgctcaggctggtctcgagttccaggcctcaagaaatcctctcgctttgacctcccaaatgtttttcttcctttcttagcagtgatatctctatatgcagcaatgtttatcaaatctgtagattttaaggcttatcaaaattgaggcttggtcattctgaaatattatcaccatctttcctcaactactcaccctgcctcagaaagtcatctccacagcaacattcataataaggcagtgggcttttccagatctcagcttcagattctctagctctgtagctccccagtttatgggtatatattgctatttgttatgagacttgaatagcgtaaacctgaatggccccaaactaaatccatttgttttctagaggccacgcaggtattttctctgattcagaagcagaggacagaaattcaacaccaacatttcttgaataacatggggtgggtggggagatacagtttttagaacaatctgttgtgttctgtaagggagcatgagaggagataaagtgagtgacagaacccctacctttaaagagtgaacatgtagctctaggaggctgatattgatttcctccacctgtgattattcaactcatcacatttgaagaatgagcattgcatttttctaattttatttactccataaagtattcctggtgagtgatttggatatacagggaaatacgtcagtggtatatttaatacaagaagtaggtagatattcctagtaatgcagagagagaagaggtttgcccagaggacctgatttccactaatggggattacctgcttagagctatcaagccctctttttcattacataagaaatatctcctcagaagttcaagaccagcctggccaagagggtgaaaccccgtctctactaataatacaaaaaattagccaggcgtggtggcaggcgcctgtagtcccagctactcgggaggctgaggtagagaagtgcttgaacccgggaggcagaggttgcagggagccaagatcatgccactgctctccagcttgggcaacagagtgagactctctctcaattaaaaaaaaaaaaaaaatatatatatatatatatatgtatgtatgtatgtatgtatctcaggcttcacattttccaaaaacaatacagattaaaatcagaaatcagtttcttgggcaagatttgcactgcctaaagagaagggacctactgcccatgcagcaacagataatggtgacatttacacatctttgacataaattgccaatcttgcaattctacattaccactaagattaaaattctggttttgaacaccctaattcactgcctccatttctaaaacatttttccaggccttttgcttgatggaaatacactaaatttggctaacttccttggccttgttctatcatacttactactttatcttctttcactttgccagcgagtttattattttctagctgtctccgtttatgaggcatttaacttctacaggttatttcctgattaatttacatccatttgaagctctcacttttcataaatttgggtagtttagtgtgtgctataattcaatttttattttcatatgagcatcaaattttaaatgaaataatttattttttcttcaaatcacattggatttttaaactgctggttttgagttagttataagcaatcgcctttcactctcagaacttacttttgtgcttaagggtcaccacggtttggtatagcttaatcttattatatttaggaacaaggtaaatatttttggagtttggtcaataggagtctagaaaccttgcaaatccaatggaagtcaagttttcacggtatatttttgctggtaaatatgtagagaaatttaaagaaatcccaaatcatgagagcaaggcataaagtaaaagctcaattaggatttgtcgactaaattagtttgaaacagaactttatatctctaacttcatttcccctttaacagctaaaattaaacctattgactcatttaaaatttatgatttcatataatagggctgccctgacaaaatctatatttttaacaaatttgttttagaatttttatttctttattttgagactgggtaacaagactggctaacttttgtatttttggtagagacagggtttcgccatgttggccaggctggtctcaaactcctgggctcaagtgatccatccacttcagtctcccaaagtgctgggattacaagcataagccactgtgcctggccaaaacctacatttttttttaacaaagttattctctgctttttcctatccctacctttttctgggaactagattattttataagtcacagatacaatcacattttctgaatatttgcttcaagaacccagaattgaacctttaaacaataaagttataataaaaccatctgcatcaaatgaagatattcagaagtgtatctgaatagctatctagaggcgagggtctggattttaactcgatttgtaaatgttaattgtgttcttcacaaaacaaatcagtatctaatactttagattcgttctttgcatataaactgtttcattcccaactgcacttctattaatcttaaattgtgcagtaaattcatatttcattgtcctttttctctttgaatccaagaagaaaaacggatgagctggagagcattcaaataacccctaggaaaaggataccctcatgagattatggaagccaaatagcaattaagatcattagtaaattcacatttgtaatctaaaatgtgggaatgaattctgaaattcagagaaaataatacaattcacttcccatttcttctctttcccttacccctgctgctatccctagaattcccatctttggaaatagagtaatagtgaaaacaaatgtattcttggatgagcttttgtataattagatatgatcaacttcctggattttacatttttatagtttcaagattctaaaagtcttgggggcaggaggccacagagcagagcgaaaaaaaaaagtaatacttttatacctaataagtgggcatggcaatacttaaccacattgattcatccagtcgttatccaggggtatatttttcagtttgtcaagtagctagtttttctgccttcacttttcttaaatgtcctttgatcaaatctcaagggacagcacttccaccagagggcagacagtaaaaggaagtgaagatgaaacacatccatccatcaataagactgtgctaagcagctttcataatggttgggaaggagatgtttaaactaatggcagtaatatgagatgacaaaataattgctattcccagagtggttctcaggtatatttttactcctcaaatctacaatattcacatttgcatttcggtgttactgctacttagttcctctttgttagccctactataatatacaacccaagctgagtgaaatttaaatttggcataacaccaagatcacatctagtattttccaggtggaactggattcttaatctttatcagtctgagatgcctcgggaaagtatcatctgaaaatctggcactgagttactaaaagctcaccaaatcattttactttttatttgctggaacatggtagaaaatgcagctgaaatgttaatagataataataattttccagtgaaggatcaagagaagtttataccagaatttatagataacaagtaaatgtgctgattgttggccttaaatatgatgtttgaaatcttatagagatacgttttgtcatttgtgtctttgtcaagtttgaagttagcaacctgtatgtttttattacaaataagtcaattttatttaactatttattcactttagatttttctatatgaaaactcattagcaaatagaatcatgttaaaatttcattagtcaatggctattcagaatatagtacaaaaataaatgtccaagtaaaatctcataggaatgttggagtatgacagatctataaattcaatggtctgtaaatgctataaattctgataaaaggctcagatccacttaaacactttgaccaaagagataatggaaataatctaagataagcattttagctttggaaagagaactgtatatcgatagaaaattacttaatttaattcattattattggctgtggacatcagtcattttaaaatttgagttacaatacatgtctaatgctcacaaaagcaaatagttgttcacatacttaggtctaggctaaatcatatccatttttcaaccgccttcattgatctataaatgaatatagtatgttcatgggagtataatgttccagattaatgatacagtttttgtctttgttaacccaccaagttatttcactttcttttcttttttcttttttcttttttttttttttttttgagatggagtgtcactctgtcgcccaggctggagtgcaatggcatgatctcggctcactgcaagctccgcctcgtgggttcacgccattgtcctgcctcagtctcctgagtagctgggactacagacgcccgccaccacgcccggctaatttttttctatttttagtagagacgggttttcaccatgttagccaggatggtctcaatctcctgacctcgtgatccacccacctcagcctcccacagtgctgggattacagccgtgagccaccgcgcccggccagttatgtcacttttttataacagccccaacccaacccaagttattttttaaaccattgcagtaactatgtgcttttaaaatccttaatggtgaaatgctttgaaaattagggtaagaacagaaatataagaataggaaagatctactaattagctcttgcactttaggctgaggaatagtgtgcataatatatgtggcccatagatcgactattgtggatttcataacaaatatatttaataataaaaaaatgaaaaaaattctatccaactccattacccaagattttttagtaggttggagagcgaggcaggggaatccataaaatcaatgtatgagtgtatatacttctatctgaaagtttgataaatctcttctatatgtaacacttttgagtaactattacatgtaggcactagaataggtgctgggaaaacaaaagtattttgcttcagaaatatcgcttccagaagttcagtttattaggaaaggcagatataataagaggaataaaaggaagggaagaaacaatgaggacaatgaatggaaatgcccacgatattatcagcaccctaaggatgttggagcactccaattcagtgaacagcataccttatcagggatatgcaagaaaaaaaaaatcacacaagatgatgccaagcagtgacagattcaactaaccccaaggagcattcttctgtattttagtttggtgacacagaattctcatttattacgattgaagaattagtacagttcagtaaagtaaaaaagcaacactcttttggaattagtacagctcagtaaagaaaaaaagcaacactcttttggggacttcacatatacagtatggtcaaaggccacaccgtttttaggtaatagggtaaaggatggacatgttgaagggagaatttcaatctgaactcatgagaacttcctgattccaaatgccaatgcaagtggtacataaggagtgagcttaatgacatcattaagcaagtcccccaaaaataaataaagagggattgggttttaaaagagaagtttttatgggatttattctttttattctacatttttcttccataagccccaagtatatgtactgtgtgtatatatatatatatgatatgcacatatgcaaataatatactgcctgtcactccatatatatgtagacacagtataagtgatattagactaatgtaaccagagattaacagcccctaccatcagtcatgtgtttacacagaaattcacaccatcattcttaaccagcatcagccaacatagacatgcatgatactgttttaacttggcaaacaaagcatgttgatttttctttaagatttctttatcataattataatgctgactccataattcagttatccttgggaggggtggaaagaaaaaattatacagatatatctatccgtatatgcacattcctgtgtatatatataaatagatatataccttgtatatatttgaagaacattttgttgtttcacctcatcttgtgccgcatgaatttttggtggttcaatttattttgttttcatatttactattttgatcattatggctatttttaactcattgctatacttttatgagtaactataatcattattttcaaatactgagagatatatagatatacaaatcaaacaaggcaaaaaaatcttttcttgccatcctaatctcaaattcctcccctttcagcatatccctccagtatttatctcaaaacaaaacaaaccccaacgaaatccaagaaagttgtgtacaaaagaatgaatactgtgttttcctcttcctccttctatgcatatttttccttttaatttccgtttctttccttttgatttacccccatatctgcatggaccacttgcctttactttcccctttatgacaatgtaattaattgaaaagataagagtcagaaaaaaataaaagaaaaacacatagaaatgacagagaaacacacccctctccacaaatttcagatggcataaaaagaattttattgcagatatagaatatttgttgtatcttttatttctgtctggacaagcccaggatcattgtgtggcatgccgtgacaagttttgtagcgcatcaactaaccatggcctccatcacaagtgcatgacaccatcttgtgtttcatccaagtgacacatctaggctaacccagcaagtccagtgtatgagttgtgggaattacattcttttgtagttataatttcatgggtccttgtttttattattatttccattggatcatgacagccctaagagctgctctcgcagcatctctgtatggttttgttcttgtgttttcttttcttggcacagcagtcaagcatgtgtctcttgtttggcacatctgtcttgccatcttgtcttgtccactgtcgtggtgttgttctgtgattctgttctctgtaagatgtgatttgaaatcctctgcctttatttctcactctcctattgtctctacttttaaccttacccctagggaacttcacaaagaagcaaaacaaactttcagtcacattataaggctgatcactggtttgcatctggaagtcataagttgtactttttacctgacttaaggaggaaaaacttacagtgggaaactactgataattatactcaaacagcaaactgatcaacgacaataagaaacccttgttgattatttttggtatgattaaatgggcttactgttaaagggacttcatgtaagatcttatttccaaagagtttttttcataaattatcagtcttctagtcagaaacttttcttcaggagcagatcaacggaagatgtttttcgggaattgttagtgagggagcatcatttctgctgtgtagaacagtgcctgttcctgaattggggaggaactttatggaaatctgcaaatgttttattacaaaatgcatttatgtttatgtattaaaatataaatgtgttcagcaaggcatctgaggatgggaaaaaaaaactttttaactcactggttccacctcatgcatattttgaggtaagattatcttttgatctttctgagtcaactgatatacattttacttttttattttttaattcatggaagcattagagagccaacacttcaactttgacctaaattcattcttttcccattccagagaacacgacatacataatagctttagttctgagaatagagtctgaatttgagacaaacgtagaaggaagtgcccagttaattatccaaatgttggactctacctgtgattatccaggcgatttgatgctttacttggaaggatttgattagttggatacgaacagcatgaaaatgacactttgtaacaactttccctctttaagggttgagcacgagaatatcaaataggtataaaaatgagtaataggtgatatattaatagattaaagattattcaataggcctaaagatttcagatgaaaaatctgtatttgtaatctgaaaaagagaaagcatatccagacctgtggttttctgatgagatctttcagtcaggccagggtagctattggtttttcttaagggtaaggggaaaaaggccaaggatgaggaactggatggctctgtggactaagaacaactttctgatgaaagaaggaagggaaacaagaaaggcgaagaaagaggaggagggaaatgtaaaagaaaggaaggaggaaaggaagagatattgattatgagccaggtaaagctgcttgctgataaatattttaaaaccagcacacacacagagctctaatttgcagttttccagtttctgtatggtgtaaaatattcccaccatggctgatttctagctaccaatatgacagccctaaactcagaattgggaagtgtccttgctcgtacacaattatatggctttttcatcatacgtacactatagacgtcaagaacctcatagataatagtaaaatttagtaaaataattaggaagtaccgagttttaagtttttaattacctgtttttaatatacttgtaactttatatatatattaacttttgaaaatggccatgttttaacaaccagcttacaaatttcctagaaattttgcaatcagttgtcataaactggctcaagcacaccactagcccaggtactatactgggtacatgaaaacatagtattttatttaaatctcattttaagttattgtgagataaaaactagcttggtcatcttacagttgagaaaattgggattttaagtttgcttgttcaaggtcacatacctgcacataaatggtagaggtaatattcaagtccaaatctgtttgaaaatagacattttctttatattacagtgtgccagtcattctttcaacacttctcaaagtactaagttatcgaattttgacacgctcctttgtggagcttagcatgactcgggtttccctattgcctcaaggaggtccttggctttaactgtcttagataaaatggagtttaaatgtattatggttgtgtcaatggcaaaatgaagacagtgaagcaaaattagaactcctgattactctgtttgtaaatgccaccaaagttatgaccatgtcttcatgagaatgtccactttgactaattttgtttcctccaaatattcctcttttactaacattgacaatgaacaggatatttcttaggttttcatattctgtcccttgagctttggaaagactatcccagatacattttctgagcacatagaatctatagcatgatcccattacatagttaggttttataacttttaaactctaatgaattttatttagttacagtatgtaatgcatgttaattaaccaactgcacagtgaaatatgtcaatgtcctttgcttccacattttctaatagagtaagctagtatattaacatttaaaacagcatgagaaccatagtactgcagaaagcaactgcagtttttaaaaagatgattttattgtaagatacttaatcattgctctgtaaaagagtttgagaggcctgggaattaaaaaggaaagtgttgcagctttttagtccttctaatttgacaagatagataatttgattgggtttctgatagtgcagtattttgctttaatttggtgtgaagtttagttgcccccataattattattatttttttttggtcactctgtcacccatgctggaatttagtggcatgatctcagctcactacaacctccacctcccggattcaagcaattctcctgcctcagcctcctgagtatctgggactacaggcgtgtgccaccatacccagctaatttttgtatttttagtagagacggggttttaccatgttggccaggctggtcttgaactcctggcctcaagtgatctgcctgccttggcctcccgaagttctgggattacaggtatgagccaccgttccgggcctccctatatagtaaactttcgatggcagcatacacaacattgaataaagtcctttgaagtgacttctaggctttctcctataggtttgccactgctacaactttgtttcatcattcagtgaatattagcacttcctttagtgaaatatagtcttaagtacttcacattgttaactactttaatcctcacagcaatcatgtgagagtctattcttattatctccattttaaagataagtaaatggaggcacagaggagctaagcaaattatcaaggtcacacagcaaggaagtagaagaaatgggatctgaacccaagccaactgcccccagcgtggacacccatcactatgctatcctgtctcttacgtagcgcttattttccattaacctaaatatacgaaatagctgccggcctccttgataataaaagaaagtctgtgtattgaatgtattacatggttgggaagtagttgataaatgggttagttattatgtatcaaaaaggctttaacaatcttggttgatgggggttataaaattgttccattatgatttattcaaataaccgtggttaaaacaagttaccctggtttcccataaggaggaatgactccaatattggagagaaataccaacacttatgtgaggtgagtctcccttgatgtcacctatgcaataatatgtgcacttgggtttttttttttttttttttttttttttgagacggagtctcgctgtcacccaggctggagtgcagtggcgcgatctcggctcactgcaagctccgcctcccgggttcacgccattctcctgcctcagcctcccgagtagctgggactacaggtgcccgccaccacgcctggctaattttttgtgtttttagtagagacggggtttcaccgtggtagccaggatggtcatgatctcctgacctcgtgatccgcccgcctcggcctcccaaagtgctgggattacaggcgtgagccaccgcgcccggccgcacttggggtttctagctcattattcatgatcaattctgttcaaaacatatgcccagacaacagccacctttaactgatgttaggaatctaaggatagaggctcttagcgagagcttgggttaagatactgcattttctttatttcagaaataaatatgttccttagaacacagtgatttaggtgttacagctaaaagaaagcaaaaaacaacaacaacaacaaaacgaacttgtatttcttatcttagaccctttctgacacccacatgctcttgacatctcttaaagttgtaactatttgtttatcctccctttttcctcacttccttgcattatgcatccaaaactattttaaaagccaaaacacacacacactttttgtgggtctttgagtttcctatgcaagaaaagaatcttaaaatgagttataaagaactaaaaatcacaattaaaaaggaaacataattttaaaactgtgtttgcttgtattataatccttattccaaggcaagtatggcctgcacaaacatctgaggattccattacaaattatatcagtctcaacccatcccgaatccagatcataaactcataaactggaaaatgtgtatagttgaaaatgtttgcataccctctgtcctagagcagtgcttccatcttagctttgaagcacagagacctcctcttactaaaagatcatgaaaactggcaatactgtattgcccagtgttaaaatttgtcagattaattacccagagccaaagttagcaaactttttttctgtaagggctggggtgtaagtattttacactttgagcgtcttacagtccctgccctatctcctcaatcagctcttataatgacacatagcagccatggaaacaaataaatgagcagggctgtgttttcatgaaagttgatttccaaaagcagagatggagctggatttggctcagaggtcatagtttaccccaatctagagaagtcccataggttaaaaatgtgtagtctttttttttgtttttaatagataagaccttcttgcccattttatagtcgttcccaacatttgttgagttctccactaagtacatgagaccacataggatacaacaggacattaaaagcttttttttttttttttttttgagacggagtctttttctgtcacccaagctggagggcagtggcacaatctcggctcactacaacctccgcctcccaggttcaggcaattctcctgcctcaaccgcctgagtagctgggactaaaggcgtgagccaccacgcccagctaatttttgtgtttttagtagagacggggtttcaccatgttggccagactggtctcgaactcctgacctcgtgatttgcccccctcggcctcccaaagtgctgggattacaggcatcagccaccgcacccggccctaaaagttcatctttaaggacatttcccacctttgttttagatatgccactatctcagacatgaaacacaataacaaactaaaccagggtcatctccacccagcttgtacactacatatttgggtaggagcttaacgtcttgcccttcgctttgccagtgtgtcttctgagctccccacctctgctaggtgtgggctgcattcacccccaattttagacctctttggcagtagcttccttgatctcccgcccacatactgtgtcatatcccagtaattcttccccaaaccttggctatgggttattgagctgacaaatgtctaaatgactgagatacgatttcacaacctgctgagagcctcttctttccctgtactctttgatttgtagctttgtaagttttgtgaggaaagtgggaaaaacattcttggtgacacaggcagtgaatgaggaggacacaatggagtgggcaccatatctaggactcctgcctgcattgcgagcaaaagcatgtatttatatcttagccctctgaatgttagaggtagcagattatacagtatggtgcaggaaggagcatcctatgtcctgaggtgaataacgtgttctaccacctggcagcagattagaccagatcaggctatgagaatacaggttcacagccagatttagtactaccagccagatttagtactactgcaaaaatggcttttccttaagaagtttttgtttctaacttttattttaggtttatgggtacatgtgaaggtttgttacctatgtaaacatatcatgcggttttgttgtacatatcatttgatcatctaggtattaagcccagtatcaaaaaattatcttttctgctccctccatcctctcaccctccctgctcaagtagactccattgtctgtcgtttccttgtgttcctaagtcatcatttagctccaacttgttgagaacatgcagtataagttaatgcttactctctttaacatctttcacattagaaatctatggagaagaaatatgaaagactcatatataaacatggggcaaaccatgaagctaaatcttaatgtatcccaaaccccagagggagcataaggttaactttgggtggccagggtgcttagtgataacattatgagctttctacattagcagggccccctggtgtggttttgtgcctggagatgtaaggttctgaactacaaaggaagcaaacaaaatgaagagatgatgcaaggaggcaaaaaagatggaggcattaggaaaggctttgagggcaggaggcacggggtcatcttctaaaataacctattggaatgcatgttttaataagctttgaagatcaaagagattaacaagaacaagaggaaaacaagggtaaattaggcactattgatggcctgacaaggacttttttctccctttctgcttacaataacctctcattttaccatgtggctagttggtttgtttacttgtttgtttacacttactcattactagctttccctataaagcaagggaaaacactctgtccccaggggccagctgcataacatgaatagatgaaatagaccagaccagatgcaatctgcagtcatgggaactctgaactgaagagaacatgccctcatttaaaggcatccaaatgaaacattttaaaaacactaaaataaagagaccccatgaaggtcaaacaaggcataatgagacacacagtgttttttattcttttgtttcttaaattcctttaaatatagccctttcataaatttggcaggatgtgctctcagtaaaatttctggtttagtaaactcttggtgacattatcaaattaaacagcaatcccttccaaattcccctaaagctaagacctttttttttttttttttgcatgtctttttttctctgataatcccagagtttatataacctcaaactataagcttgatgaattttagagttcattgtaatgcttttggtttaggtgacaaaactgatgcctacaaagataaactgatttgctgaaggtcatggacctagtctttattggagttgtaattcaatcccaggtgtcctaaatctttaatccatgccattttattgatattatatattaagattttttttattgtatatccaaagatttctattttaaactgagataacatccaacagagaattcagaagtagtatgaaattgattatcttccctctactggacattgttgccatacaagacgatatcattgacccacttagggctcaaatatacaactctgtattattttagtcacaaagggaactaagagattatagacaagttgtgaagcagttagtggggactggaagtctcctgtggcacagactcaaatatatgctctagtgatgtgttctcagtcatgttatctgcccacacagaggacagattaagcaacctagagtactggttcccaagctcgaatttaaaactagtaccagtctatgccaaagctttcagtgacccatagtgaaatgagaaaagcaaggacaatatggtgagtctgcacaaagtcaaacttacagaactgccctatatttggatactgtatcatgtttttttggatggctaaaatcaatgtcttttacaaaagcagcattttgttactatgtatagcattcttaatcagcaaaataaaggttggcaatggtatgtcagtccttccctacagtttttctttgaagtttttttctcaggcattgaaaacaaacatccgaaaaagcaaaaaaacaagagttttaaagttttaaagtgttctctatgttgccacattagattgagtagatttcaaagactgaaggcctttttacatgtaaagttttattgtgaactaataatgatgatgttaagacccatctattttattgaggtcccaggaagttactagtttaagcatccgtcacttagataacaagcattaaggtaatttttaatttcagttaaaaaaatagattaaaggcacaaaatagatttccaaacaaacaaacaaacaaacaaacaaaaaaaccaaaaaagccaccctaggataaatataactagaaggccaagatcagtttagaagtctacttaaagaaagacagaaacttctaaggactgtgtggaaagataattcatgcctataaaaaagtctctgtgctaactctagatttttttcactgtaagccttgtaacaaaggagagagagctattttggaaagctgaattagcctacatttgagctaacatgatccatctttgtgtcaagagaaagtcaaatattatagtccccagccaaaataaggcatgtgatctacatcaaaggcaattcctgaatgtgtatctacgtcctcatcccctctcctcttttttgtctcttgggtaatctataccaataacctcctgattcatgaaatttattatctaaatattgaaaatattacactaaatttagcctaataaaaattcatgccaaatttactgagtatttattggaaatcagagacttaaggtcctgaatcaggtgtaagaattgtattatcaataacagacttaacagtgattatctctaggtggtgaccgatattttgataatcatactccaaaacatctatgtagaaattgggcatggtggcgcatgcctatagttccagctacttgggatgctgaggtgggaggattgcttgagcctgggaggtcaagggtgcagtgagccatgatcacaccactgcactccagcctgggcaacagagcaagaccctgtctcaaaaaatgaaacagaacaacaacaaaaatcgatgcagagcatgtattacatttgtaatcagagagaagggatatctgttatttcttaaaatatagaagagtatactaggagaccagcaagggaaatgttttaatatttagatacggaagcttcgccagacccgtaattttttaaaaatagtgaatcctttttcctgggttgaattatgatgtatggccctgcaaggaaagctgctggaggaattcaaagatgatgatgatgatgatatgcagggctctatatagcttaacacattagttccataaggtcagttctgttcatcaagtgacaaattgtccatggatacaccaggtggtaatgcagcagcagtgggcacaagctatcctgtaaatgacccattaccagaaagtttaaaatttctgcttggaacccaggaacacagatggaacacgaagtggctttcaccagagtcttgggaatatgcttgatcctttaaccccagcttcaggtgttgtgtacatacttaatgcctgaacagttctcatctgtacatctgctggttagatgaaaagatgcagttgcagacaagtaatttaaaactttacattcatgtctctctacctccctcttcctcttctgtctctccctcgataggatgtccagaaaattaaatcagctgcagattaattgagactctcttccatgtagggaacatctgtcactgcagctacaaagattatattaatgaattaaaacatttgattacctttaatccaagagaatgcagcagtctctttagtcatttagtttatcagggttttttgatggtttttttttccacgtgcatcttacgactatagtccacccctgaagctgtgagatctttcagcagatgttgttttccatatctttaccctttccgttgtggaagggggaaaaagccctcagaaaagcaattttggaggaggcagaaaaggtttccatcatgaacatacttttagaaacagctggtaaaacaaatggtccaagtgcaatgcctggagcatatctattcaaacaaggttgtttaaagataaaagcacccacttctaaatatcagcattagtagtgatttcctcacgtatatttaagagatggaagagcttgtgaagactttttgatttctattttgttttctgagacttctttaactcttttggttttgttagtatttgaatttatcagaagctgctcaaattgttaaaactgtatcatcatatgtaaaatatataaatttacatataacggatgcataaagatttgctttcttattctaagaatgttcttatttgataacatctatgcatagtccagaagattgacatgaaaaactgataatgtacttaggtattaccaatcctataacccaatttgtgaaaaggtcaggcactcctactaaagaacaaacgtttgtatttgtagcatttaaaaatctgattttattttgtatttgctacatttggagtcaaccttatcccttcccttctaatgacttcatttgtttaccaggctgttttgttctgcatcctctgccaaatgccattacgtaacttcctttgtcagaccaattggtgaaataattctttgtgtgcttttttttttttttttttttacggccgtccaattttcaaattatatgtggattttctgagtcaggcattgcacaaatgctgatttgttagcttgaactcgataaatgtgtgttcaccctatcagttgtcattcatgctgacttcttcctctactctcttcactctgattctgttttcatttaagaaaatttcagaagtagtgaagctaggagagttaatgagtagccacgttgaccctagtaggatcttacccattggagaaaagccctgttttaaaacgatgcacaaagaataagcttcaatgtcttcctctcctcaaccccagcatggagcacaatgcttatgtgatacacggaagtgagaaatttaagaagtgcttcactttaacttttctcaataagtaaataaaactgtcttttctagagtccaacacatcccaaagtgtgtgactttgctattttaccttaaactgactactctctgaatagattttcatgttatatagtctgagacttttctttccatcctgctggtgctggaagacatgatcataactactcacaacccagatcttaaaatatatatattgttacacttttatatacttgtattaaagcatcagttagtaagtttcatggttgtttcttctgatgtaaaagtaactgtagttatagatcctccagcacatgtcacactgaaaacctaatcacaaagtcaaaatatgtgcataaatattagcttgattatgtgtcacatgtaccccaaattacacatatatataccttcctcaaagattttttttttgtggggggacagtctcactctgtaatccaggctagagtgcagtggtgcgatctcggctcactgcaacctctgcctcctgggttcaagcaattttcctgcctcaggctcctgagtagctgagattacaggcacctgctaccatgcccagctagtttttatatttttagtagaggggtttcgccatagtggccaggctggtctcaaactcctggcctcaggtgatctgcctgccttgacctcccaaagtgctgagattacaggcatgagccgctgtgcccaacctgagattttttttttaaaccttggattttcaaataactttatagttggagaaaagttgcaagaatagtatatggaattcgttatgtccttactcaggttcaccagttgttaacatttgccacatttgctttaccattctctatatgtgtgagtgtacatgcacacatgagccatttgagagtatgcatacaaaacatatttatgtagatatgtatttcccctgaaccatttgaaactcagttgtagtcatcattccttttttaaataattcagtgtgtatttcctaacaaggactttctcttacaaaatcagagtacagtgatcaaaatcagtaaatgtaatcttgacacaaaatctcacctagagtacatattcacattgcaccagcgtctgcataatgggctttgggattatttttttcccagtctgtgatccaatccaagatcacacattgcatttagttgtcaagctcaccaacttttgaagcatcttcctgatacgttattttatttccccatttgtttactggtcacagaccagtaagagcaagtaaacttcttaaagtcctgccaggtgtgttggtgtagaagcgggaagatagagcctgtgcttcagcacaggaggaagatttcaatttttagaattaaaattatggcaaggaaggacctgtgtttcatctagtattcattccttagagagcacggatataatagtctgacaatgctttttattagtgttttcacttagctgcagattgagcatttactgtgtgctaagcactgaggatgcaagagtaagcaagaacagagatggcccttgtgggcctagtgggggacactgtcatgtaattaagtgacctccaaataaatgtgtgatgacaaacgttgatgaaggctatgaagcaaaggcacttggtgccatgagcataccatggtaggacaggtaacaaggcaggggtgggtgctaggaatgtagagaaggatgaggaaaccttctctgaaaaaaatgatatttgagcagaagagtgtgaaataagtgacagctaagaggaagaaaaaatgcattagagcttgcaaaaaattctgaacattagaaaaagtcagccatttctgggagagagttatctgggagcagcaactgtctcacaggattttgtccaaagtataaaataaggaagtgtgttaggctattcttgcattgctataaagaaatacccgagactgggtaatttataaagaaaagacgtttaattcgctcagagttctgcaggctatataagaagcatggtgctagcatctggggagcctcggggaaactacaatcatggcaaaaggtgaagggggaacaggtatgtcatatggccagagcaggaacaagcaggggtggagatgccacaaacttttttttttttttttttttgagatggattctcactcttgtcgcccaggctggagtgcaaagtcgtgatctcggctcactgcaacttccacctcctgggttccagcaattctcctgcctcagcctccccagtagctgggattacaggctcatgccaccacacccaggctaatttttctatttttagtagagacgaggtttcaccatgttggacaggctggtctcaaactcctgacctcaagtgatttgcccgccttggtcaattaaagtgttgggattacaggcgtgagccacagcacctggccgccacaaacttttatatgaccggatctcactgtcatgaggacagcaccaagccacaagagatccaccttcatgacccaaacacctcccaccaggccccacctccagctttggggattacagttcaacaagagattcaggcagagacaaatattccaaactatatcaggaattaagtaggctttgctgtccttttgcagctttgagtcaacccatatgagagtgaattctccgatcctgtactgctcctgggaggaaagggagtgggctttgtgaaaaatggagatttagtgagtaaagtgatgagttcactggaggaaggttggctagaaaaaaagtgacatggctgggcatggtggctcacgcctgtaatcccagcactttgggaggctgaggtgggcggatcacctgaggtcagaagttcaagactagcctggcaaacatggtgaaaccccatctctgctaaaaattcaaaaattagccaggcatggtggcaggcacctgtaatcccagctactcgggaggctgagccaggagaattgcttgaacccgggaggtggaggttacagtgagccgagatcacgctctgcactccagcctgggcaacagaggaagactccatctcaaaaaaaaaaaaaaaaaaaaaagtaaaattgtctttttttttttttttgcgtaccaaatcctatcaatgaaagagacaggaatagatttgactggaatagtcatgggagccatttccaggctctcatagtcttagagatgacacttggtagttcagtgtcttattgtgcttcttcaagcacatacagcctgattgagagagactcaagacagcatacaaattctaggcatttttacatctgcctagctgtagtgaattagtcatacaataattatttaaagaaagaaatgtttcctccatgttgtgctggagatacaatggtggagaggaagtggagatcaactattgatcgatttataatttacacaattccacactttggagaaaacacattccttcttcctcaccatcaccctcaccattataattattatcaattaacttgttcaatatgtaattttgaagttgccaatcatttaccagtgtgattcatcatgttaaaaggaaatggcttttacattattaatattctgcaataaaagtttgggtttgtgtgcttacagttagaataaaagaaaaatgctttgtactaagactatgttaataataatgataataataaagaaataacactttctccagaaaggaaatttcaggaaatctgtttcagaatacctgtctctaccacaagagctttctaagtcatgttttgattgctaacagcattccagtactgggttggaacatatgtattccttctatcaactgaggaacagcaggttttctgttattgcccatgcatggtcactctctgcttataaaaattcatcacttctgctgattgcattgtgtaggattcctactgattaccatttagatttgttaagtgacatagcacattttatggagtcaggagccagtaaccatcaaggtcaatagcagcaacctgaatcagttataaatgaattgtttaattacccacgcatgatcaatgtgtgcactgccataaaagattagttctagtccctgaatgtgtgtgtgtgcctgtgtgtagttctaagggattacagacttctctgaagtcttcttcattgaaagagattgcaagtgagtatcttttcagtggaatagaactgagttatggtaacaacatcatctatacatccagtctaccgtggccactgaatccaatgacttttttttttattaatatgaaggtgcctgcctatccaaagcactgcttactgtatttcattacaatgtattgcttcactcaacacactctgaatagagaagatatgctctacagcttcaaattcaggcacttcctccaagcagagcttgtttatctgtctgcaacacacttggagcatttgaaagactagtgatgaaatccattcatgctgtgaaaatgtgttgagcatcatggccgcttcctttacaatggcctggcatggaaggttggagaaggccattgttaccatataaatgactgtctatttgcctctggcatgacttgtccagacaagttgcatcattttaaaatgaatgaagttctagggagcatttttaactatagtaccttagttgtaactttgagagtttttaataagcttgcaaggaataaatttggaatctagagtagtttgttctatttctggaaaaaaaggaatgctttgtacatatgtaggatcctttacctggccacagagtttggtttgagaagtggacttgactctggatagtgaacaaaatgctttttcaatttttaaaatggaggcacctttttttctgagagcatagtcagtaactccccaaatgtgtgtctcttgtgtgatagaggaaccaagtaagagaatagcttggtgtgtgcctggttttcttccacaagtacccaattagtaaagggggcttttgctttttacaaagcatgaaaattaggggttgcctataggcctgagagccctgccagacagttgcctaatgccaccagccaggattatggaaaagaagccttggcatactattcaatggcaccgattcacccaaattgcaactgaggaaaacgtgttcatttttcaaatagagtttgagtaaccatagacacaggcaaagtaatctctccatttggtcacaatggactaaactaccttgttctattgtctaccttctctctcactgactccatcaaggcagacttgttcggtaaactattcaggtgactttgtgaacttttatttggtgcaaggctctgttaatagctgtaagtcagctgtttttggtcctccctctcattctcttcacactgattgatgaaatgggaaacaggttgaagaagctcacttttttagatgacaagtattaagttgacagataaacctttaggaggttccagttcatttcaggaacgtgttgacatgaggtctttaaagatcgacagtcctattagagatagagaccaccaggaaatcataaggaaaagaaaaatgaaggaaatatctagattcagtaggaaattgggggtgatgagagaattttaagaaaaacgcttgctttatcaccagctgtgtcattttgttcaaagggacaggaaacataatactctctctgaagcttaacagaactgcagacctattgccacagttttctcttttgcataatcttgtttagtcacttaagagctagtgagtgacagatttcacatgagaattggtcacgtacaagaatgttaatgcagaactaggtcagattatggcatttcacacatgcaagatgggaacacgcttcctctggttagacaaaggcttgacgattgcccatgcatctggtcctgctttaaaggaagctcatgtaatcatgagaactcacaatgtatccatagatttcttagatatcaagtttctatgagccttggcattgtgtatggttttattgttattttgccaaacgagggttttctagcttcacttagtatgcctggagaaagctattttggttcggcccagctccatcactctaagaaatgatgaggatgagcgctctcagtttgtaccgactactcatgagagactaagaactgatcatctggctgctggcaacattccactgcaacagctaatacagtgttttggaaagatgccgacaacaaccagattgcattaagcactttaccgtttaagatcagttttgcagttcagaacttgaagtcagcagcagatctaccttttagtttgcagtttactttgctccgagtttttcatgtcttctgtgagccccccacgtttatctcagggtggattctaacacacatatgcttatgtgaaaatttcataatactttagtatttaacaggcacttttatataagtcaattgatttcaggacaccccctcgccgccctgataccaaaatctgcagacgctcaaatctcttacataaaatggtgcagtgtgtacatataacttacacacatacttctatataatttaaataatttctagagtacttataatacccaatccaacatagttgttatactgtattgtttttgtgtttttaattgtaatattttcatttacctgcagttgttgaatgagtcgagggcaggtagatatggaaagctgactgttactacttcccttttacttatattacaatattatctatgttagtgatgttcatagttcaagagacacactaaaggaattacagtatggagtgtctcctaagttgcattgtggaactaaacactagagacaagagtcgagccctggctcaatagagccagtaataactcagtgtctttatgaccctgagccggtgccttaaattctctgcagcgtagtttctttaaacggtggttctaaactaaggggacttttgtccccaggggacatattgtcaattgtctggagatgtttttgattgccacaactgggaagatgctaacggcatctagtgggtagaggtcaggggtgttgccaaatagcctacagtgctcagacagcccccaccacagagaattatcccacccaaaatggcaatagtgtagaggttgaaaaatgtcactttaaaatgtaaataatgtctatcccattatcacaggattcctatggggctcaaccccacattttgtttaaaaaaagtaaaaaaaacataaattgcccttctatgtctgatgttactactatggggcattgcacatatggacaccaaacttttcccttaaaaaggaaaatggatttattcttttagattaaaagttataaataaagctatcagattaaaatatattaaatatatccactgaatcttggtttgtaattttatggttttaaatgaatgctctaaatataaagagaaacaatgaaaagttattaagtaggagaaacctactattcagtgactaatatagataaaggaaattggaatccatgcaactaatagacttttctattagggtacagccacagcacgtctttcctaatagaagcaagcctgaaatgataagttgtttggatcacattaattaacattcagctctattagatttgtacctgaggttgggttcattttactggtgctgatgaatatcaaactacacaatatctacgcacattatattagaataaaacatgttttacattgaaggcaaattttagattcgactcttaataatggtcttttatattaactcagataactagagatagtaaaagaatgaattaaaattccagtgagccaaactacaacattgataatagtaatgagaattaattctgtgttgattttatggtgcctttgcctcgtaggtatatataactctggagtttatgaggcatgtttatagatcttaacttcttaattttgtaatgctgtcctcttaaaatttttgcttgagacggacaaaacctcctgaatttcttcaatttacatgggcatttttactaggaaagagcatgcagccttcatcagattctcaatagggtttattaacaaaaaatgttgagaaatcaccttaaaaggcaggcagctcttaaatgcttgttctcactgaagtccttctaaaatgatattgcatggactctatcagtctcttagcagctcatctgtagaggtaccaactgatcaaaaattcaaagttcttaattgacatactcaggttttttaaaatttaaagatccagattggtagctcagccatatagctaaattgaataattatgcaaatgctgcacaatatttaattggaccttttggaatgaaaataacccaggtgtgcacaattctttgcaatctggagcaaccattctaatatatatctgcaagtgacaacatcttgtatgtaaacaggcagaggaaaagagttctggctgccctcccaggaaaatatacatgaaagaacgtttgtgttacagcatttgtgttacagcacatacatatttctgagttgtttgttattaaagtcccattgtatgaaaacaactatatagacagactggcaatccagagagttggtagttacataaacaggtcccacggctaccaataatattaacacggtattcttagcccttaagaaacaaaacacagaaatttctaatactgggagtttaaagtgccacaatggaaaagcaaactcaattacaaatgctggattccacctggagcctattcttttcattttcttacttctgtttctgccaccttcccttcttccgataacagattttcaagtactgctcttagaattgctaaatgtgttcagagaatgtgtgataagatctgattctcctggaaggccaggttattttaatctttccatttctcacaccaaccatttaactaggtattatttgtttctggacgtcacagctaaagacacaacattttacatgaaaatgtcagtgttgaaaatattatttatctatctatcaaaatgtagccacgcatctgttcttgtttgattctagtaaaccataaccctaaacatgacacaaaaggggctagtgaaatatttgccgagagcggtactctaagttaacagtaaataattgaaaataagtaagtcaaaaccaaaaccaggaaagtttgcattcattcccaatcatactttaacagaacttgcagctgccacagattcagacatcttcatcttcctgtggagcatttgtcttttcatagcagaggacaatctctgtgactttcttatatcactgagaccatcttgtacagtttatttcaaaagcaagagtgttctttttcgtttcatgccaccagtgacaatacgaaaccagatctaactgaaacttcactcaacacattcccgacccgccaccccaaccctaatagcctctcataaccaccgttctactctacttctgtgagttcaacttttgcagtctccaaaaagaagtcaggtcatgtgatatttgtctgtgcatggtccatttcacttagcataatagggggactaagttcaagagatctattgcacaacatggtgaccatagcaaataataacatcttgtattttgaaaatcactaagggagtagattttaagtgttcttagcagaaaagaaaatacaatgaggtaatgccggtataatttagcttgattcagccatttcacaacttgtatacatttcaaaacattatgttgcacatgataaatatgtacaatttttatttgccaatttgaaaaacagagaagtccctcttcagatcctgtcctatgcagctgtcactcacttggctttgtaagcctgcagacagtgtcatttaaaatattttcctctgtaccataacgcttttccttttaatgatatataagaataatatttctctctaaatagttatttctttaactttgaaataattcagcatctcatgattttgatttccatttctccatatatacattttttggggctctgttctgggatttagggctaacctttgtcatggagacatctgtttttggcagtctttgtttccagggagtgaaaatgtgtgtagaaagaattgaatagctacatcttaggtgacacaattgaggaactggatgaaagatatttgtggaaagcaacataattattcaaactggaatatggccattgccctgggtttcatatttatcttcataagcaaagtggtttgggattctgtgcaagtataaggatttaggatttaaacactaaaccacatccctgcacggagcacatgggctttgttgttgataatcatgatagtcgcacaggaaacttgacagtgacagcaggggaacagcacagtatcctacttggccactggtaggaggatgcaatttaaatcctggcatgcgtagaatagcctcacttatctgtggattgttattgtaatctacatagtaagtttcaatcagaactcagttttgtgcagttgatttccaattcccgactctgcatcattagggtacaatgttttctgtaagatttctttgtaatattatagagagaagagcagaacaaatgcagttattcctctcaaagttcagctgaatgctactaatagttcaagaatgtggattgtaatggttctgtgcattgaaagaacacaatggcaaatgacaaagatgacactaagtgtgagccacagctattgttttgatagcccactctgcttttctagttaactttcttacaaccatcagttccatatttaagactagaggatcagttctgatgatgctcattcaaactcttgccaactgacatttaatgcactttaaagttgttaaaaccaagagcaggaaatgttacacttgtagtatcaagcctggctcatgagaaagttccatccactattctggaaaaaaaatagaactagcctgcaggacacaaagctacctgtggtgatccgaactatgcttctcaaaaatctttcttttgtttggccacctttataataggagttctccaacagagaaagagctgcttacagcttcagagtacagatggataattgttgctgtgccatctctgaacatcttagattgagggtcccagagaacctcatgtatgtgaatgttagcacagtacaaaagatgggacagagctttccagagcagtaacagacagctgtgcccagcactttcttctaaaagttggagatgctggatggaaaatttgtcattgtttacatagcacccacacacacacaaaaaatcctgactcactagcttctgtgttgtcatttttttgtccatggttctattgctgcctaattttcatacgggaccctcacagtggttagtctgcacagtaaggagtcaactgtgacatcctcatccttgaatgctagactccccactttctcagctcaatattccatgtgtccaaagtaatactgttagtatcctacattattccaggatcttgtcatgccacttcaagaaacaaattatcaccgctttctaagacttaccaagctaggggtgttgtaaagtatgtatgcaattgacttttgacttttgattcttatgttgaaaggcaacatagaaaataagcttccattaatgtaatgatatagtgttaggaagacagtatctacagtccattcaaaatattctgaaaattatagtattgattttggaacagttttgattccattggccatagcgcttaccttaagtcatttttttttaaaaaaaccgtcttatccatttcatatgttttacaggcactaaaatggggcacagagactaagtcacttagttgagttaaccaataagtaaaattgccttcatattctgcttcctaatgttgtatcttctctagcaagttcaagagagcttactttctggaagctttgcttgttagtaggatgtataacctgtgggaaaagacccagcagcatccacttttacttatctccttgccttctctgaaaacacactgaacagaaatatccccatctctttctccatcgtgggtttttcctttgggccacaaatagtgaacgccactgctttacaaagttattcttttcaccactaatagttctttgatgtcattttttgtacaagtgtcaaagtttttctctagaggcttccacacagttaagttcttgcttttggattctttctaaaccaaataaataaatcttcgagactgcaggttaatcaaatgccttcaaacatgaaggctgtttaggagctaagctgcacagacattttccaacatttaaactcttcatgcagcatcttcctatctcaatttgtacccgttagccagttccacagggcatattgggaaataccttttattttcaatatttatatttgtcttatagatatttgtcctttcaagtaggacaaagtggtaatgacctgcctctatcaaaaaattctacctagtaatccaagataagcagtgtgttcctagtgagttgcttacataaaagccaatatattttgtactgaatagtatacagtgttaaaaactcagctttttgagggacccaagcaagcctaacctacatgattttacaaagacaatacttaaaagtcataaagtactaagtctcaactttcagacttaagactcataaacgttttaattttttatcccttaaaaatgttattttttggctaacagcattgaaataagcgttactatagattaatactatgaaacaggaacaaaactgttgagcagacattctcccagggaaggactgtgtgtgaacacattaaacttacgcataaaagtggagactgtaagtgggttccagggtttccccacgctgactttttaaattaaatgtggcagtattgctaaaaataaaatttagtgtttctcaaattttttttagatagatacctcatatggtactcacaagtagtgtgaaaacttaagtagtatatccatctaaagcagcacaagcaatatgtcagcaccttttcactattaccacagagaaatagtgttggagaccatattgaaaatgactgtagtctggctgaggagatattaagtgaccagatggcctctggcacttctgttttcaaagctgccttatagtgcctttctcactttgtgataccaagctgctgccatgctagtgtccaccctcgaacaccatgccactcagacatggtgggattcgtgtttctgaaggggcacagtaggaagctcattcttgggccttctggcctgcctgagactgtgctagcaatacagtctcattgtgcacaaaagaagccatttttcttaacacctttgagccattaatgaaacctaccagttagaggtggtcaaaagacaaaattacaacaaatttagcttaaagatgtattggttttacttgcaattgtagaattgggcaacaccttgttctataaaatagtatgttctgatgagctgggcaaggtgttgtctgactttatggacagaaaaggactgaagaaagcagaaacaaaatgagaagtagacaggttgtttcaacatttccttctttctaggctttaagcagagggtactttcttatgctggatcaggtaaagggccccttctgcttggttgctatgaatctcctgtttaaaaagaaaacaaaaacaccacacaaaaaaacctgacccattatggtttggtctggttggctgaggcctagggccggagtctagtctaaaacaatggcctcccctaaacttgaacagggttacattgtagaataacataacaggaaatgaaaagagaaatgtgatgctcttcaacaattggtttatggggccttttaaaaagtgtgtatagagtcaatgatgaattaagatgcagtgtgaaagaaaatgacacaggacagatattcagagatcatttgttcagttttaaaatcagattattagtattgctgttgagtcatttcagttccttgtgtattctggttattaatcccttgttaaatgaatagtagaaaatattttctcccactttttggttgtctcttcactttgtagattgtttcctttagtgtgcagaaggtttttaacttgatgtaatcatgtgtctatttttgcttttgttgcttatgcctttaaggtcttatccccccaaaaatctttgcccataccaatgtcttatagcatttccccaatgttctcttctagtagttgcagaaagcacttgtaatttaacagctcaggaagggaatcaaatcattcagaccaactgaagctttcaaaatgttactgcttgaatgggcagaatatccaaaaacatttattgtgtgatcctaacatctacatattagaaactgatagaaaacttctgatgtatcagtaagatgataattacccttgtaacatttctggaagcatgtatgtatgtatgtatgtatgtatttaaacgaatgcttgtatatctagcatctctttcaattgactcaatacccaaggaattttatctccattttacaaataagagagattatgacttatttcaggtcacagaagttggatcacagctggaactttagtccagttgggtctagaaattcaattttctttttactttcatgactaaggaccactctataactctgaggtaaaaagagcaaacataatgaagttatttagagtagtgtttctaaatctaattttgcatgagtcccttggggaacttttaaaacatgtagataaccaggcacttcctgttatcctttttccactgcccctagcagacagacttagtatgtctagcttaggtaacctgggattgtgcaaaaaagtaaatcttcagagtccctctgaatatcaattctcattatgcaattatgactcctaaggcttaaaagtatgaaataaatctgtagagatcttaggatctcctgtggaagttgtttttgtgcctaaagattagcttgtttgtaagttcccatactcagtgagaactgaatattttaaaaaactggtgaagggtggcactgtattttaacgtaaaacatgcaggactagatacagtcacggccattcaattttttaagttgtatatctttgggtgagttacttagcttatttcagcccagatttactgctatgtaaggtgtaattataattattgagtaaaataaactaaagcatttaacacgatgtctggcagagactaagtttttaatactcttaaaaacatcttctggaggtaggcttctagttaattagtgttttaattatgtaattataatttttgtttcctttctctgtcctcatatttgctagaaaaacactatgtcaaccatttgatcatactcatttgtttctaagcatatatcttaactaatctagagacccatattcattgagcttttggaatgactggaaaatttctcaaagcttcctcccttatctacggtttagtttacaaaaattaaataagcttatgatgtgtgtctcatccacccaagtacatctgcagggctcctctattgtaaatcagctgcctaaggctcaagttagacacagtcaaagccgtgtatatttagggtacataatcttgatgtcaagtgctggagtcttgggcaaacttttcatctttttatgtaaaactgatttccattaagtatgaaaacaccttggtggtattgattttatgaaccctgtacattccctgcaatgaagacagattttagggtaaaagaggatgtttgcaagaaatggtgagttttattgtaagagaacttaccggccctatagagaggagaaaacaggttggaatgtccagctgctaccacccaacgggatcccagcacaaagaaaacagtcaaaattatgttcatcatgacagagcaaatgagcttttggggaaaacagaagcaaaataaacctttttgaataatttattattctataaacacaatcataaagcgtaatggtatcagttcaggagaaaggtcccactgctcctgtgttctacgtcagtggctgcagggccacagcaggcagagataaccaagcatgctttcactgccctgatcaccattcccccattaataatttgcttggccctttccttcctactgcctgaagaaaatcaatgtttggcagctctaggttgaattactgtttattttatctttagcctacacaactgcaaaaggaaagcctgagttttccagtgcatattccaatacctgtttatggaagtgagaacgagtcagatagtgatgtattttttcagagagtttcttaagccagctgtggataagaaggtccaatttgcattggaactgctaactaggactcagggaaatcccatctggtttagagaagagtaaatgaaaataaaacagaattgtgaatgcaatgcttcaataattagtttgcaaaacatgtatccactgccttgtgtgggcaaagcaccatattaggaactatagaggactgcaagaaaaacagaaaaacagagtgggctccttttgcaaggtattcgtggctattccaggcatcctttcttctttcagcagtgatctcctgagttattactatgtgcctggcgctgttctgtggactgcggacaaagacaaagtctctgctctcttggagcttatattccagtgaagtgggggaggactaaatgtaaatacatgggcaaaagtcagctaataaatactgtgcagagaatcatgaggagttgatgttcagttagtgagcaggctggttcgttactagggaagatgtgaagggcctctgagaagtaaaattgtagcagagacctaaataacgagaaagacctagccaagcactgagcaaggcaagggatgttcctggaagggaagccagagagtatggccagagcccgagatatcctgggtctggtgagtcatagatgagactggagtactggagtaggcagctggcaggtcacagtggactttcccagtgagtcagggattttgatttggggaaacctttggggattttaaagaggaaagtgacttgatctgatttttattggatactttaagaaataaattttgttttgtatacttaaggaatacaacatgattctatgagatatatatatatagtaaaatagtcaccatagagaaacaaattaacatatctatcatctcacatagttatacattttccccttatgtcaagagtagccataatctgatttagcaaaaatcatgaatacaatacactattactaactacagtcctctgcacattagatctttagacttgttcatcctaaacacctgttacttggtattctctcacctacatgtcatttcctctcccacctctagtaaccactgttttattctctatctctgtgggtattagacattgtttttttagattccacatataaatgagatcatgtaatatctttctttctatgcctggcttatttctcttagcataaaaccctgcaagttatgtatattgtagcaaatggcaggatctccttatttaaggctgaataatattccacttaatattttataatgtgtccatcccttgacagatacttcgattgctttctatcttggctaatgtgaatataggtcgggtttggttccaaaccatttcaacaaagtgaatattacaacaaagcaagtcacatgaatttcttggtttcccagtgcatataaaagtatgtttataccatactgtgctttgttatatgtgaaacagcactatatcttttaaaaaaatactttgataaaaaatactttactgctaacaaaaatgctagtgatcaacagtattcagcgaatgtttttgctggtagagggtcccgtcttgatgttgatggctgctgacagatcaggatgtgggtgctgaaggttgggatggctgtggtaacttcctaagacaaaaatgatgtttgctgcactgactgatttttcttatcacaaaagatttctctgtagcatgcaatgctgtttcatagcattttaatcagagtacaacctctttcaaaattggagtcagtcctctcaaactgtgcctctatcaattaagtttatgtgatattaatatttaaatattttgtcatttcagcagtgttcacagcatcttcaccaggagattacttcttatgaagtcattttactaatccataagaagcaactccttaaccattaaagttttttaagaaaaattaattttaatagttttggggttataggtggtttttggttgcatggataagttctgtagtggtgattctgagattttagtgcacccatcacctgagcagtgtacattgtacccaatatatagtcttttatcccttgccccctcccaaccttcaagtccccaaagaccattatatcattcttgtacctttgtgtcctcatagcttatctcccacctataagagagagcatacaatatttacttttccattcctgagttacttcacttagtataaatggcctcgcactccatccaagttgctgcaaaagacattattttgttcccttttatggctgaatagtattccatggtggatatatataccactattaaagttttatcataacattacagcaattcagtcacatcttcaggtcttacttctaattatcttgctatttccaccatatcttcagttacttcctccactggtcttaaacccctcaaaactctccatgaggttttgcattaaacttcctcccacctcctgctaatgttgatattttgacttttctcatgaatcacaaatgttcttaatggtatctagaatggcggatccttctaacaattttttcaatttatttttcccagatccattagaagaatcactatctatggcagctattgccttacaaaacgtgtttcttaagtaagatgttaaagtcaaaattgctttttgatccatgcacagcagaatggatgttgtgttagcaggcacgaaaacaatgttagtctccttgtatatctccatcagagctcttggatgaccaggtgcactgtcaatgaacagtactattttgaaaggaatcttttattccaagcactaggtctcaacaatggacttaaaatatttagtaaaccatgctgtaaacaactgtcatctaggctttgctagtccacttaaagactacaggcatagtacatttagcataattcttaagaaccctaggaattttgaagtggcaaataagtattgactttaagtcaccagctacattagcccttaactagagaatctgcctgttctttgaagctttgaagccaagcactgactcctcttctctagctgtggaagtcctagatggcatctttttccaatataagaccattttgtctacattaaaaacctgttgtttagtgtagccactttgatcagttatcttagctagattttctggataacctgctgcagcttctacattagaactcgctgcttcactttgtgcttttatattatgaagatggcttttttttttcttaaacctcatgaaccaacccctggtagcttccaactttacttctgtagcttcctcacctgcctcagccttcatagaattgaagagttagggcctttctctgcattagggtttggttaacaggaatgttgtggctagtttgatctatctagaccactaaaatattttccatatcagcaataaggctgttttactttcttatcattcgggtatttactggaacaacaattttaatctctttcaagaacttttcctttgcattcacaactcagccaactgtttggcccaaaaggcctagtttttggcctatttcagctttcaacatgccttcctcactaagctcaatcatttctagctttaaagtgagaggtgggtgactctttctttcacttgaacacttagaggccactgcagtgttattaatttgtctaatttctatattgctgtgtctcaggaaatagggagatgggggtggggggctggagagagacaaggatagacagagagagagagagaccgacccagagagacagagagagagagagacagagagagagacggagacggggagagagacggagacggggagagagacggagacggggagagagacggagacggggagagagacggagacggggagagagacggagacggggagagagagggagacggggagagagagggagacggggagagagagggagacggggagagagagggagacggggagagagagggagacggggagagagagggagacggggagagagagggagacggggagagagagggagacggggagagagagagatggagagagagagagatggagagaaagacagagagagagacggagacagagagagatggagacagacagagacagacagggagagagatggaggaagggcaggttggtgaagaagaacacagacaatattaagttcactatcttatgagtgtggttcatggcaccccaaaatagttataatagtaacatcaaagatcacagatcaccataacagatacagtaagaaaaaaagtagaaatgtgagaattaccaaaatgtaacacagagttgcaaagtgagcacaggcaggtagaaaaatggtgccaacagagttcctggatgccgagttgccagaaacgttcaatttattaaaaatgtatctgtgaagcacagtaaagcaaagcacaataaaacaagatatacctgtatttgtttttaaatataaaaataatttgctttaatgctgaacaaaaatgtcccatgtaaaaaattcatgtgctatctgttcccaaactcagtttccacacctaattacagtaaatagaaaggagagaaaaaccaaactttcaagatggaaaggagaacccaggacagcctcaaacccaacacttagaatggtatttctgcatgcccaatctacagcaaactttcagacttaagaaggaagagagaatggataaaacgttacagaagacagtattacattttaaaaattggtaagatagtagaatgtttagatctggaaggactttaaattaatcttttttccttacattcagataagctttaatgtgtactaaattctatcccaaaatctctattctttgtgaccctactgtaccctacgcagatttttgttgactcaatactccactgcacttaatttgttttttagtctcagctagacctgaaacaactttaggaaagggatagtgtcttcttgcttacttttatttttcctaccaactagaatactaataatcattcaaatgtttattgaatgaattaatggataagcaaatgaattaatataattagttgcttatattttaccccccacactagcctatagctttaaagttgtggtgactacaatgtctagtcacttaacctcacagggcagatttgctcaactaataagattttgaatgagaaagtgcttaaaaattctaaaagtgcttctctaatatttgttactattgtgttcaaagactgttagctaccaaatgaaggtttcatagtcaacagaggaggctgaatcccagacaattacaactgaggcccgggctactccaagtgtgatctttggagtatctgactcagcaaacaaacaagaatcacctcaacccaaaaccctaacccaaatagccatcattactacttccttccaatctccatctccacaccctccaataatgatgaattcttaaagcttgaatacatgttttaattgtaaatttgggttatttctgcatgtaattttacagttattttatttcacccttgtgagttggagttaagctctgaaaaggtcttattttgatgtctttccataagattgtattccttttttggcaagagaacagatctggagttgagctcctgccctctaccaaactgtgaaatttgagacaagtcacttgtcccccatgccaacccctggggcctcacttttcttattcaaaaagatcaaagattttgtcctaactcatgaaatcatgagcattacatgtaaaattaccttagaaactataaaatattcatttcaaatgcatcaagatgttattagctatattttatgagctcagcactccttgatggtcctgaagagaccaaaggggctgaggccaaagggagaattctccttaaatctcttggaaacaatctgacagaccttagaattgtgtagtaagatgaggacataaaggaacagagggtcaaggtagtatcttagctcctttctcccaacgtgttgatactggttaagatacacaaaagggaaaacccacctaagaaactgccaggaattcttttttttttttttcattttgttttaatgctaacttaataatcatgtcttagtgtaactaagcttttcttcatcaagaacattataagctcattgatgcacaggctaaatctttatgcttatttggtgctttttaatctgtctagcacagaatagggcacaacacaggtcttcagtgtgcctttgctgaattgaaatacaaaaaaatagcacatctttcaatacttgaagctcatttttataaagtatatgtgtgtagtagggaattctaaaaactattttttgctggtactagtttatttaatcaagaggaaatatcttcataaagtcaaacaaccagaaaggacagtgcaaatggccctcaaagcttgagcttagcaactgctcccctgttcttagtcttgccactgtgtggaatttaggacttctatatgcagatagtttgttacttgcaaaccattagaccaagcttgtcctacccacagcacacagggcgcatgcagcccaggacagctttgagtgtggcccaacacaaatttgtaaactttcttaaaacattgagtttttgcaatgttttttggtctcataagctattgttagtgttagtgtttttttatgtgtggcccaagacaattcttcttccactgtggcccagggaagccaaaagattgaacacctctgcattagacccttttaatactattataggtaatatattttacaacataaaaaaatcatctgtgtaccagtcagaaatgaaggttttgtatgaaacattttcattcttcagtatcaacagcccaagattctcctgactttatttctccagccctggcccctcacctcaccatctcttagctggccccagatatggcccaggtgttttaatcttctgggtgatctgatccagcctcttgactttaaatggcatctatatgatgataattttcagtttaagcctcccttcagaattccagtttctcaaatccatctggctattcaacctttccactttgatatttaagagacactttgggttcagaagagctaaaacagaactttggattccccaaacttgcatgtcctccaaattttctcatctcttaaatttgattcaggtgtacaaactccacatttgtcatcattcttgggcccctgtcccaactctcttccccacacccagtcaagaagtcctgttgactctgcctcgataacaaattgctcacacatttcctttgctccagctacccatgctgtagtgtaagtcaccatcatttcttgcttgaattctgcaacggcttcccaattgatctccccaattctacttttgcttcccaaaagtccattctccataccgaagccaaagtaatctttaagaagtatacatctaaacaaaacacttcttcacagcaaagaaatcaatacaatgaaaaggtagcccacaggttgaggaaaacatatttgcaaaccatatatctagtaaggggctaacttccaaaatttataaacaactcatacagctcaataacaagaaaacttataacccgattttaaaaatagacaaagtaacccgaatagacattcctctaaaggagacaaaagtggccaacatgtatgtgaaaagatgcttagcataactaatcaccagggacatgccaataaaaatcaccatgagatatcacctcatacatggtagggtaggtattatcaaaaagacaagggacaacatgtgtcgatgagagtgtggagaaaagggaaccgttgtacactgtgggtgggaatttggattggtccagccattacagaaaacagtatggaagttcctaaattaaaaatggaattgccatataacccagcaatgccttttctgagtatatacccaagggaaaggaaattaccatcttgtagaggtatctgcactccatgttcattgcagcattactgtaccgcattatgaaatgggttccttcaccccttttctgagcaccctccatgtctacagaagaagttatgaggaacaaaggtatatgcagggctcgttttgtaatgctgacaacagcaatcctcacatccagacttccatgtccatgtacagggttctctactttcgttctaagtcaaactgtgattcagaaatgagccatccattctcccagaattcctccattcaccccacagacacaaaaatcaaatctatgaaaatgtttttgtatatttcataggagaaacagatgtggaggcttaactcatgtatccaatgccaaaagtcttcaaaatcttcattaggtatttgttatgccaacttctttctcagccctcccggtttgtaactttttaaatctttacccagtgttgcacgaagactgttgagatggttccctctgccttcctctctctagtattctccctgggaagtttaaaatatataatgttatgtaaagtaactcactggggccttcctcttgggcctcacctctatacactgaagacaatgctttctagcaaggaggacccatgcttccagagaggagggtttgcaactggagtaacttgagtatgtctttgggattcttgagctcaacccaaagcagttcagaaacatttctttgaaacaagttcccaagatgaattctaacaactgtaatatcgcatttggcattttaaaaattttgattttacatttagacagagctattaggacatggtgggataaaaatggtagtatcgaaatatactgtttcaaatcaaattattgtattatttgttctcaatgacagacataacccaaacacattcttagtacccagaataaaggcacagccatgaaatcaggcagttattaataaaaacctagtgtagatagctaatgaaagatgaaaatgaagctgtgacatgattatgaactgctattagcaagcaatgtcattttgtatcttagagaccaaacaaggtttgtgtatgtgaactaatggttgacttatatggtaaagatatacatgcattatattcaggctatgttggcttcatttgaaactacagcttccatgggtttaaaaaatacacatatgatttgcaaagtgacaaccctaaattttcgtatattcaattgttcaaaccagtgatttctagaatgtaagtggtgtcctacttgtaagagttttaaaacaggcaattttggaataggtaaattactcagtagaagccttagagaacccaaattgctgatgtatctttttcgaaatgcctctcattatccaggagaatgtgtgtattggaagtatcttattctttaagtctcacacttagaccggttatgtttcctacttttaaaaattgtagaactttattctacagatgtcatttgatgccttttgagaccgaccatatatgcatttatacaatcttaattcaatgttaaaagtataattagtccaaaaaaatcaactaaatggcaacaagggtttttctttttctatattattaatttttttttcctccatctaaaactttccagctgctctttgtgaagttcccagaataatgattaacattattaaaccagagactaaaaatcttggtacggactgacccatggggacacattgctataattattttaaagtaaaataataaaaggggcgtcccatagcgggcaaaagttggactcatcctcaaaatttactctatttgtcaaagtcccctaaaagagttcttaggagtggttggaattggttgtcagaaccaggtgctctcaagtgtcttgcctttgtggttcgcctacctgggtttcccagtccttggttgaacattaatgttctcaacgagatataatactgaatataactcttgtgatctcttccagtggaggctgaggccatttctaaaaattccttccctctgtttcttctacagtatcttcctctccgtgtgcatacatgtgagaggcatagttttccccaacgtacttcagataaaccttattggcatagttttcctcaaagcacttccaataaactttattcctttcatgattgtcctgtagtttacagacactgatattgtactctttggagtggagaggggttttgccattcttacaaaaaaaaaattggctattcctccatttatcaggctcattttattaacattctactgtcatcattgtgctctgtcactttgactaagcccaagaaccctcccacagagcaatgttaattataacccctctatgcccgtaaaatatgccatctaaaggctttgaataaatttgggataaatttcctgaagcagaactcatgaacccatatgtattttgattccaattcctgtcaatacaggttctagttcaactcccaacacacacacacacacacacacacacacacacacacacacacacacctctcacatgctttccttctaattggcaagaagccttcagatgtccttcacccctactggaaaggcatgaaacaaaacccagtaccttcctcctacccctaaactggttttgtcttgctgcccctaatcctagcttgctgttctgtttttctattttcccctaaatgcaacttactttaagcatgtgttaactggattaacattcctacaattgaaggatagtatatgataacccatttgtcagtctagctactttcttctcttttaaatgtctacttacgacgtacatccagactgcacgccctttttattttttcaaagcaaagccaaaaaataaagaaaacgtaaaattagtttttaaagaaaatgcacaatctgtttttaattttggctatcacgaaaaggggaattaaccagccaaaaaagcaaagcaaaaaaaacgtgtcccctgactgctctgtctgtgcctttcaagcctgtgcgtctggttgttcatctctgaaagtgtgtgaaatacttttttctttaaactttttgtttttttctcccttcttgtttgggaattaagtgctttttatattatatatatctatatatatatatcaatgtgtttcttttaattgctagatctttatcttagatttgattttatctaaaattatgagaaaaaaagttatgaattgttttctgcagtttttccccactccctctttaaatgtggaacaacttcagctgcagaatcctcacatccacatctttcaaattagcctggtctcattgccaattgcgtgcaacatgggtggcataaggaagatggatgatgtcgtttggaaaatgccatttctctatagagaagtaattagcaacccagtgcgtgggccccctgcttagtagtgcgtctcaatcacctctgtagatttctgaacctcccccactctagatggggctgtgtggctgccgatgaagttgttcaacttgaatgcataaatctagtcttcttgtttttgctttaaactttttgatcatgactactagtattttatgtattttggctatttttagtaggaaaaagtttaactgtttttattatttgaaaatctttaatgaaactgtaataatttttggagtaattgcatgttgaagaagttgcagcttagggtgtgtgagattgtcagtgttagagttctgttctttatttccatagatgggcatgtgtaggctcatttgtttttgtatattgcccatcccttccttacagccagaagctctaatgcagctagatcactccgtgccgcccttacatggacatggcgactcacttacacatttactcctatcatcttcatctcctgtgtagttcactcatagatatgaccctccccttcctgcatctttccttcccattctccccctttctttagcattgttaaaatttatgtgctgtcatccatctccctaaattaaagaaagcctaaaatttgtcaaaaagacaaaaaaatatatatatctgaaaacttataaatgcagaaattcattcaaaacccgttagagtcatagaattttttgaaaggcaaattataaaagtaaacaggtttttttgtttggtttttcaatcatagcaatcggaattattttaaattcaaaaattgatgccctcccaaaccccccaaagtaaaaatttgttaaagtgcagattttttttttctttttatgttatgtggtgtggatgtatgtgttgttgcctccctgtatcatcctctgttgtaaattattatatttgaaaaattagacattttgctcaaaagtttttaagaaatgacaacaaaaaaagcaagttacaagaatgtggcaattctatttgtccaagagcattcttacacaactttcttttgtaaatttttctttcatgccaaaaaacatgcgggcaatttgttgatgtaagttgactataaattaatatggtatgcttttttagtttaaattattttgcctatatggaaatgatttctttttttcccagaacagcttctatttttaatttgcttttactttttctttccattcttattatattgtgaatgcctcaatgttatttgctctccttctcccagcttactttggctacgaagttgattttattttctactatataattttgaagactatattttttatttcatttgtgtcgatttgctgaattttcactgttatgttttgtgctgaattgcttctaataatcaatgtgaattctactctcagtagaagggggttaatacattgttcttaccacccaaagaaagcctggcctctttgcctgaactttttcaccaccgtgtttaaagccttgaaagtattggtaggctctatttggtatcttaaaattgtttccagccagtgggaggcctgtaccctagaagaaaatgagttgagttagctccaagtagtaccagtggtatttgcatctttttaaaattccttaaaaagcatttaggaaattagttcttttccttcagcaaaggggaaataaggtactctcaagtgactatggtagagtttggttatccaggatcatactctcacttttgcttcaggctacaaaatcaattatactgaaaatgcagatatcaagaatcccaggtgtttcgagtattgttctatgatactgacgccttccagtgtatggaactaacaactggcaaaaacacagacacacacagaaggcacacacacattctctctctccctctttcctttgtctcttctccttttccctttttcatttctctcaaggatttaatcaggtaagctttcagggatcttaagattctaccaagaaaacatgatgattttcatatctaaagttatacttagaaaatatttcaggtgggtaccatcatcgtgtaactacagggtaagactattccttcaccttaagattatttgaaccaatgctgccttatgtacttcaacatacataagattggtaagaagcactatataattttttcatcaagaagttacttgttttgctttacagatatttgtgttatttgaactgttatagaaatatcaaactgaatggtggataagagtgtttccaagccagcagcttaatatttgggctctctctacctcagtttatgcgattttgtgttgtttgacatgctggataatattttaggtctaaaacttagaacttcctaaatgggatgttgttttatcttgatgcattaaaatattttctttctatgaaaaagatatccaaaggtaaatttaataaaatgttatttttaaaaaatacaagctatttgaattataaattatttcttatattctattatttaaaatagcctcaatatataattatacttctactttagcatgaagccactaaataaaaaagggttagaagaaagtgattatgtaagtgtttatagctcagatacattagtagaaataataacattagtaactagcatttctgaatagtagtaggtactgtgttaaccatctaacatataaaaaatacttgatatgcattattttaatatttgcattgatggtttgaggtagggtattttattattctcattttccagagtttaagaaatttgaccaaattcctagcactagtaggaactcctagagagttccgatgttaagagtctgagttacttcagaagcaaagctcttaataagcaaatgaaacactccacttgacatttcctgttttgtaatacataatgatatcaaggggctgtggctcatcttattgttgaaaaatataatctgtagcctttccaaatcaaacctatttcagacaaaccctttgctggggtggaagggtggtggggaagcgagggagaatgccctacctagaaattctcatcctgttaaaatacaagttaagcctctttgagacacttgagtttttctactgtcttctccccaggtacttgccctgtttgtccatgactattttttcccgaaggttgatagagagcaatttcatggttacaagctttatgatatttatgtgttacaaatacacacttctatgtcaccaaagagctaaatatctttgaaaaattaattcttggggggaaaagaattatttccccttatcatgtgaattttcaggaagaaatttggaataatgcaaataagagatgaagtaaaatacccaaatatataaaaagaattcaaggaattcaagcatggtgtcctgtcccagagtctcactgttcagcatcactgttttggtattttcgtgaactctcaaaacccaaatatctccagagaggcaagtgttgaaacttcatgcttgtttttttgttctttttttttttttttccaaagataacccactgcattcactatcacccacaacattctcacagttcagaagaattctattaaattttttatacactgtcttttttgatggcagtgagccccttttgctggatatcagccctagaggcatgaattatatatctacaaatacactcataaagcaaaaaagccgggaagccttcagggctaaaatagaccttttatatctctaatgatctctctagtttaaagaaaagcacaatcctgccaaaaaggggtatgtatgcctgattttaaaatgctaactttaaagaatatagatagcttttatcccaaactaaagaaaaattctggggatagcataggaaattaggattttgatggattacaggttttgtattactctgctcataaccctttatgactttgggttatttgcttccatgaatacttttgtaggcatgggacacatagttgatcactgacttcatgatctctgggaagtgaagaaaatattatcagctacttgaacatttctcagggtagtcacttttgattaaaataaacaagaagctttgaatagcttcccaccaaactacttttttgtttgtttgtttgctttttgagacagagtctcgctctgtcgcccaggctggagtgcagtggcgtgatctcggctcactgcaagctctgcctcccaggttcacgccattctcctgcctcagcctccccagtagctgggactacaggtgccagccactatgcctggctaatttttttgtatttttagtagagatggggtttcaccgtgttagccaggatggtttcgatctcctgacctcatgatccgcctgcctcggcctcccaaagtgctgggattacaggcgtgagccaccgtgcctggccaaactaagttatttctattaatgatcttatagtaggagaaatacatcactttctcctctcaaatgatgtgtgcctttgatcccccaggacactattatcatctgcaatcttaaacatggaatttaatattaaaattaattacaccaacatatacacttgtcccaggcatttttcatgtttacagttatctaaaatgttctacctattttcattagaattgctatttgtcataaggacccccgtgtactgcagttgacttcattttaaactaaaggcaatcttcccacttcttgagaagccaggaaagaggggttaggaaagcttctaccactttgttgtctaaaaatcagcataatttgggctcagattttcccaacagagggtatcatttatcatttttatcgctgctaccgagattaataacaaaatggcaaagaaaactagagatcagtagttctgaaagattttgttttctaaactctgagatggcatacccatcattttagttttaaaataagctcttatcatttcactttgggactcaccaggcttttagaagctctttataaattaacaagcttcagaaccctcttactgtagagttataaaaaatgtggttactcttttttttttttttttaaatctaagatacttgcattagtgtgttaaatgagagggagatagcaaagtaaagtaattcaactgcagagtgaacagtttgtagattttgaaacaacaagtacactgtggaaactttagctggtattgaaaggagaaaaaacaaaccgaaaaaacaaaaaggcaaatttaagactccggttgggtgtcacagatggtacactaaaattgcaaatgaatgccactctgtaatcatgaagatggtgatcttaatcccacttaaagggacactagcctcttacccaacagtttgcctttatattcaaactatttgtaccagggctttgcctcctaagatatcagttattccttgtcctttaacctagtttcctctttgcttactctacatggggtagatttgtcattgccataaggaacaaatgactcggtgtttgtgccagaaaagaacacacatgttaaacctgtgttacagataagttaaaaaaaaaaatcctgccttgtcctctgaaggtaagtaaaactgtgcctgagaaatccttacggaagctttagacagagtccatgggccttcacttcctctctctcatcactgctctcctattactcaaaccttgccctctttcatatatcaccttaaatctaccacttgggaccccctagcagaagaataataaaaaagtttgctcagagttagttttaggactggcttacctttagggaactgcactccaaatcccatttgtaaaaactagcaaaagtgtgtaaattatgcattaaataagttgtaaggcatatgaattatatatgttcacaatgtaaaaaaaagaaaaaaaaaaaaaacaggtgtctgctggtctagtacagtaagtgtgaatctttggcaaatctgcacagatcattttgctcaatagtttcaaactctgagcaccagaatagaggcttaggtttagagcacatactacaagatcatcttgagaatctcaaaaaggtatttttttaaatttcatagtaaaattatcacataggccagagatgacactgcaacattctgttgtcccttcccttctaaatggtacacattatatgctttctcggttccctcagaaactcagtttctttctgcagaacacaattgttattggctaaacagggagagaataaaggcttctgacatgggcaccaacagtttctcagtgcttgaaggtaggtattagctttcttctcaggaagcccttctcttagcacacctgaaacctggacaatttggatgcatgggaaaggtttcaggatgcaaggtgtggaaaggttgcatcttgaagcatttcctatgcattcaaaaggagagttttaatttgtgaatcaatcttcataggaaaaaccctggaagactgtgtaggctccaaggcttattcacttggagtcccctagaactctggtactgaatcacctccttgtctggctttgttactgatgaggtgggtacctcagctacagtcttatctgttaacagctactcaaacactgattatactatcacagcaaagttattaccaagtgtaagagacacacgtacgtggtaccagttgacagctcaatgggtcagctcagaaagaggccttcaacaataacgtcacattagtacctcaaccttctaaataactggggcagggaaacattcgcagcatccctgcgagtggattttttttaagtgatagtgggaatacatttttctggaatatattcaataaagagacatggactatgacttcttaagattcttcctttgcttggaaaacaacattataaagacactgaagagagatcagttatcctgctgacatagatgcatagcaatcttggccttacagtagggtaagcaaccactactgcagaatatttgtggtacccatgatctgcaaggccctgttatttaatgaactattctgagctttctttcccaacttagtctgtatgattctaagtgcaataacgagggtctatgggtaaacagatatgtttttgccacactagttagcaatcaccaatttaaaaaactcactttgctaagtcaacatttctgagtctaacagtttcaagtcatggatatctaggctgagtattttgaaaatctagcttccagctcagcatatattgcatacagcatgaaagcaatgcatacaaatattagactaatgcaaggcaagctgtcatttaatagtcagggggatttctggaaaagcatggtcaaaatggatttgttagatgaatatttttaactttttaaaaatccctattgctcagcttatagtaaacaaggactgtgattaataagtgtgaaataaaaggaagtaacttaagaaaacacaaaagacacaatcttttatgtttcttgatcttggtctcaataagatggtgaatcggtcattctcatcctcctgggagcaaatgagcagaatcccaagaaggcaataaagaaatcttaaacgcatgttaataaattcttaagttaagcacacaatgtgtgcgtgtacccacacatgccaattttgatagccagccagtatttataacagtatcattgactgaatgtcatcagcccataagcagatcctggaaagaacatatatagttgaattttatctaaataattacttgagagtatctttaaaaaatctaagcccctgatctagggatttcaggtttgggtggcaagaggcatacagaaggctccaaatctgcctagaatgattagactccatccagaaaagatccagatctttttattataatttctgaggcataatctgtgaatgacgttggttgagtgagagttgtttacaaatatactaattgtttttctttttcttttccatcccaggaggtgaattagttatccctcttcttgtagaagaccctttagctacccctcctattgctactcgtgcaccttccattacactcccccctacctttcgccccctcctcaccattattgagaccaccaaagattccctgtccatgacctctgaggcggggttaccttgcttgtcggaccaaggcagcgatggttgtgatgatgatggcttggtgatatctgggtatggctcaggggaaacctttgactctaacctgccccctactgatgatgaagatttttacaccaccttctccttggtaacagataagagtctttccacttcaatcttcgaaggtggctacaaagcacatgcgcccaagtgggaatccaaggactttagacctaacaaagtctccgaaactagtaggactactaccacatctttatcccctgagctgatccgcttcacagcttcctcctcgtctgggatggtgcccaaattgccagctggcaaaatgaataaccgtgatctcaaaccccagcctgatatagtcttgcttccgttgcccactgcctatgagctagacagcaccaaactgaagagcccactaattacttcccccatgttccgtaatgtgcccacagcaaaccccacggagccgggaatcagacgggttccgggggcctcagaggtgatccgggagtcgagcagcacaacagggatggtcgtcggcattgtggctgctgccgccctctgcatcttgatcctcctgtacgccatgtacaagtacaggaacagggacgaggggtcctatcaagtggacgagacgcggaactacatcagcaactccgcccagagcaacggcacgctcatgaaggagaagcagcagagctcgaagagcggccacaagaaacagaaaaacaaggacagggagtattacgtgtaaacatgcgaacactgctcacacgcgagttttcacagttatttctatccacgcctatgaatctttggacggtgagatctcacagatgtcagaactgctggaactatgaaatggggtatataaccacgactctggtggggaaaaccgttttttaaaggacacacacacacacagcgatgcatctctctctaaagctcagccacggctgcggcaaggtcccagcggtcgctgggagacagaaggttttgtgccctgctgtatcataaagcacacacttagcgctctggagccggacggtggctccaccacttccgcaggcctggaaacttccttctccggaggaccttttactaaaaggtagaagacttcatggcttacttgttccataactccaagtgagtctgtaatgtttgtgaagcttgactgtaaccatgttttttctgtttaattatgtaaaaaacaaaactacaacaacaaaaaaagaaaaaagttaaaaaagaaaaaaacaccaaaaaacaaaaacaaacaaaaaaaaaaacccacaacccttatctggttctgaccagtgtgcgtgtaactttatgatctgaggggaaaaatggcttttgggtttttgtttatttttttgataatgactggacatcagaagaggaaaaaaactcaaaacaaaagcgagagagactattgccatatgaactcaaaagctatcatggtgttcactctacatatcaggttatggtgtctctagaatctgttgtttgtttcctataagatgctttgctgaacacatagcaaaattcatgtgacggatgataaattgattcgaaaagctggtcccccaggatctaatttcagaatttaccacccaaacccggaacagatgggtttagggctggtgttatcagagctattggctttacgtaacaatattgttcctgtccattcacccagccaaattgtgttaaagaggaaagccccacaaactaaaacagcctttcctagggaagaggaaggggaggtgggctggatctgtgactgattgaaatgcatgcaaataaaaaagacaatattaaagtctgttatcaaaccagacagtaggggagttcaactcgtgatggaaccacaaaaggtcacacaagccaaccatgtcatgccagagtacaaaacacatagttctttccccgccccgaatgtgacaatggttttcatagtggtttaattttgtagcctgacatttatggataactctgtccttccatttgctcacttctctcttcacccatcttttttaaaaacaaataaatgaataaagctgctgtgacacacacacaaaaggaatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaaaaaaaaaacttcagattttgtttacatattttactacatttttgctggtataattccttagccacctatgtacatactgctttaagaaatgtttttttcctgtttatttctgtttggtttatattctggttgtctttttctttttgtaaagaggaaacaatgtacagaaaaacaataaactggttgtatggccatagctatccgaaaagcaagagacaaagcaagacaaatattcacacaaaaatgaagtgtgtcctctggagggtcagatatacaatttcttttgtacagatgaaaatcaatcagctgcttagatttagaaatctactcttgctggtctttgtaagttgcatgaatatttgactttgaaaaaatatcttaacgacatggggcaaaaagtgcaatctaaatggtagcctttactaatgtgtgtggaaagaggtgttcctcattatctaatatttcaatgtgttaagagtttaatttttttgttatcattaaaaaagacaggattataaagagatatcaaagcacgattttagataacctaaacggcccagcctatacgaagttgattatatctcgatgtctgtaaaagattgctgttcttggagtcttgaggtcttgtgaattgatttcctgctttctttcatttttttcaatttaagtaataatacatttgttatattcctttcagtgtaagtttctatttggacaattttatgggaacatgtgcattctctatgtgagcttctatcatattcctgttttattagcagaacctaaaggaatttatttaatgatgttgtgacattactgctttttcttttttcttttcttagttcatatttgcattttcgttcaaggatatgcttagcaataaaatgttcttcccaa

SEQ ID NO: 2414 - DNA, 585108 bp, Homo sapiens; identical to SEQ ID NO: 2413

SEQ ID NO: 2415 - DNA, 223007 bp, Homo sapiens
cagtgcatgaagtatgctcagtgtgccagcaagggctgataatcagcagaaggacagggtgcttcgttagtcagaagagccagggcttcccggctgccaggctacagaactcgcctcgccactcctgagacatggacaacgccggtgggtaaatcaagcatgaattcttcatagctgctggcttcctttgcagcccgcatcctttactgcggaaggtttgcctatttgttgctctcgttttgcacttaaatgttcaagactgagacgcgtgtaatatgtgaaccccgatgcattgtccacaagacaattagtgtttactttgaagtttaggaactgggaatgcagattgtattccaaattcaccttttgtgaagactactgctatttaggctgaagcaagtgtggtgtttgattcttttgtgctcagagcgatgggtggaaaatgcatacagttagtgaaaaaactattactaagggatggcacaaggtagatggaattaagttaatgagctgagcaaaaattctgtgtaaatattacaatatgcacagtgtaacagcataagagctctttggtctgatgctttcatcttcacgttaggatgcaatgtcgaaaatgtttcgatagcctctgatattttaatttcagaatagagacattagtggtcaattgtgaacctttaaaaatgtacttatttttagtatctttacttgataactagacaaacagatgattgaagtatgttaatgtcaattaaataattagcataaaattatcaggtggaacttttttctttttactttgctgtattgaacttttagaggagatatactgtgagatcatgccccatttcagtgttgtcggcactcaagcagaattctcccagctgtgttatggattatctgtctcctgaagctcattagttcagttacgcagctggtatcagcttgaaggtgatgcttcccatgccttgagacacggtcagctcttctaagaggttacatcatttaaaacacattctacactacaagaccacccattgatggtgaaacatatttgtttatgaaattgagctagttcagtcctcggcacaggtagcataggctagcagagattttaaagtcagcgtgtattaggttcttttatgaaatagcttaccaggaacaaaactctgtgactaacattatttggtcattgccattgaagatattgaaataaagtggaacagtataatatcagggatgaaaatgttagggtggtggaagaaatgaaacaagtgtaaggatgtgtgtgtagtagtagcaggagtgaagctggatgcatgtatatggattatacccccattctggtcattaaaaaaaatgtactatagggcttgtcataaaagcaggtaggtatggtattccatgacaaggcacaatttgaagatcaaccaaaagcttctctaattacagtggtagagtgagtaaaaattaaataaataaacttagaatctctaatttagcctcatttaaaacttctgccacccacaatttattatactgacattctggcagaacgatcactttaattcaagtaaatgcctttttaaactgactcatatatttatttaaaggccatttaaaaaaaggaaagaaactcctgtggcagactttatgtaggcttaaaaatgctaagggttatttttcttttttgggtaactagagctttgggggatgttttcacaatctctagttatgttattaaatgcaattaataaaatacctctgctcttgatgagtttaagattatttaaacactgtggagagtggcttgtaaagtagcaatttctatatcatttcaaattttaggtgtaatctcaaatatagccatacatacctttgaatagaataacgggttttaaatcacataatttgaatgcttcagaaatagcatgtttcttataatggcttataattggctgtcagtgatcacttttcatggtaattttttgatgaggtaagcagcctctcttacaggaggaaaatgtaaacatccattatatacagacatttcaatacattatattgactgtaagggaagcatttaagataaaactggtaagtggcaaaaaaaaaaatctgaaaaatctgaaataacttggagcactacagtttctccaatttaatttaaagaagataatgatgttgagtatttgcctaaatttttctaatcagaaatgaattgaggccctggatttcagagctagtagtttagagcggggcactcgtactgacaactggatcattagtttcaaggagccagaccttcttctagcaaggctttctgtgtgggagtttggataattgacaggcagaagcacagcaatgggtccacacaggttgaatgtccctcatttattcaagtcacatagaacgctgcatcaggatatttgtgcatggtttctgctgttaacaagtaaagtaagatgagctgcttgggactccggcccttttggtgggtgtgtgtacatttcagctatcatggcattgtgaatctgtcctttctctccttagcagcaaagagctgacattcctactatctcagagaaggagacatcccttccccataattgctggcttctgtattcctttaaaagcttttcctggaataacaataaaatatttatcaaactgtgtgtgtggaatatgtcagggcaattttagcaatatctaacattttcttctttttttttcaaatggctatttcttcttagaagttatataacaagtcaaatagatggtgctttagaatggcacacctgtgactacaagcatcatcagcattctgccagtgccactatcctccttacctccatcaagtggttctcgtgaatgaactgtgataagacattcagaggcaaagttgattggtgtgtgttttttatctgaaacacaatttttgaaatgtaatcccatattctacagtgcagagtactgttaaaaaaaaaaagttctgcagaatttattgtgttgggttttccctacttgatatcaagatatttcagttaccatgtgtgggttgaaagagccacactcatttggaggggaggtggcagctgctgagagcccctgcgccttcaccgtgcattctagctcagtggttcaaagccttttgacaattgatgtacattcattgagtttgagaaggtcacagtctgccagctccctgcaaaagagactcgagagttatttggagccagactgaggaagggtttggagtggagtagtcgagagcatcagataattttagctgaacgttggctctgctacctgtcatcccagtgactgtgaacaagtaatagaaactctatgcatttaattttctcattggtaaggggtgacaataatggtacccatctcataggattgctatgaggagaaaataagataactcctgtaaagcttttggtacaatggctggcatatggcagcatacaatgcatgttggcgttttagagagtcatcaaaagattgaagcaggttgctttatgaacaaataaatatatgctccagcagcgtggctctgaaagtggtgtggatgacagtgtgggaaagtgagcaattctgagcaaagagactagtcaagtggctgtctcagaagtagaactggaaatttatgtgggtggtgcaatgggcatggggttgggggatgcattggatatgcatcagcagagcacgacgagtggatatggaggcagggagaactgcagcagtcaaaggagaccctggaggtttcccgttagagaatttaagacagtagtcctgcactactgaacacaagatgagttttcagagaaagacagtgagttccattttgacattgttgggtttgaaataccttgtgtgttgcccactagccatagtagttggttcactgatgactatttaatccacttaaaggattaaaaaggattcctgcctcctctccctccagtctgtgggagattctatgggatggtacagagaaaggaaactttcaaatgcttcatctttttttatagatggaaataagaccaggcaaagagaaacatgctcctaagcattgcaataattagggtaaaggccaggctgtcacataagaaaatgtaagcacgaagacatttcatttcaagctggttcaaaaccttagcagcccaggttgtcatgccaaagttcctgaacagctaaagatggtgactcaggagaagggttacctaatggggcagagatccaataagaatgcatatgttttgaaagaggatgctttctagaatatttgactatgtttgcaaactctattttttgcaattaaaattttgtttcctctaatcctccactttcatgatctcttggtcttactatctataattttgttaaccatgatactttttagaaatttattaatgttatatatacacacacacacacgtacataatatgtacacatgcatttgcatgtgtattgttaatatatgtacgtatgtgtggattctttatttaggggattgtcagccttgatgtaggggaatgtaatgttgctagctcttctaaaaaacttgataaaaaattagaacagattttcttttaaattaaaaaagaaactcattcttatcctctgaaatgcctttatgttgtaaagattattatttaacattttattaactaccaagcaaatgacagtattttcctttgaatttattgtgaaacccattgtgctattttagcattttaggtttcacaaaataaatattcttagaagcatccaggattcatgtaaatatatttttgtttttcttttttttgagacggagtcttgctctgtcgcccgggagtgcggtggcgcaatctcggctcactgcaagctccgcctcccaggttcacgccattccctggcctcagcctcccgagtagctgggactacaggcgcctgcccccatgcccggctaatttttacattttcagtagagacggggtttcaccgtgttagccaggatggtctcagtctcccgacctcgtgatccacccgcctcggcctcccgaagtgctgggattacaggcgtgagccaccgcgcccggcccatgtaaagatatttttctaagcaaaaagttaaaatttgataaataatctgttttttggagcatctgttttcaaaatgctagtattaccaaaataactgttttaaaataaaaatgccaaaaggaaaaatcagttcatatataaacataaaagtactgtgaaagtgggactaaattttcttcctagttttactctaatagtgtagtgactgtgacctcctgcgagtaaactgacagtcatggcccaagagtgtgcagaagcaggacaaagtctttgtttttgaaatgaagttttgacttttgtttcaggatcactggaatttgttctgagcgtttctttctttgcaaacgctcatctttccaaaggcagaatgaattgtgatttttctgtatcaccaagatgaaatagaaatccttgtcaaatggcttctgtcgagaacaactgttagaaaagatataaagcacaagcaaaaatgcattttggtgatagaggaatcagtaatcaacattttctaaattatacgccattccatattaattccacaggttattaaataaactccccaacccacctccacacacaaagaatttagcattcaggcaattttaagaattgttgagtttaacagcattcaacaggtttcttagcatgttaagaaacatgctgaggccgggcgtggtggctcacatctgtgatctcagcacttggggaggccaaggcaggcagatcacaaggtcaggagttcgagaccagcctgaccaacataatgaaacccccatctctactaaaaatacaaaaattagccaggtgtgctggcacatacctgtagttccagctacttggatgcctgaggtgggagaattgcttgaacccgggaggcagaggttgcagtgagccgagaccacgccattgcactccagcctgggtgacagagtgagactccgtctcaaaaaagaaagatgctgatagaattggcatataatttcctgtgggtgctaatatttgttgtgaattcctaagatggaatacagaatgcagcatttcccaatcatattaacctcaggttctccaggggataccaagttacaaggtagataactccaatttggaatgcactgttaagatcccttcattcacagtttcactttccatttttaccttattcttcctctccggagttcttctcaacttcctgtttccaaatataggaagccatttttggtaactagcaaagttaccaaaaagttacttttggtaagtaacttttaacatagatatttaatttctaaacaatcaagcattcatacttccataagtatgtacatttcatgtacatgaaattccattgcacatgtacatgaatatgtacatttcatgatacttaacttccataagtgtcagtgcttgattgtttagaaattaaatatctgtgtcatctatgtccaggatttctcttctctttccttgcctctaacctttcactgctcataaacatcaccatcagatgaagtaaagaaagaaagggagctaggccttgaacctgctttggaaaggagtggaattcaatgacatctatgagattgggggtcatgcacagattttatcaatccaaatgtaacaattcacatgaaatgttaaaaatagatgatgtaagatgttatatgtaaaaagtcaacttcaaagttctatttttgtaaatcaggtaccaagaacatatataacaaaggcaaatcatatttagctaaatgtcaaatgtcttaaaaggaaggaaccttacttttttgagtgtccattatgtcctaggcatcaagttaggtattttacacatgttacatcattaatacttgcagtcactctgtaagtaaatattatctcccccaagttacatataagtagctgaggctaagagctcacccaataaataagccagtaatttataaacttgaatctagccttttgtaacaatagcaaaattcaactcatcatttttcatgttgttttactgctttaagagtggggattcttggtctttgtgttttccatagcattgagcaccgtgcttgggctgtagtaagtgtatagtaaatgtttgctgaattaagtcaacaaacatttaatgatgtttaattaagttggagcaatttttttaaaaagcaaattaatttgtaaatatcaatgtcatatgatcttattatacatctgaataccctcttggatagaagttagtatatggataagacaaaatatagttgtgaagtgtttctttcataaacattcataaatttatgacaatttataaaatagaatgctttttgatagagcccacctatgaaatctgttaccattgtaaaaaaaattattcaaaattttcatttgaaagatgtgataatattagagtcattaacaaaaattatggaaagagcctttcccatatgtttttaatgatatttaaatgaaatgcagacacacctttctggaatatgaaagaattttactttttctctcttcttcttccagagagatcatgattagagggaagaccacagagtacctgtgcctttgtctcatctgaccacacctgtgcctgaatagtcctttttctttcactagtaatgctaacacgttacattccacatgactctttccaaactctgtactactctgtgaaccagtacaagatttgacaaacacacagtgaaacaataatctcatttaaattttgatatctatgtcaagagaagccatagtttcaaagtttcagtttcaggtttcagagctatggtttcaaagtttcagggtttcctaccacttggtataaagtatctgcctaattgtttttataggtagctcttttattatttttatagataattcccaacatccagctatctccccaaaattattttgaatttttttcacataaaccaattttttccaaatatttaatcttctaattaggaatagtgattgaaattgtgcctcaggactggactttagaatcataatttcctttcttagacctgaatcattcagtcctggcacagcatttatacctttacaggtgtcaagttcaaatccttatatttattgttattagtaatgattatatttgacttattaacctgtatcttctgttattttccatgtatcctctacatctaccagtctgttccacgtctgttctgtatccacaaaagcatttgtaccttcattcttgctgttcttcccacctagaacgccttctcctccttgccattcagtcgttaattcatccatacatcctggtgatgtttcctggtcacccactctgtgccacgcaatgtcctagttagtgtggatatgagagaatgaaacggagcttctgtcagcatgctccttccttctagtagagaaagcaaaattagtaatgaatagacaaaatgcttggggttgtgatcagtgctgctaagttaatcaactggtatttggataaggaatgaggttggggtggaggctacgccagactcggtagtcagagaaagcttcctaaggaggtggcatgcaggctgaggcctaaggaatgaaaaggaatcagccacgtgagagccagggtaaaaatgtgtcaagctgagtggccggcaaacacacacgcccccagacaggacgttgactgggatgtctgagcaacaaggccagtgtgtctggggcctgatgagaggtaggggcctcagaccaatcagggagggccttgaggcttggcctctgtcctaccagctttcaggagcctttgaagggttttacgagactgggaagaatggactggaaagaagtaagagtggaagctcctaagaatgaaatccacttagaaggctcttgatggaggtggtggcagtggggaaggggagaggaaacttacttcaatcccagccctgtgtcaaggcccagcacatatcccatcttacaacgtcttcccaactggtctccaagccctgaattttctcatgacgctgatggaattcaacacccagttttgtacttactggaagttcatctgagattactctccagttgagtcttcccttcccaaccagatttaaaagtcttgagggcagatgccacatcatagacatcttttatgtcttccaaagagttagagtggtcattctcaactctagctactcattagaatcccctggaaatcttttaaatacccatctctgtgccccaccctagacaaattcagtccgggactttggagtggggtcaggacattggtgtttgtttaaaagctccccactatattctaatgagccatgagggtgacaaccactgttagagtcctctctctttctctcttttctttcccctttctctccctccttcctccctccagtctagcaggccagtctagctgagattttgtgcttgggaattatctgcttccaggtgagatgtgaggctgtgagattaatgagacctccaaggaaatggctgaaagaaaagagcagaggtgaaatactgcttccaggcaatgtatcaggataggaacaacggaaactgaagccagactttctataatccacccttgtggagtctgtagactggatcaaagaaggtggttacggagagacttagtcacctacttcctaatcaggaaggttggtttcttttccaacatcttagaagcaaattaaatactaaaagtgaagattcaccacagtggcaaaaactatttctaaagagactacatgtgaaatttaactaaaaagagatgttaaacatctcttgtcaaattctgtataatagaagaggtacattattagacccccaaatagcactgctatgatttaatcatcactaactgtatctgtaccaagaggctgggtcagagccacgattagacatcgatgctatatttgctgtatccatgtgacttaccacaggcgccctgctttttagtgatagagaaataggtcctgttccaccttgtacttcctgctccaaacacacacacacacacacacacacacacacgcacactccagaatgagtttcagatcattttaaattgatagtgaccttaaatattaaagcctagggatgctttgataacttgcttttctggcgttttggttaataaatggtgttttttacaacatggttaatatatgctttctaatagaaacagcgcaatttagtaaaaccatcttttacaatgtttgacttaactacctcacatggtcatgagcgtcacttgagaaggtgtcagtgtcagagggttttaaactccaaatgtttatacaagtgaagcatctagtattgggaggatccaccagggactggcaggggaggctggggggggataggggttgaatgtttccctaactgcccctcctgctccagcccccaccatttctccccagaccctctcacttgcatgtcccctattgccatattgcaaagcctcctccttgtcttagcctcagctcaagtgtccccgtttgctccaaaccatcctcaactcctctggatagaatgagtgttctcactcctctcctctcctccccgaaaactctcttctacccctgttggaacacgtagcagatataccatcatgctgcttcacgtgctcctcaagaacagggccacgtctccttcttgagccttatactaagtactgtacctggcagaggaggtgtgttccataagcaggcaaatgaatacactagctgaaatcaagcctgagctgtgtcttttattgtgtgctactacttatatagaaactctgaattaattcttactggaattgaatgctgtggccatatgcaatttaatatgagcagcagttcttcaactgaggagcccattagaatcacttgtgcaattaaaatcttcctgcctgtctgtctgtccatccatccatccatctacctgcatgcttacctacctgtgatctatttttctgtctacctatcattgatcaagagccctaccagccccactccagacctagttaattcagaatctcccatgggaagaaaggggtacttttaagaaatgcttcacagatgattcctctacgccctggtgagacccattatcggtctaagaaacatataatgaagccactcagacaaaataggtttctactgtttcgtgtgctattaagatacttgcttattgccagtgtgaaagcacattattattagaatgctaaagatcttgtgccttgcacaaaaatgctctgaaataccctactgaagggtacacagtgttgacctgtacacaaagaagcatctttctttgagactgttgcatgggaatggtggtacattctgttttctcttcctccacttactgtggaaagggactcggtagcttttgtatcattaactgagacttgcttaaaactgtacacccaacttgtctttaatttaccacctgctgcatgcctctgcacttcacatcctgggtcttattttcttagtaagggaaatttggcaaccctccatttttaaagcagcttgacttggggcatttttaataaggggataaaaggaaatatagccagtcccaaactttgacagcggtcagtatggtataaagagtgaaaatatcttaggtcccctgtgtgagattctatagtcttcacagcgccgatcatgcttgcttgtggtacttacagaacatgtcactcggtcgggggtggggggtcagttcatttgttcaaacagtaagcatttcacaacattcattaaccttagggtcacttttttaagttaaggaagttcaaagacatttgtttaaataactgtatgactgtgacgatagttgaaaaaagccagatagttgaaaattaaagccaactttgtttttaaaatccagacttcgtggaaaaccaggagctctgtagcatacatttagaataaagctccagctttaacttctaaatatcctggcttatgtcagtctttttgtcacagccctaatgctccataaacaaaggtgtctcttatactaacagatgtgggctttgtctttagctgtctcagggaaggttttcatggaacctcgaaactacaaaaactcccaaagtacccttgagcacctgggttactgtaaaacaaaatcatgtcccagaaaattatgttttcaatgcagggctagtaagaaatgaagttttttttttttggaaaaaaaaaatgctgtacatacttcaccaaattcctctcatcttcaaaaatgcttacaaatatagcttgtttctcacagttctccggtgaattatgtaaatacttcaaatcatcagttctgcttttatagatatgaaactaaggcagagaagtttatttatttattttttcagacagcagcctcatgcacagcttaactgcacataaaaaatgttgccctgacatataaaatccatgtctgcttgagtatatgcttggccatcggccaacccacaaggcataggccatgccaaatgtgatttccattggcttttatgcagggggaaagccaggcacagtttaccctttgggacgcatgcaatattgtttttagggaaatgtggttgtatttgccctggcctcaaaggctgtctcactggaggacaggctttggtcacagttttggtcacaaaacacaactgtccccatcagctatgttgaagctctctgtactaggatatgcaaccaggtgatcagggactggaaatcagctggaaattccaatagaggctcattaattagtggagcccacatatgcagggcatatacttatatggcaggtgggcagcagatgggggacagtgcaaacctccaggaaaagaacaagagcaggatcattaaagaagccttagcattttcacacagagactgagcttggaaatccagtttcagagaagggattggaggattgggtagggaatgtggacagattatagggagagaccaaggtagacacctggcttatgaaacgggtctacagaaaacatcaggaggcccccacaggtttcattctggcttcttcaatttggtgtgaattgacaacaaagaaaactcaggagggcgcgaatgagttcctgtggatcccgagccctctcaggcctcctcggtgcagaagggcaaatccttcccatagttcctgcctctctctctagagtagcacaggacttgggaagccagcagctacaaggaagctcacctgtcaagcaccaacgctttattttaattggtattttgcatgagaatcattaaattgcaactctttcttatatttaatcacatttactggctttctcaaattgaacataccccaacccttgaatagtgtgggattgtgcaaaggaatggaattagagttgtaaaagaagaatgcagttcctggctgagcctgttctacctgctggtatggggccttgggcatatccatgagcctcactttcctcatctgtagtttagggttgattgtacttggcttgagtagtaagtattatgtaacatagattcattttgcacctacgtggactttaaatctttgcgaacagtagctcatttcttcctctcagctacctcccaaggtgatcacttggccccaggtccccctgctctggctccctgagttcctgccttgctcacctctcacattttgctgttgtgcacttgcttctggcagctcccatctccctccttctaatctgctgttttcttctttttgtgtgtgtggtctgggaaaccaaataatcaagagtgttatccttttgttcaaaatgatagtacacagaccccactgaggccttgggcagtgtatgattcacttgtgtgggctggagtttgtgaattttttacatttattcgggccgagttgcagttcggttgatttcctggttcttgacataatggaggtggacagctaggttatatcttttaatgtttcctcatcatccaatttagaaatctccagagatcctgcccaaacctcaggataaaattcaagcccaaaacgtcacacaaggcccctgtgtcaccagcactgtcaccacctctggtcatgtagtcctaggtcccagctccccagactcttcctctcatcccaagtactgtgtgttcctgctgctttgcttggcaatgtgctgttctcctcgcgtacatctggtctccccactggccaggaaactgctcaagggcaatgttaccttaccgttggtttccttagtcctaccccagatgtggcacacagtaagtatttaatgcatgctggctgactcacttcttctgccattgttaccaagctacagaatgttctatagagcacaatgatgtatatagaccatctcattacatagattttaaaaatatttaaggagaaaaggacagtttagagaaatgtagccaaatgcaaacgatgcaaaatgcagcttaatgaggttagtaaaaatccttatcaacccagaaaagtccttgtgaaccttgatttttttgtgtgtgtgtttgacattaaaccaaatttagaatttaaaaatatatattttgtagggattccttgcaggagaagatagaacatgtaataattacagtaacaagtgtattgaatttgattatctcatgaaggaagatgtaccatatactttaaaaaaatgttctcaaggaagatttgattatatcaaaggcataagacctgtgaaatttggccctaagttgaggagtacaaagaagccagccttcacctaaagaaggctcagtctagtgacattgtttatccatttgctttgaacttttcagattaccttccctaacactgatgtcaaatatgccggtgaagagtttgaataaaatgttttcaggaaatgtgagagtggaaaaaagcaatttttaaaaatagcatatttttagacatgatttagtatatgtattttaaactaaattaataaattaaatattgttataagaaaaaagccaaattaccttccctagaaaaagaaattattttcaaactcctaaaatgtattagtatatttaaattgtcccttgctcttaatatatggagagagaaaaaaatgtcatcataatacccaaatgaaggcccaggtgagcagatcacttgaagtcaggagttcaagaccagcctggccaacatggtgaaaccctgtctctactaaatatacaaaaattagccgggcatggtggtgcatgcctgtagtcccagctacgtgggaggctgaggcaggagaatcacttgagctcggaaggagaaggttgcagtgagccaagatcatgccactgcactccagcatgggcaacagagtgagactctgactcgaaataataataatagtaataataataataataccaaatgagagagaaataattctgaactcttgttgaaaatcagttcatgggagtacagcatacaaagttggttttatttttataaaaacattttgtgtgtgcatagagcaatgctcaatccctgaagaataacagaaagaataaaaggggaatttttatattttactctagacttttctatttttggttttgtttgtacagtcattgtgtcctgctttaaaagccaataaattatgttttaatcagttaactggatagcagcacatattatattgtcttaccatgtatgatgcacaatattctgggtacactcagagcacccccataataagttgctaatgacatgggtccctaccccagagtaacttggggtgagtgatatgaagaccctgcctccccacccactccccaccctgccccagtgtaagctattattgaacttgtttctttgttaattagaactagctctgaaatcttgttaattttttttgttgttttttttgtttgtttgtttgtttttagacagtattgctcttttgcccaggctggagtgcagtggcccaatctcggctcattacaacctctgccccctgggttgaagcaattctcctgcctcagcttcccgagtagctgggattacaggtgcctgccaccacacctgactaatttttgtatttttaggcgagacagggtttccccctgttggccaggctggtctcgaactcctgacctcaggtgatccacccaccttggcctcctaaagtgctaggattacaggcgtgagccaccgtgcctggccaaaatcttgttaattcttatgaccaagacgcagtcatagttactaattcatattcacacaatatcaccacaacatggacatttcaactagattttcttccaccttcctaaattgaggacagacttgaggccaaaatcagcaatttgggattatatcaccactcttttttaatgttgtgggaagcagtttattttcatggtatgcggcttttttcacatggctaaattccagcctgtgtctgcttggatggggacatgtgttcaatctgcccttgaggagctccaggcctaaagctggaaccccacggttgccctggatcagctgaggtggttactagagaggctgagtgtgtaaaggcttggccaggatggtaaagctgcgtttgtcattgtgcctacaagctgagtacagtgtcagatatcagagatggagaccacagcaaagagctgataaagtatagtcaaggaggccgggaacggtgcctcacacctgtaatcccagtactttgggaggccgaggcgggcggatcatttgaggtcaggagtacaagaccagcctggtcaacatggtgaaaacccgtatctactgaaaatagaaaaattagctgagcgtggtggtgcatgcctgtaatcctagctacaggggaggctgaggcaggagaattgcttgaacccgggagatggaggttgcagtaagccaagattgcaccactacactccaacatggagtgtagagacagaatgagacttcatctcaaaaaaaaaaagtatagtcaaggaatatggtgttatgaatatttgctgagggcatcatgtgactatcgtttaaaatacagtcatgtatacgtacaatagaattagatagtttctgtgccagaattcttatttattgtgagatatatcaaatttttacttggtgattcagaatttaaactatatcactacctgtacagtttattcaaaaaataaatatttaagttataaatttattagttatttataacttaatctttataagcaaatattatttataacttaagccacataccgtgaaaataaactactcacaacatcaaaaaggataataaatattattgataacttatcgaataggtaattgctgcatattgatttccatttccccttgtgcggtgtgtctccaatagatgtaatatcaccagtgactgtgggaactttgcaatttgctaaaaataactgatgaagcttattagttcttattttctttgtttatcataattttagaatataatttagttgaaagacatatttagcaaatatgaattgagtgcctactgggtcaggcactcttccgggtgcagtgaatggggcagtgatgagacacatggagtccctgctcccatggagcttacattctattgaagccaacagacagtgaccagatcaacaagtaaatgtatgataaaatgccaggaagtggtaagaaccatgaagaaaggtaaagcagagtggtggggcagggacaactgaagagctcttttaggtaaggtgagtttctttccagtgactggccatctaaatgtgactgggttacaaaatttgggagatttgcaagcatagctttgtaaaaccttctttgatcagtttggtgcagtttcaggtgaacgctattttttatttcaatttgcttaaatgcttttaagttttgtgctgtttcaagcttcaggaagtggcccagttcaaagaaagatgctaagaattttaccttgttttgtgtgacaacagaatgaaggcacataattacaccgactatcccttacccctgccaaacctttagtggcccaaattggtttaaaatttagcacaaaaccggccgggcacggttgctcacgcccgtaatcccagcactttgggaggccgagatgggtggatcacgaggtcaggagattaagaccatcctggctaacacggtgaaaccccgtctctactgaaaataaaaaaaattagccgggcgcggtggtgggcgcctttagtcccaggtactccggaggctgaggcaggagaatggcgtgaacccggaaggcggagcttgcagtgagccgagattgcgccactgcagtccatcctgggcagcagagcgagactccgtctcaaaaaaaaaaaaaaattagcacaaaactgcattgttatcagaagatgttcccatgtcttaagaaaaaccttgcagtattaaggtggcagcttgattacacaaataataaatcatgtcttccttaataacaaagacctgttgtttatccttatagagaccaaattaacacgtttatttcgggaaaacgttgctcttaagagcttctgcctgcctgtgctatgtacaccaggggcatgatgtgaagcgtgtcaattaaagaaagacagggaagggttttagcaaagacattagaatttaaacaaccaaggagattttctttcagctatcacattgagcaggtatatattcaatttaatatattgatattactcaaaacaagtttggaattcctcttttagaattgtctttggagctactttacaagacaaactaaaacgttaggttgattattagtgctttcctttgccaacttggcgcttcctgctcagtgtatgtcaatagattagaactatttcttacccttgagacgccaacactgttgtgaggagaccgatgagacatagaactggaagtgcttaggtatctatgaaccaaacaagttagaaggtccaggagggaagtgccacttggtgatgtaggggaggctccaagggtgatgatatttgggctgggatgtttgaagaacaggttcaagtttgctaggcagagggaaatgtgagtctctaactttgtagctaaacattattattttcaaaactaagatagctttactcagttcgataacttgccttattcatcagacttagaccagaatgatcttgactaatttaaaaaaatttgtggaacacagatattttataccatttaatttcataaatatttattgagttcctaattatgggtaatatactcagctactacgtcaggtagccttgcggaattcaagagtctttccccatcttttaatttttgtattaaggtgagattcgcatgacataaaattaactattttgaagtgtccaattcagtggcattcagtacattcacaatgttgtacaaccaccacttcctttttttttttttgagaagaagtctcgctctgtcacccaggctggaatgcagtggcacgatctcggctcactgcaacctccgcctcccaggttcaagcgattctcctgcctcagcctctctagtagctgggactacaggctcgtaccgccacgcccagctaattttttgtatttttagtagagatggagtttcactatgttagccaggttggtctcgatctcctgaccttgtgatccgcccacctcggcctcccaaagtacaaccaccacttctatctggttccaaagccttttcatctacctcaagaaaaccctatacccattgtgcagtcatgactattgtccccctcccccagactcttgcaaacaccagtctgctttctatctctattgatttacctatttgggatatttcttataaatggaatcataaaatatgttaccttttgtgtctggcttttcaaattgaacctaatgttttcaaggttcatccaggttgtagcaggttatcaatacttcattcctttgtatggctgaataatattccattctatggatgtaccacgttttgtttctctattcatttgctaaagtacattgggttttccccaccatttagctatcatgaatagtgctgctatgaatgtttgtgtacatgcatttgtctgcattagtttcctattgttgctgtaacaaattgccacaaactttgtgactgaaggcagcatatatttattacctgacagttctggaagtcagaagtctagcagtctagtgtcagcagggctgcattccttctggaggcactgggggagaatctgtttccttgcctttaccgacttgttagaggctgctggcattccctagcctgtggtcccttctcctaggttctaagccatcagagtagcatcttctcatctcagacctctgctcctgtctttgcaccttctccctctgactctggcccttcgcctccctcttataaggacccttgtgattacattaggcccatccagataatccagggtaatagcctcatctcagaatccttaatttaatcatgtctgcaaagttccttttgccatataaggtaccatttataggctctagggattaggaggtagatatctcagggcagggaggggctgaaggtgggggaagagggagatcattgtttaccctacccatggtctttctcacttgagcaaagtctgatttctttagcagtgctggtcacaatcctcactaggctaatattttcattattcagtttactttctggccaatgggaaagaagatgaatgtttaaatgcaggagatatatatatatatatatatatatatatatatatatatatatatatatatatatactgcaaatccttgagggcagagatggccttattcaactcttgatctccagtacctaatagagttcaagtcacatgttcagtaagtacagaagataatggtggtgagttatatcctgaaatgagggagggtatcattttatagttttcttaaagatgtccatagaaataataagattctgtaactccaaatacaaatacagatctattatatgaaaatcatattggtcatatgccctctccctaagcatcttctggagggggaaagagatagacatctaaccacgtctgctgagggggacagaattttaccatctgagaaagagcagaacatatttttggcactcagtctaaatttttcctttcagtggtatttttaaaaccacgtgaagtttcagcatttgaattattatcaagctccacattggacaaggaattagctaaatattaaattaggtaatttgggctttattccaaactaaccagtacctcacggtgatggagaaatacagtttggcatcctaatggtacctctacaaaatgtccttgagtattgcgatggaagctcatacaaattagtgagaactgtgggtgtgagtaggttgaagattttactagccactttatggagtatgagtatgctccaccgtgtaggtggcccttagcttgaaatattgtgtcacggtacataagtactgtggagttgtttacatgttgagtgtgctgccaagaggaggaaaaaattccaaggagatgcgtattgagagggagcccaaaacagagcagtgcgctcttccatgatgagaatgtcaagccctgagataatgaaattcaaatgaaaggagcggtcagggtgctgctcagcttcgtttggagtgttctgtgtcgtgtgttattcattgctgggaacaacctgtaaaatgtgccatctgcaacatgtggcatcatagccttcgtgagtgagcagatgatgtgatccaagctgccctctgaaaagcaatcaacagtattacagctcttctgttttcatcttcttgtggttcacagttctattaaggtaatctctgtgacaagaagaagatgaaaatcttggatacatgaccaaaataactttaatagtgggatttgagtcattcttaatattataagtcattatatttcataattataattcataatattaagataaatgtttataaatattatttgaatgaagatcaaaaaattaaaagactttatttactatcatttaaaatattttcttgttttgtatgaatgcaaacattgaggaaacaaagtatgtctagaaagctatagtaaggcatattccttctggctacctttagaggaaatttaagaaataatgttaatataccaaatgtttgacttgatgacatgtttaaattaaatacaattgtagaatctctataactacctaccagttttatccaaattgtattattaatctgaaacctccatgccttaattatagctcaaaaacaaattaaaagtgttgtgataactgttattgactcagtaaacaactatcattaatccttcatagggtcgttgcaggattaaatgagttaacctttcaaagccccattcctgacacattatttataaaatgaataaaaatcatggtaatgaattcactcatccaacacgcttggcaaggcaaagtaaattcctttgtttaattgaaactgaacagagcaggtctacatcatacgtaattcacatgttatggtacaatgccatttatactggaaaattgaaactaataagtgaaaataagtagtgatggaactaagccagaaatacactggtatggatcagcctttggagcagggaaagaactgagatggttcacattggagagaactcttgaactccaagtctttctcacaaaaagtcattcctaggtcttcttaataaccagtgcttcatgcaagtcatgtatttaatggctgctcgaagtgacacaaactgtagcaacaagttatgccacaaatcctttcttctctcccttcttcaataccagccttccttgttggaaggtacaaagcaaggaattaaatacttaacacaaacactgaatgcccacagcagcattttataagaggagttttatgtagtatctaacatgccatatgttacatcatttcaagaagatttaaccttctagtagaaagcattcttttttatttttatttattcatttgttttttagagacagggtctcactctgttgcccaggctggagtgcagtggtataatcatagctcactgcagcctcaacctcctgggctcaagcgatcctcctgcctcagcctccctagtagctaggaccacaggtgcagaccaccacccctggctaatttaaaaaaaattttttttagagatagggtctcactgtgctgcccagtctggtcttaaactcatggcctcagacaatcctccttcctcggcctcctaaagtgttgggattagacgcctgagccactgagcctggccaggcaagctttttttagcctgcttcctggctccatctgcagagcttgtgtgcttccgtgcctatggtacacccagttactttgtattaaattgaatggaagactttctcacactaatagggaaaagacaaggccataaattcagctgaattcttaaccgataatgtccagcttcattttcaaaccccacaaacgaggtctcattgacaaagttcagtctgcagtctggtcctgggaaccctgtgcacattctaggagtgagacaattttagaaatgttgagcttctcgtaaagtggacacactctagaaaacatcattaagagacaagcagagtagaaagagacaaaaatgatggaaaccctaagattctgtctttatttggcagtcccttttttgatcaaatttgttccatttctagggctatgactatatctgttatagtaccatgccatttatgctggaaaattgaaactaatacatgaaagtaagtagtgatggggctaagccagaaatgcactgttatggatcagcccttggaacagggaaaagaacaaagatggttcacctcccaacctggccccctgcccctccctggccctgactctaagcagatggtcaatttgcattgttccagaagtagagaagcaggagtacatcaactacaaggagagcctcaagctgccttttttgttttccctatctcgagcactgcctcaaactcacctagggaaggctgctgctttgaggtccacatgatattgttctttagactgcttctatttggggaagaataagaatatttttaatattctatcttgtattttacctaagtatgtatgttattttaaagaaactatttagatacccccgccaccaatttattaaaataggctagaatttgcaaataaaggcaaataaatgtgtttgactttttaaaagttaatgaactttgttttttagaggagttttaggtttacagcaacataaagagcaaagtacaatgaattctcacaggtgtcaggggatgtctccccccgactatggacatccaccactagaatggtggatgatttgttagaatcaatgaaactacattgactcatcattatcacctaaagcccaacattagggttcactcttggtgttgtacattttatggattttgacaacgtataatgacatacattcactgatacagtgttatatacagcagtagttatatacagtagtttttctgatctaaaaaatcctctgtgccccacctattcatcccttttcccccctaaatcctggcaaccactgacctttttactgtctccatagttttgcctttttcagaacatcatatagttggaatcatatggtatataaccttttcagattggctcctttcacttagtagtatgcacttaaggttcctccatgtcttttcacgtcttgatagctcatttctttttagcacagaataatattccactgtctggacataccacattttatttatccattcacccactgaaggacatcttggttactttcaagttttgtcaattatgaatgaagctgctataaacatctgtgtgcagggctttttgctgacataatctttcagccgatttggttaaataccaaggcgtgcaattgctgaatcatagggtgagagtatatttagttttataagaaactgctaaactgtcttccaaagtggctgtaccattttgcattcccatcagcaaagaatgagagttcctgttgctccacgtctctaccaggatttggtgttgtcaatgttctggattttgaccattctcaaagatgagtagtggcatcttgttgcttcaatttgcaattccctatcggcatatgatgctgaacatcttttcatatgctcacttgccttttccacctgtatatcttctttggtgaggtcttcctttttagtgaggacctctttagagagaccttctgttcaggtcttttgtccatttttaaattggattcttcattcccttattgttgtgcttgaagagtttatattttgggtaaccatcatttatcagatatgtcttctgcaagtagtttttcccagtctgtggcttgtcttctcattatcttgacattgtctttcagagagtagaagttgttaattttaatgaagtcaagcatattaattatttatttcatggatcatgcctttggtgtagtatctaaaaagtcattgccatactgaaggtcacctagattttctcctacgttatcttctgggaattctgtagttttgtactttatatttagatccataatcgattttgatattttataaaggtctctgtctagattcattttttcgcatttagatgtccagttaccttttgaagatgaactttgtaagatgaactatagatttaagatgaaagtaaaaacggtcctcgtttagaagccaatattttacttaacaaggcagtatcataaaatgactatgataattatattttatcctacttttacaaaatactagtcagtgcaggtatgcctactgacatcatttttactgtactacggcaggtcttccaacagggaagtaaaataatctcatgtagaaaatggcctagaaaatgttaagctctgagtcccatgttggccttttgcagtgtgataactttcagaacaagatttctttttccttttgcagctaatccaacaataaaaatataattatggaattgcaacctctttgggagaaggtcctaatatatgttctaagttctcttctggaaagttacatcttaagaatgtaccgttcctttcaaaggctataattaaacaatatgttttcctgctgcctgatcttgccagaataggaacacttagtccttttcatttaataagagagcagttttgctaaaaatgaaacttaattttaaaaattttgatatgtgccattgtatatatttgaagatggtatttatatcctcagaggttattgaagaagaggtcatctgattttaaacagaggtcttggtgccagctgtgccttgtgctactgatcagtttgtgttcattgtaccataagtgtttacaacaaaggagtctgatagtgaggatgagccagttagatgatttatctctggtttattccattggagaatgaggcttggattcatgccaagatgataaaagacaatagtatctgtgttataaggtgtcaggctgatgactttgtagttgggcatatgcagatagcttcaggcagatcttgggtaatttgcataccacaaatatttgctcaccgtctatggctagcaaatgaaacaaataccacagcaaatataaaacctggccttgccttcatgggatctcatagccacaaattagtggggcgtcacaaatttaaaaatcagcaccaatattttaaatcattttctcattttttttttagaaaggaaagactaatttagatagcctgaggaactgaagtaatttctacgcacagaacatgtatctactctaagaaaaatgaactttcttagggtcactattatcattaagatggtgcacaaatatattcaaaagcatgacatttatcctctccacattcttgttctctgcagatggcatgtgttactttatctccattagtatatcttttctttttaaaacccaaattagattatacatattgttacatcacaataatttttcacttaacagtatccattggatatctatccatattgatatacatggatattttaaatactattccattatttgcatgtactcaaatgcatttaactagttcatattgacggagcatttaggatgtgtgtgtgtgtgtgtgtgtgtgtgtgtgtgtgttttctgttacaaaaatgccacataaagcacacatttcagaaatcttcagttacttaaataaatgtaggacaaactcttcaaagttggaattgtgggatcaaaagtacgtagctttaaaatcttgatagatactgccgagttttccttctaaatgtttctaactatttatactcccacagtcagtgtatgagagtgcctctgtttcccaccaacctcagcaacaattaatattagcaggcctataaatctttggcaacccaataggtgaaaaatcatttctaattattgttttaatttgttttgtctagtgccagtcgtatgtacttcttttctgtgaccaactcttcattcttagcttttccccattttactttaaggtcgtcttgttgatttataatggctctttatattagggatattatgcctttatcatgaatgacacaaatgcaggccttttttatttgtatgtaaataagaaagcttttcatctttataagctttttatttaaggcttctagattttgtatcccatttagaaaagctctccccttcctaatttattttttcaaaactggaccaggtgtggtggctcatgcctgtaattccagcactttgagaggccgaggtgggcagatcacttgaggccaggagttcgaggccagcctggccaacatggcaaaaccttgtctctactaaaagtaaaaaactaaaaaattagccaggcatggtggtacacacctgtagtcccagctagtcaggaggctgaggcaggagaatctttgaacccaagaggcagaggttgcagtgagctgagattgtgccactgcactccagcctgggtgacagagtcagacctgtctcagaaaaaaaaaaaaaaattaaaccatgctttcctctgctgcctttatggtttctttttgttatatgcatgaaaggttatatatattttattatatatgaaatgtatttttacataaggggtgaggttgggatccccatttattttctttgccaatgcgcttctacacatcattcattaattttctgattcatttgaagtatcacctttgttacatattattttccatacacgttgagacctatttctgaatgctttatatcagtgtttttcaaagagtagccaataaatcacttaaggttgtctgcagtctatcaggcagtctataggcagttggattccaagaaaaatgttattaaactatttgattcacaaatttaaaatagaagataaattattactttcacagaaattccatgctttcttaattattttcatgcctttaaacattgcccatgcattagctcatcttgggtagcatatatttaacaggatagattttgccatgaacaatgaattttcaggtcatttgtatattattgttttcattatgaagtttgcttcttatttctgttgggctatgatacatacccaactcaccaaacaagatgaatggcttcaaagtcattcattaaagcataaatgtcgagtccttttggttgtctcatatcttagtacctttctcatgtagatgaatataattctagctgaaagtggaatagatcttccctctgccatctcctggccatcagcccttgggcacatggccacatggccctaggtgtcaccattagatgctctcaatccagattctcaacacgagggttgccataaaggtacaggcctgaagagatttgccatggtggccttcagtggtagggatggagtgtccaggggttgcatagtttggcagcgtgactaaccgggggtggtgcaaatggtggtgtgctaagcatgtggttcttctgagggatccttgctgtgccttgctcccttgtttttgctctaacctcaattccatgagccactcaatatccttccaaataattttttttctaagttaaccattcttttgtttttctaagttaaccattcttttgttgtttgaaaaaaaaaagaaaggaagaaaaggaaggaaggaaggaaggaaaaaaggatgaaggaaagtaaagagcacaggaaacgtaacaatgatatttagtttttcttggactggtagcttatctattcctagtcctcaatatgttctcagtaagactttgcgaaattgaagtatattcattttctatgttgcataacaaattatcacaaatttagcagcttaacacaacacatattaactatgtcacagcttgtatgggtcaggagttcaggcacaacttagctgggtcttctgcaaggctacactttaggtgttgggcaggacacagtcctcatgtggaggcttgactggggaaaagggactggtcccatgttagcagagtcagttctttgcagctgcagcactcatggcagcttgcttcttcaaagccagcaaggagagcaaggctctaatgcaaatctgctgtagcaatgggagtcttttataacataatacaatcacaggagaaacatcccttcgcctttggcaaacgtgataacatagtcatgggagtgacatcccgtcacctttgctatgttctagttgttagaaacaagacacaggtcccacccatacttaaagggagaggattacacaaaggcttgaacaccaggaggcagtgatcatggggggatcatctaagtgtcagtccaccacaaagctttcatgtcaatttcaaacaaaagcaatagcatttctggtaaaaacaatctaatgattccagagcaaggttacaataatatttttagtgtgtagttgatgaattatttcagtaaatatagacagaaaccacaaatactaaggtcttccttgtagcaaatagagacttaagttatagtattgctgagagcttgattggcagttacaaattcagtgatcgctatggcttaaaaagaagcagaggaatgccaggtgcagtggctcatgcctatcatcccagcactttgggaagccaaggtgggaggatcactttaggccaggagtttgaaaccagcctgggcaacatagcaagaccccgtctatacaaaaataataattaaaagattagctgggcatggtggtgcatgcccatagtcccagctactcaggaggctgagatgggaggattgcttgagcccaggagttcaaggctgcagtgactatgatcataccactgcactccagcctgggccacagagcaagaccttgtctcaaaaaaaaaaaaaagtattacacacacacacatacacacacacacacacacacacacccagctatccaagttttgagctaatttttcattttatattaagcattaaacaccccaaatgtatatttgcttaagaaaaaatgctaaatacatacttttaaaaaagggcagtgaagttagaagatgaatgttagcaggcagattcatcatacttttccttcaaatattttaagaatagtaaatccacagacaatgcttcttgcatatagggaagtacatgtgtcttgtccattgctctttctagcaatatagataaattcctttgttctactctgtcaattttcctgcccaattgcatatttgtccttaataatcagtagtttacaaaatttattctgtctaaaaattgtaatttagagtgttcgtagcttccccaaaactatgaatgacattatctccttaatgatcattttctctttgcccagttgtcaggcaataaaattattcagtgtagcatcaaaagcctcagccaagggctgataaagtcagatgaatctacatacttatgcataattttttaacagtgtccaatattcttctgaattatttttgaatcattacatctttctgctttcatgagccaccaatgacatgcttcataaaatgacaattgctgcaaagtacctgaagtacagtctgtctttccaaaacaaattaatggtaagatatacctatagcaatgtaatgttgtaaaacaaatgtaacagaactttatatagtgatttaatctttaaatcacgttgggagttagtgtttatgccatcaaggctatcattgctcaaaacatttcaaaaattactaagtgaaagcatattcagagccattttataagtgacacaagcaaaataattcttatttttaattcacacttttgttttctgcttatgtagatcacctatttttacttttggcatctagatgacatttggcccattcaaaaagaattaattgtgctggggaaaagtctttaggtttgggagtgagaaagcctgattatagcgggagggattactaactctccctttgatgatggattagcataccccatcatgagtaaggatagcgatggtttgagcaagacagttgacaagcttgatgtaattgatcaagaactctgcacacaacaagtagatattcattcctcttaggcaaatatgaaacatacacaaatattgactatttacacagtcacaaaagaagttttaagaaccactgaagggtgatttgatttgcattacattttctcactgtagtgcaatgaaattagaagtcaacataactactctaaagataatgtgttctggttcctagcctccagaagctggaggaagcaaggaataacaacttgttattaatagagtcatgtgctacataatgatgtttctgccaacagtgggccacatatatgatggtaattctgtgtaactgtaatagagttgaagaattcctataacctagtgatgtcacagttgttgtgctgtcatagtgcaaatgctttactcacaagtttgtgctgatgctggtgtaaacaaacctactgcactgccagttgtatataagtgtagcacatataattatgtacagtgcataatgcttgataatgacaacaaatgtctatgttaccggtttgtggatttactatacttttaatcaccattttagagtgtactgcttctacttactgttttttaaaaggtcactgtaaaacagcctcagtcagttcctccagaaggtattccagaagaagacacaaaagatggatagatgagcaaagttaaccaggtcactcagtcaaatagaatagaataacgttctcaaacaaaagacttacagagagacataaggagagcaacttgctatctagctagatgcgtttatggaagtgcagagatggaggagaagtgagccaggagacgaggctggaaggtgaagcagacctcacagaaccagtcaatgcctacaaaaggtcaatgggttttgtattcctcttgattgagcctcagaacaaacattttccctttctgttttctgtcaactaatttagtgctattaatacattaataaactactacttaatctgaaaaatgctaaaagtattttttcaaatacaagggacattctcaagcaattgtgtagtggactgcatagtggctcctcaaaagatatgtctatgtcctaacttccagaacctgtgaacgtgactttatttgaaaaaaagacctttacaggtgtaattaagttaaggatcttaagatgagatactcctggatgacccaggtgggccctaaatccagtaagtttccttatgagagacagaagaggagaaaatagacacacagaagagaaggcatgtgtcttagtctgttttatgcttctgtaacagaatatctgagacagggtaatttataatgaatgagaatgtatttctcatagttctggaggttggtggtccacgatcaaggtgctggcatctgctgagggcattcttcatgactcagggaggcaggtgtcacatggcagaagggcaaagagagagcaagagggggttcaaacttgccattttatcgcaacattaatcccaccctttgcagtggagacctcatggcttaatcatgatttaaaggtcccacctcttaatactgtgataatggcaatgaagtttcaacatgaagtttttagaggacaaacattcaaaccatagcagcatgtgaagatggaggcagagattggaatggtatagccataagtcaaggaatgcctggagcttccagaagctggaggaggaaaggaaggattctcctccagtgccttgagaacgagcactgccctgccaattcctgacttcttaccttcagatctgtgaaataatacatttctgttgttgatttgtttgtttgtttgtgtgtttgttgttgttgtttttgagacagagtttcgctcttgttacccaggctggagtacaatggcatgatctcggctaaccacaacctccgcctcccaggttcaagcgattctcctgcctcagcctcctgagtagctgggattacaggcatgcaccaccctgcccagctaattttgtattttgaatagagacggggtttctccatgttggtcaggctggtcttgaactcccaacctcaggtgatccactggcctcagcctccgaaagtgctgggattacaggtatgagccaccgcacccagccaaatttctgttgttttaagtcaccaagcttgtggtaatttgtcatgacagccacaagaagcaaatacaagcagctgagatgaaatggagttctatatacattttttctcttgtgacactaaagaatgcctagatatttatgcatctaactaggtaatcgtgtttgtcccactcatgcatggccaacagctacatagaggtgaattatatatagctcctctgcagttaagtacactgtagcgcctctttaataataccagatccttgattcagaatgtcctttccattccacatactatagtcccaaaccctagatgaggtcaggatacactggccttatactgacactgttgtaaaatgcataggaatttaatcaatgtcctattattattatttgtaatttcctcttggtcttggaatgtcctacagtttttgaagatccagcttctgtaccacattgttattagggagaaattatttattgtctgcatcgcaagcaggcttgctttggaagcacttcgcgaacctaaaaaatgtgatctgttgaccagaacaatgaacaactatggtaatataagtaagcaaaattcacaaataaacacctcattgtgtcaaagatttgcaccttcttatcttcagagctcttagaagaactgcagtcagatgtagtggtttgggcatggcttgtttgattgtgttatggattgagccgtgtccctacagccttgcatgttgaagtcctaacccgtagtacctcagaacatgaccttatttggaatagggttgttgcagatgtaattggtttagtttggatgaggtcattagggtaggctctaatccagtatgactggtgttcttataaaaagagggaatttggacacagagatacccacacagggagaacactatgtgaagatgaagacagagattgggtgatgcttctacaaacctaggaatgtcaaagtttgccagcaaaccatcagaaactaggagagggacatggaacagattctccctcacagcccattccaccaatgctcttgtcttgggacttctagtctatggcactgtgagacaatacatttatgttctttaagccacccagtttatggtactttgttacagtaaccctagcatactaatagtttggctattccctattaatttgcttggaagttgttcatgagtactaagatagctcatgaaaatacaaagcaaaagactgtatttaaattatatttcaggtagtttcattgtaaattattttggaattaactatactaaaaagattttatagtgcatatataataatgaattgagtacatcattattttacagagacatcattggtgaggctatttatccaaattattgtttaaatgggtcttttttttgcaaaaaatatttcataaataatctatcccctgactacttgattggcttcagaagtgttttgatatagacatcgtctcaaaccaaatttaacgtcccttctagttggagaatttttagtggttcgatttagaaatattttcttaaaaatccacagatggggtcatactatgcacaagttacttctgaaaattggttagtttatagtccaaaagtaattaatatttgcatttaattcagtttggaattcagtaaattttagtaacattcctttgtgaagtcaagtcactggttataacaatgttttaaccatcagttgtttataatgcattgtttcatctatatataagtcatgggcattgaggaaggaaaatgtaccttcagtgaactttgaaatttagttcctcaaaggagggctattactagaagtgaacagaagtaaaacaaaataataactaagtatacagctcataaatgttcagatctagataattatgtttaatttctgcttttgcttaccatttaagatcaaacctctaggtatcttttaatctagctctttagattgttaaaatgttttatgtgaaatgcacatttagtttataagcagcaatttagtgtcctgtttccatgagacattgatattaaataaaacactagaaagaagtaatctaacttttttctcctttgtacaagcccctctttgcacctcatgtgatgttgcttactggatatcaaaaaagattagaagcagggtgatttcagatcaaagaagaagcatctgcctacccccagggtttttaaatatttaaatatttttctcgttaaaaaagtaactcaacagaactctaaataaaatacaattttaaggaaccaatgtatagtcattttaagctattgccagcaaaccaccagaagcgaggtgaaaggcaagctattatataatcacactttttccattgtattgaaagttaaattcagcttatttgccaaagaatgcttcaaatacactgaaattttacataatagtacaggctaaggcgggtggaacacaaggtcaggagatcgagaccatcctggctaacacggtgaaaccccatctctactaaaaatacaaaagaatgagccgggcatggtggcgggcgcttgtagtcccagctactcaggaggctgaggcaggagaatggggtgaacccgggaggcggagcttgcagtgagccgagatcgcaccactgcactgcagcctaggtgacagagtgggactccatctcaaaaaaaaaaaaaaaaaagtacagttatgaacctgtattattatatcacagttagactcaaatgactcttaatgacatttatttggactcatgtatattttaggctttttttttagcataattcattgactctaagatgtaatacttttcacattttatcagctttaaagtcaggatatgtattataatcaatggtttcttacaaatataattggcaaccatgttttgtttttcttagtggtatgtaaaacaatggtgtatcttaaaatcaatcatggcatcttagggtttgttttttttttttgccttttaagtaatgtttatttttcatttgcttgttttttctgttttttgatatttttaattttatgtctgtaggctattggggaacaggtggtgtttggttacatgagtaagttctttagtggtgatttgtgaaattttggtgcacccatcacctgagcagtatacactgcaccccatttgtagtcttttatccctcacccccttcccacccaccctgagtccccaaagtcaattgtgtcattcttatgcctttgcatcttcataagttagttcccacttatgagtgagaacatacaactatggaaaacagtgtggagattccttaaagaactaaaagtagatctactatttgatccagcaacccactactgggcatctacccagaggaaaagaagtcgttatacaaaaaagatacttgcacacagatgtttataacaacacaattcacaattccagaaatatggagccagcccaaatgcccatcaatcaacgagtggaaaagaaactgtaatatatatatatatgaatatatatgaatatatatagatgatggaatactactcagccatgaaaaggagtgagttaatggcattcgcagtgacctggttgagtttggagactattattctaagtgaagtaactcaggaatgaaatgaaacatcatatgttatttggtttttataacaggagatatagcttgtttatttcaagccacactcagtgttggaaaatgctgtttcttattctgtaggtccagcattcccaagctaaaagaaagttgtgtggcgctaaagtgtttggcaaggttgtattattgataggtgaattgctcataggaagagaaaaatttaagtgactatattaagaatgttctggtatttatagttctctgtcttttccattcttgagaatgtaatgttctttgtgttactctttaaagcaatggagaataaataaattgtttagtaagtcatgttgacattattccttaaaaaattgaaagagactgtatgtcccttcctcatagaatacacaaaactaaattacagctgaattaaagatttacatctaaaagcacttaaaagtaccagaagaaaatattttttaaagtgtgtattcgtatcactagagtgtggaagtcattccataatatgacactaatatcaaaatttataaagaaatgattgaaaggattgattacctcaaaatatataacaatagtctatcagaaaagatgaagcatagatttaaaaaaactggagaagaataattatgcagagataaacgtgtcagaaacaatagaatactttttttaatattttacatcaaaatgtatattctccagtccttaaacaggcattcaatgagcatctcttatgtctgaggtcataggctgggtacaagagaggtataaattaggctcaaatggggcccacaaagagccccaaatctagggttttattttcattgttagagtgtctatgtctatgtcagtaattgggattatttttaaactgaaaaactctatcccactttaaaactcctaaatagaacaagcatttatctaaccttaatatcatagcataactccttaaagtttattgactttaaaataactaaattcagtagctctcaaatatccatagtatgagtgacagacctgtaaaatctaattgactttatttggcagacacaggcaaacacatacatgtattttaacataatatgatgactacttagacataacctgatccttcaaatataactgaaaaaaaggtgctccattttgcatgatttattattgaactagagttccctttcctaggtacatggagcaaatagagaagataattagaattccacttttcttgaaatgtcaagaagggcaggtgtactctgacctcagctttaagtttaaccaaatatatagggggatttgagactgctccacatgtttctcatggaatttcccccaagcactactctctgaagagcctgaaaaagtatgtaagaaaagccttgttctctcttgacatgaagttatgctcagcctgcttattatgctagagcttagtgtctgaatagcagagaacgttttctcatccttagttatgtttgttgttctaacataacagtcttctgatcacgatgattctctataatcaacatttcttaagtgcccagtgaggtaagccttgcttctaaagaattttaaaatgtatttttagcaaggctctaaagattaagtcttcaccttgctgtcagcagttacatttttttctaaggggtaaaaagcacaaaccagaattatgctagatctccattaagatataaaacattttatggtgccgggttgctgttgacctacattgataattggaaatattacaacttattgcaaaggtactaagtattatctattataatatgtgttttgcatccctttctgtgatgtagataatattagtcctattttgcagatgaggaaaccaagactctgaaagctaaaaagcttgctaaagtcacgtggctaatgagtaataacaagattcaaaatcaaaacaacctgaccctgaaaccctcctgttaaccagtgaccttttctcctctcaaaattctgcagtaaatggaaaccatttcacatgtgtttattcattcacacctacagtgtgccagctcccagtgtagtctaggtatactatccatggtgaagaggacagcctaggtcgttgccctcatgggcttgcattccattgagacagatacatttctcagtgcttaatttagttaagtgagatgggggcgggaaagaagagaaaatagagagacagagaatcatggggttttgactttacgcgggagtcagggaaggcctccgtgaggatttgttagctgaaaggaaaccttggttgaagtgagggaggaggaaaccttgcagatatcttgggagaagagcacctgtacagaaagaacagcaagtgcacagccccctgtgctgggaataggcttgtgtctgagaaccacaaaaaaagccagtgtggctggaaagggcaggtaagggagagcataaggggaaatgggcacagagctagccacagccaactcagggaggcgttgtaggccctggtaaggatttaggactttcttttgacttctgtgataagaaaccagtgaagggttgggcttggggaagttgcccctggctgtgtggccgcagtggaaataagggaagcaggtaggatcctgccgtgacccgagagagatgtatggctgcgacagagccacaacagttgggaactggtgggtgatgacatttggggtctgttttgagaattcaggggatttatcatctcgttggtggcaggaacaaaactcatagcagcatagtgcaagaatacagacagcatcctgttaaggaccgcagtgttttctgcaacttcttccatgtgtctactgcaaattgtctgagaagggcagggcctaggaaacatggtggaagttttgagataaaaatattgcagcccatctgcatttccctgggagctcaattagtcatcactttgccttattatttactaagcgttcatcatagttctaaatagattcctcaaaagaattaaattcaaagggcaaaggggtagaaaatggatctgactgtctctgcactgggagtccctgggagggggggacgaggaggaacagaccaaacaaagcatggctgatagaaagggaagcctgcgatgggtgggttgagtcaggtaagacagagaagcttgctaaggtggagtggaaggaaatcctatcattactgtggctgccctctgaggtaggaaggaatgaagagcccgggaggtttaaagtgctctgaagcactgatactgtaaatgtggcatgctagcataggggaaagtgtaattcagacaggcagactactctgtctgcattcctacaactgcttctcctccccaggatgtgcacgtgtgtgtgtctctgtgtgtgtgtgggcatgtgtctctgtgtgtgtctgtgtatgtctatgtgtatatctgtgtgtatacaagtgtgtgtctgtgtatgtgtccatgtgtgtgtctatgcatatgtgtctatgtatgtttgtgtgtgtgtgtgtgtctgtctgggtctatgtgtatgtctatgtctatgtatgtttgtgtgtgtctgtgtgtctatgtgtatgactgtttctatgtatgtctctgtgtgtctctgtgtgtgtctgtgtgtctatgtgcatgactgtgtgtgtctgcatacactcaaaatgcttctgtggaataaagtcaattagattttgcctttccacatggcttctgtatgacctgtgcttgaccaaccatcaaccaaagcccacggcttttcctctgaaagggatgccacatttttgtgtgtgtctgtttgtaaacagtgacattcaagcacaagggttagggatggagtggataaggagggtgtgaaacagcacaaatcagagaaaatttaagaggtacaagaagaaggttttttgccttggctttaaaatgctggtaaacactaactaattctatgaggccagcatcatcctgataccaaaacctggcagagatacaacaaaaaaagaaaacttcatgccaatatccttaatgaaacaccaatgcaaaaatcctcaacaaaatactggcaaaccaaatccagcagcacatcaaaaagcttattcaccatgattcagtaggcttcatcctcaggatgcaaggttggttcaacatatacaaatcaataaatgtgattcatcacataaacagaactaaagacaaaaaaaccacatgattatctcaatagatgcagaaaaggccttcaataaaattcaacatcgcttcatgttagaaactcttaataaactaggtattgaaggaacataactcaaaataataagcaccatatatgacaaacccacagccaatatcatactgaatgggaaaagctggaagcattcacctgaaaaccagcacaagacaaggatgtcctctctcaccactcctattcaacacagtattggaagttctggtcagggcaatcaggcaagagaaagaaataaagggtatccaaacaggaagaggaagtcaaatatctttgtttgcagatgacatgatcccatatctagaaaactccattgtctcagcccaaaaacttcttaagctgataagcaacttcagcaaagtctcaggatacacaatcaatgtacaaaaattattagcattcctttacatcaacaacaggcaagctgagagccaaatcatgaatgaactaccattcacaatggccacaaaaaaataaaatacctaggaatacagctaacaagggaagtgaaggacctcttcaaggagaactacaaaccactgctcagagaaatcagagatgacaccaaaaaatggaagaacattccatgctcatggataggaaggatcaatatcatggaagtggccatactgctcagagggatttatagattcaatgctatttccattaaactgccatcgacaatcttcacagaattagaaaaatctatgttaaaattcatgtggaaccaaaaaagagcccaaatagccgaggcaatcctaagcaaaaagaacaaagctggaggcatcaccctacccaacttcaaacaaaactacagtaacaaaaatagcatggtactggtgcaagaacagacacataaaccaatggaacagaatagagaagccagaactaagaccacacacctataatcatctgatcttcaacaaacctgacaaaaacaaacaatggggaaaggattccctatttaataaatggtgctgggagaacaggctagccatacgcagaaaattgaaactggagtccttccttacatcttatagaaaaatcaactcaagatggattaaagacttaagtgtaaaacccaaaactataaaaatcctagaagaaagtctaggcaataccatttagaacataggcatgggcaaagatttcatgacgaaaacaccaaaatcaattgcaacaaatgcaaaaattggcaaatggaatctaatcaaactaaagagcttctgaacaacaaaaaaaactgtcatcagaatgaacagacaacctacagaatgggagaaaatgtttgcaatctatccatctgacaaaggtctaatatccagcatctattaatacaaggaacttaaacaaatttaccaaaaaaaacaaacaaccccattaaaaagtgggcaaaggacatgaacagacactttttttaaaaaagatatatatgcagccaacaaacatatgaaaaaaaagctcaacatcactgatcattagaaaaatgcaaaccgaaaccacattgagatgccatctcatgccagtcaggatagctattattaaaaagtcaaaaagcaacagatgctggcaatgttgtggagaaaaaggaacactcttacactcttggtgggagtgtgaattagttcaacctttgtggaagacagtgtggtgattgctcaaagacctaggagcagaaataccattcgacccaacaatctcattactgggtgtatacccaaagaaatgtaaaccattctgttataaagatacatgcatgtgtatgttcattgcaacactatccacaaaagcaaagacatggaatcaacctaaatgcccatcaatgatagactggataaagaaaatgtggtatatatacaccgtggaatactatgcagccataaaaaggaatgagataaagtcctttgcagagacatgatggagctggaagccattatcctcagcaaactaatgcaggaacaaaaatcaaacaccgcatgttctcacttataagtgggagctgaatgatgagaacacatggacacatggcagcgaaacaacacacactggggcctgttagggggtgggagggtgcagggagggagagcgtcaggaagaatagctaatagatgctgggcttaatatctaggtgatggggttgatctgtacagcaaaccaccatggcatacacttacctatgtaacaaacctgcatatcctgcacatgtacccacaaatttaaaataaaaaaatatataatatatatataaaagaaaatgtggatacacagagacaccagacataggcactcacacagaaaaggccatgtgaggacatagagaaaaggcagccacctacaaacccagaagaaaggcctcagaagaaaccaaatcaactgatgccttcatcttggatttctagcctccagcctgagaaattaaagttctgttgtttaagcaaaaaaaaaaaaaaaggccggtaaacactggtgattctgctttatactaaaaatgatggcggtgatgggggaaccgtttactaggtacaaccacaagatatttggtcaaaaaggattgaaagccactacttgctttcatttcttgaaatacatttctttaaatacataccatttcttgaaatacatttattaagcacagatgagtgttgttttggtttttgtttagtgattaagtgtacaatccccaataaaatattttgaagtttttccaaagaaaagaaactctgcctggctgcatcagctagacaaaggtacctgcgctgctgtttgtttgtttgtttgtttgtttgtttttccctgtatctgctggaatattttagctgatggacatttgagctggcattacttaaatgagaatctcttcaaagtgatgcacgctgtgtttttccctgtgagacgtgtgaatgccttgtggatatttgtgagtacacttaagtgtttttgttttccactatgctaggtcagttttcagatcttattaaaaagctcagggtttcgggaatccgactgttctgcaaatgcctgctgctgttgttaagtggcctgtaccatccttgagtaggcaagaagagctgagatttcaccagaaacagtgacattcacacccaggggctgaaataaggcggaatgcccacctggagataagtcttggctgtcacacctggaccgcctgctctggtcatgtgtgtgtgtgatctataatagggtcacagctttatgaaattcagtcactttgtagcagccactctaaggaggatgattcatggtccctgtgcaggcactgcacccagcaccttctcaggaacattcacattatttccagctggattgaggctggaagctccctggcaagcaatagaaaagcaccaggtgttcccagcagcgctctctttcacccttgcaagctgcaactggcaagagaattgtacttgatggcacacggtgtgatggttgcctcactgccagagcatttgttctggatgcctctgtccccaggtgtctcagaagtaatcctaatcattgaactttggccctctggaaacaaggccagtcgcaagacacgtcaggaagcaatttgtgcatcgagactcgagctgctttggagtttccctctggattttagtcaagctgtcacaaagttcatgacttggtttttccactcttgtaaaatgaaggctgctctgactcctgcctgcaatctccagcttattgcctttaatacttccctgttgctattgctaaaccccttaccttatacagactgtggagatgggcaaaggaaaaaaatctccaagctttttgatatggtgctttgaagacacagtttactaatggcctgaaagaattcattgcagcttcccacatgcaaagtttattttcggagagtagtttatatatggaataaatggaatagaattgagtccagaaataaactctcacatttttagaaaattggttgtcaacaaggatgccaagacaattcaatggggaaagaaatgtcttatcagcaaacagtgctagggcaactagatatctatgtgaagaagaataaagtgagaactctaccttacatcatattaaaaaattaactcaagattgatcaaagacctagatgtaagagctaaaactataacaggcttagaagaaaacataggtgtaaattttcatgaccttgaattaggcaattatttctttaaaatatgacactaaaagcacgaaaaacaaaagaaacaataataatttggacatcatcaaactaaaaatgttgtggctcaaaggacaccatctataaagtgaaaagactacccagagaatgggaggaaagttttgtaatgttgtatctgaaaagggaagtatctatatagagaacaattacaatgcaataataaaaagacaaatactccaatgttcaaatgggcaaaggatttgaaaagacatttctccaaagaagatattcagatatctaataaacacatgaaaagatgctcagcatcattaaccatcagggaaatacaaatcaaaaccacaagagaccactttatacccatgggaatgtctataatcagaaagacaggtaataacaagtgtttgcaaggatttggagaaattgatggtggaaatttaaaatgatatagtcactttagaaaacactctggcagttcctcaaacaatcaatcatagagttaccatatgaacagcaattctacttctaggtatatacccaaaaaaatgaaaacatatattcaccagaaacttgtttatgaagtgcagagcagcattattcttaacagcctaaaagtggaaacaacccaaatgttcatcaaactgatgaattcgtaaataaaatatactatatccactcaatagaatattatttgccaattaaaaaaaataaaggctggatactgtggctcacacctgtaatcttggcactttgggagactgaggtgggaggatcactcgaggcctggagttcaagaccagcctgagcaacatagcaagactccatctctacaaaaagtaaaaaattagccaagcatggtggtgcacgcctgtagtcctagtgacttgggaggctgaggttggaggactgcttaagcccaggagttcaaggctgcagtgagcaatgatcatgccaccacactcccgcctaggttgcagagcaagaccttgtctctacaaataaacaaaaactaaatgaagtattgatacatgccacaacatggacgactcttaaaaacatcatgctagccgggcactgtggctcacgcctgtaatcccagcactttgggaggccgaggtgggtggatcacctgaggtcaggagttcaagaccagcctggccaacatggagaaaccccatctctactaaaaataaaaaattagccgggtgtgatggcacatgcctgtaatcccagctacttgggaggatgaggtaggagaattgcttgaacctgggaggcggaggttgcggtgagccgagatcgtgccactgcactccagcctgagcaacaagagtgaaactccgtctcaaaaaaaaaaaaaaaaagaaaaagaaaaaaaagaaaacatcatgctaagtgaaagaaaccaggatgaacgttgtatgattctatttatatgaaatgtccagaataggcaaattcctagagaaagaaagtacattagtggttgtctagggttgggggaattgtggggaacaggaagtgatgctaatgggcatagggtttcttactgggttgatgacaataccataaaattgatggtagtgatggtcacacaactctatgaatatactaaaaaccattccactgtatactttaaattggtgaattgtatgctatgtggattatatttcaataaagaagatatttaaaaatcacaaaatatagatgattagagaatatggaatatgtcattaattatagattttttctgcatttttaatactttctttgacttcacttgctttctcagatgtttcttagaaaacatccaaagcaaagatttacaactctgtacggaagccacagattttgtaagaaaaggctaaagagaaaaagattactgcaatgtagtgtttgcatttatgatttactttctattcacgtttcagacttagttatttactttgcacctattaccacatacttgctattatctctccatacacatgaaagttcttcggaatttttagtaaaatgtcctcagtttctgagtcaaacctgtctactgagaatcaaatatagttttcactaaagttgcttcctacgaattgccatgtgagaaaaagaagaaaacagacgggcagcagatacactattttctcctagttgatggcaaaaattagatctctatcaagatcaaaaaagagttctttattccatgaactaagtttcttatcctaaggtgattaccgggggaaatatttaaaagaagcatcagtggagggaagggtaaatcgtgggataaaatacactcattgactttcttctccaagccaaactgcagaggaaataacaggcgcagagacttctagcagggttgtctggtgggacatgccctgggatatggggtcagtccattcctgtccagaccagggacttcctctgaccttggcaactcagttacctcctgtgagcctaagctttcttgtctgcaaactgagagatctctcaagtctttcctggctgtaacagttacaggggcgtccaatcttttggcttccctgggccacattggaagtagaattgtcttgggccacacataaaatacactaacactaatgatagtggatgagatttttttttaattgcaagaacatctcatagtgttttaagaaagtttacgtatttgttttgggctgcattcaaagccatcctgggctgtgtgtgtcccacaggctgcaggttgggcaagtttggtctatgattttataatctgatctagtattctctgagacatcaatgctagatgaggatacaggtagatgaatgaatattgtagttgagtaaatattacacccggtgtgttgattaatgaatagatgtgatcatagaagaagcaatatcaagatttttcaccagcctctggagttatcactgattagcaaagcattttaattaataactcaaacagaaaaagcatgtctgttagttttgcaatccgcaaaaagatgaacacaatagacatgttaattcccaaacttagtttcaaaaaaactatctgccaggtttcaaatgaacataggcttgattggccacacgaaaatttaaatattatgaatgttgaatggccaaccataagttcaacttgaactaagtttgatgtggctactttttattttttacttttcaaaaattgtggtacacactgcatcttctcactcataagtaggagttgaacaatgagaacacatggatgcagggaggggaacaccacacactggggcctgtttgggggtcgggggcaaggggagggagagcattaagacaaataccgaatgcatgcagggcttaaaacctagatgacgggttgataggtgcagcaaatcaccatggcacatgtaaacctatgtaacaaacttgcacattctgcacatgtatcccagaatttaagtaaaaaaaaaaattgtggtacaatgtacatacagtgaacaattcagagttttgtcaatttcatacagccatgcactccacacccctatcaagatgtagaatatttccaacccctgaaaaaagatccttcatgcccttcccagtcagtccccaccgaggcaaacactgatctgatttctccccagtacgtgtttttccaatcctagaacttcatcagtcatagaatatgtactcttttgtgtctggtttcttacactcaggaaaatggttttgaaggtcatccattttcttggttttatgagtagtttctcgcaggttgtattccctgggaagagacagagatgaacacgcagggcattgataaaggagttctcttagaagccacgtcttttgaaaggcagggaaagaagtcagattgagcagattggggaatagagctgtgaggcagctccagccccagcctcagtgcatcccagtgggggtactggcgtgagattgtctgtcagttatctcaaggtggggtgtggggaccttgatgcttgccccgtgttgatcaggcattggatgtgggctccttctacaggaaggtggtatctcgggcaagcctgcagctttcaggcagggaagttctccttataaaaagctgacagctgagggctgtctcccagcagcactcctagcagccaggggaaataatccctttatttctgagggggggtccaggcagcacatcacagtgttttattgctgagtagtattccattaatggacataccacaatttatttacccactcttctgttgagggacgtttggcctgtccagtttggggctattatgaacaaagctgctatgaacattcctaaactggtctttttatggatatatgtttttatttctgctgaataaatgacaagtagaatttctgagtcatagggtaggtgtatgtttaacattacagaaactgccagactaacctgagcttcaacaacaaatgtgattttaaaataaatttgggtacaaatatagaaatacaccttcaaattaacaagggaaattcaggtgaaacttaaatatgaacttaaaacttaacctgaagttgacctccttaatgataaggttctcctgtgcagtatttgaaaacgaattacagcactcagtctctttttcccaacagatttttttcaataaagtacaaccatgcattgcttaaagacagggatacaatctgaggtgtgttgttaagtgattttgtcattgtgtaaacatgatagagtgtattttaacaaacctggatggaatagcctactatacaacctaggctgtatggtatagcttatttctcccaagctacaaatctgtgcagcatgttactgcactgaatactacagacaattataacacaatggtaagcatttgtgtatctaaacatatatctaaacatagaaaaggtatagcaaaactatagtgtaaagattaaaaaacaaacaaacaaaaaatggggttgggcacagtgactctgcctgtaatctcagcacttcgggaggccaaggtggcaggatcacttgaggtcaagagttcgagaccagcctaaccaacatggtgaaacctcatctctactaaaaatacaaaacttagccggtcagggtggcatgcgcctataatctcagctgctctgaggctgaggcaggagaatcgcttgaacccaggaggtggaggctgaagtgagctgagatcatgccactgcactccagcctgggcaacaaagcaagattctgtctcaaaaaaaaaaaaaaagataaaaaatggcacacttctataggacacttaccatgaatggagcttgcaggactggaggttgccctaggtaagtctgtgagtgagtgatgggtgaatgtgaaagccttggatattattctacaccactatagactttataaacactgtacacttagcctacactaaatttatatttaaaatttcttttcctaataataaattaaccttagcttattgtaacttttttactttataaactttaaaaattttttaaacttttttactgttttgtagcaacacgtagcttaagacacaaactcactgtacagctgtataaaaaccctctgctgagggtgtcagggtctcatgaagctgcagtcaaggtgtcagtagggatgtcgtctcatccaaggcttgactgaggaaggatacacctggaagtgcatgtggtcactgggcagcacgccattccttgcagaatgccagactgagggctcagtttcttgctggctgtgagtgggaggttgccctctgttccttgtcctttccatgtggcagctcacaacatggcagcttgcttctttaaagccaggtgaagagccagtgtcccctagcaagacagacgtgccctctcagggggaggggatcacacaaaggtggattacctggggtctaccttcacatctgtccaccatgctcccaatggtaagaagcatttattgtagtacctcagttagtcaaatatttccttcctccaaaagcagaggaaactagaactcccttccagtttgttcatccatacacagtgatttgtcaggtaatgaatgttcctgattagctttagcactggtgtatttcaaccaaatcaatttttaaacaaaagacaaaggccagtaacattaaaagagaagttgaacagaactttaactgggaacactaaaaacttaaatgtatgtatttagtaggtacatattaaatgtcattatggtaatattcagatctggtgttttctcagttactgcattaaaaaacttaagtgctcatttgtaaatggtgttctattgacaatactgcttactactggtaggcctagcagtaaagctgctctccatactttcaataaatcctcaatctccttttcctatttctcctggtacccacagaccttgtattagtccattttcatgctgctgataaagacatacccaagaccgagcaatttacaaaaaaaaaaaaaaggtttattggacttagagttctacatggctaaggaggcctcacaatcatggcagaaggcaaggaggagcaagtcacatcttacatggatggcagcaggcaaagagagagcttgtgcagggaaactcccatttttaaaaccatcagatccatgagacatattcactatcacaagaacagcacaggaaagagactcccccatgattcaattgcctcccaccaggtccctcccacaacatacgggaattggagatgagatttgggtggggacacagccaaaccatatcagacataagcagtgtattgatacggatcaggttcatttattcattcattcatgtataaaacaaatacctactgagcacttacccgtgcactgactgtgctggtgtttcagtagtaaatgaaacatggcctccaaataacattcagtccagacagatgaggaaacgctgcacaataaactccactgaggaatttgctatggaaatacataaattaagggccgagagaacttgatatccaagtggcacgctccttagaaaacaaattataggagaagtacaggccagatattgagagttaatcaagtagaaagaaaataaaacctcaaggaaggatgtgtcccttagatggtaatagaatacagagacaaacagaggcttgagaactgaggctttagaaaaatctaaatagaagatgggaagaaaaataacccacaaattttaagtagctgcagtgttggcaagctgtgaagtaaagtctcactcttcaaatggcaatatcagttttcagatactagctatttctatactgacataaataatggaatacaagtaaaatattcataaaaaattcatagtaaaatttgcatacaatgaaaaactctagatgaagtaagataatatttaaggtgggaacaaagtaaaaattatcacctaaagtcacagacccaggtgagaaatgcatattaatgttgactgttttattaatgcatgtagttaaatataatagtattcagtgttggtttgtagaaacaaatcactgcatgtgttactggttcacaagaaaacactgtaacacatctataaagaagaaattcaataatctaaaatgcagtggaatctggggcttcatgtgggttttagaatatttagagcaaaacaaaatctagagcactttatcctatatagtaaataaataaatatatcaaagtataacaataattttgcaaataaaataaaaaagcttttaggtaaagattgtttcttatcgtatatttggcccttttctaaaattttctttctttttttttttttttctttgaggcagtctcgctctgtcacccaagctggaatgtggcacaatctcggctcactacaacctcctattcccaggttcaaagggaagctactcaacctcccaagtagctgggactacagacatgcaccaccacacctggctaattttttgtatttttggtagagaaggggtttcaccaggttgaccaggctgatgtcgaactcctggcctcatgtgattcgcttgccttagcctccaaaagtgctgggattacaagcatgagccactgcacctgacctaaaattttcccttgtgcattctcaaaattgcaagttctctacctggaaaatttggaggaatgaaaacccctcagcaaaagaccctcattgcattggagggtgatgtgtggatttaaaatggcaatattccaagcacattttgtatatgtacttcttaattgtgtgattacatgatttctccctgaataaatcttgttttgatgaaagattaagtcagagcacctgcaagcttcattgctcctccccctttctcagctcccatctttatcacctgtttggagaatgtgtcaacattccctaattgagaagtaatttgcagttactgaaatccattttatattaaaaagcctcttcaatatgcacaacttaccctagagagctgttttacttggaggcatttcttagatttaagttctaataaaactaagtgtgttttaggaaataactttatagctttttttcccctattttaaaatacaaggaacataaaagtaaagaagagatgaagttaagcctgttaaatataagaaactacttattttgtttgttattcccttaagatgtcgtttggagttttaaagatatcattgtactacaaataaaaaatattacagatatctatttactcttcagaaagtaaaaataagtagtgggtaggagttcttcatctgtttttagttataaaatgctgaactattgaataatgaaagtgttttaaacaacactaaaaatgcatctgtatttttccctgaatgcaaaacagtaatatttaaattcaccttcctactagggatgtttcagttcttatgactaccaggcagttttgtttttcatcttgaattgtgaattgtcttcacctatattacaattagttttttctttttttctttaatttcggcttttatttttgatacagggggtatgtatggaggactgttatatgggtgtatattgcacccagacagtgagcagagtacccaataggtagtttttcaacccacattcttctcctttccccctatagtacacagtgtctattgttctcatgtttatgtccatgtgtgctcaatgtttagctcccacttataagtgagaatatgtgatatttggttttctgttcctgtattaatttgcttaggatatgatctccagctgcatccatgttgctgcaaaggacattatttcattctttttttatggctgtataatattccctggtgtatttgtaccacgttttctctagccaggcccccactaatgagcacctaggttgattccatgtctctgctattgtgaatagcacagtgatgaacgtacgagtgcatgtgtctttttgctatagtgatctatttccctttgagtatatacccagtaatgatatttttgggtcacatggtaactctgttttaagttcttccaattacatttttcattcaaagttgcagagcactctctcaacatgctgagtgaaggcttgccctccccgtggatgaatgaagtactgaatatcccaaagcattgaatcacttctcttgattttaagattctgtttcattggtgcccttgtttttatcattttgttttttactctgttcttttttcttttctttccctttttagctttatcatttaatattgacctaattcatttgtgtgattatctttccctgaatagatcttttctttgtttttttaaataaatgcgattaaagctttaaatatagctctaattaccacattagcttaattctacatgttttatagtgctttcattgttgtttagttctaaatattttatgctacaattggattttcttgtgttacttaggagtatgtttctttcagtttctaaaaatgtgtgggaggggtttttatttctgtttttaactaggttttcttgttgatttttaatttaattacattatggtcagagatcagggattacttaatatgaattacttaaaatttattgagatttctgttatgatctagtgttaaatcaatgtacagttgccattttcttgagtacaagtctctacacgtttgtgtattacatcaagcttgtcaatgggattgtttaaattcatgaccttaaaaatattttgttttcatgatctattagtttttgatggtatgttaaaaatctctccttattattgtggatctgtccgtttatcattgtaattctgttagtttttgctttagatatatatatggttctgatgtcagggatatatgagataataatttgaacatcctgttagattataatttttgtcattacactatataatatgtccctctatactatttgttattttaccttcagttttaatttatctattattaatattgagattataaattttcttttggtaagaattttcttagtaaatatttttcatacttttattttcagcttttgctgtttggggtgtgtcttctaaaaatgacagataaagaaagagatgtactatgtttctgctgctcacaattttttagtctttgtcattagataagaaagcttattcctttcatatttattgagattactaatttggacttacattgccatcttaatttgtgtcatctttttaagcatgctcttcttcaattttctttcattttctcattatttggattagtgaagctttctttaatccccttcttttgtttagtgatttggaagcttatagttatatctttcttactatttgaaacagttactttttctaacaaagtttaaaattatttagtacatatatctttccccgatcaaaatcaggactttaacatacatgttaaaacttcactacttcctcatttgcagagccgatagtttattaaattcaccatcatgtcctcactttctgtgctcactgttgtttcatgcataccacccttacctctaggttcattttctttctttatttttattttattttattattattattttgagacactgtcttgctctgtcacccaggctggagtgcagtggtgcaatctcggttcactgcaacctctgcctccctggttcaagtgattcccctgactcggcctcccaagtagctggcattacaggcacctgccaccacacccggctattttcttgtatttttagtagagatggggtttcaccatgttggccaagctggtctgaactcctgacctcaagtgatctgccagcctcggcctcccaaagtgctgggattacaggcatgagccaccgcacccagcctgggttcattttctttcttgctgaggaatatcctgtagatgttttcagtgattaattacttttagtgaatgattgatttagtgaatgagtgtttacctggatatagaattctaagttgacagttgcttcttcaaaacactaagaaaaaatagtttttcatttacttggatttattatgattccttaaagtgggatttgccttttctgtctcctgctttctaaattttctctacatttctgctgctcagtttcactaggatgtgtttaggtatacattgatttgttctttcccttggcgacacatgggattgtttttattctgtatttggaagtctagcagacatctcaaaactgaacttctaattttctattccaaatccactccactcactgttgtgctagttttaagtaatggcaatttgatcttttcagttgctcagaaaaaaattttgaagtcttccttccatcatcttttgtctcccacaccccacattcaatccatagggaatattggttctgttttcaaaatgaacccagaatccagatgcatttcattacacccactgctaccaacctggtctaagccactatcatttctagtctggattattcctgtagtctctcctggtctctttgcttctaatgttgtctcctctgttctctactcagaagccacagtgatttttaaaacaaaagccagatcatgttattactttgttcgaaactgtcattgcaaccttatcgcactcgtagtaaaagctaaagtattttttattatttttattttattatactttaagttctgggatacatgtgcagaatgtgcaggtttgttacataggtatatacatgccatggtggtttgctgcacccataaacccgtcatctacattaggtatttatcctaatgctatccctcccctaggcccccaaaccaccccccaacaggccccagtgtgtgatgttcccctctctatgtccatgtattctcattgttcaactcccacttatgagtgagaacatgtggtgtttggttttccgttcctgtgtgaatttgctgaggatgatggtttccagcttcatccatgtccctggaaaggacatgaactaatccttttttatggctgcatagtattccatggtgtatatgtgccacatcttctttatccagtctatcattgatgtacatttggcttggttccaagtctttgctattgtgaagagtgctgcaataaacataagtgtgcatgtgtctttatagcagcatgatttctaatcctttgggtatatatccagtaatgggattgctgggtcagttggtatttctggttctagatccttgaagaatcaccacagtgtcttccacaatgtttgaactaatttacatgcccaacaacagtgtaacagcattcccatgtttccacaacctctccagcatcagttgtttcctgactttttaatgatcgccattctaactggcatgagatagtttctcattgtggttttgatttgcatttctttaatgaccagtgatgatgagttttcttccatatgtttgttggccgcataaatgtcttcttttgagaaatgtctgttcatatcctttgcccactttttgatgggatcatttgttttttcttgtaaatttgtttaagatctttgtagattctggatgttagccctttgtcagatggatagattgcaaaagttttctcccattctgtaggttgcctgttcactctgctgagagtttctttcgctgtgcagaaactctttagtttaattagatcccatttgtcaattttggcttttgttgccattgcttttggtgttttagtcatgaagtctttgcccatgcctatgtcctgaatggtattgccgaggttttcttctagggtttttatggtgttaggtcttacatttaagtctttaatccatcttgagttaatttttgtatgaagtgtaaggaaggggcccagtttaagttttctgcatatggctagccagttttcccaacaccatttattaagtagggaatcctttctccattgcttgtttttgtaagatatgtcagagatcagatagttgtagatgtgtggcattatttctgaggcctcggttctgttccattggtctatatatctgttttggtaccagtaccatgctgctttggttactgtagccttgtagtatagtttgaagtcaggtagtgtgatgcctccagctttgttctttttgcttaggattgtcttggctatacaagttcttttttggttctatatgaaatttaaagtagttttttaaaaattctttgaagtcagtggtagcttgatggggatagcattgaatctataaattactttggacagtatggccatttttatgatattgattcttcctatccgtgagcatggaatgcttttccatttgtttgtgtcctctcttatttccttgagcagtgatttgcagttctccttgaagaggtccttcacatcccttgtaagttggattcctaggtattttattctcttcgtagcaattgtgaatgggagttcactcatgatttggctctctgtttgtctgtgactgatgtataggaatgcttatgatttttgcacattgattttatatcctgagactttgctgaagttgcttatcagcttaaggagattttgggctgagacgatggagttttctaaatatacaatcaaatcatgtcatctacaaacagagacaatttgacttcctgtcttcctatttgaatacgctttatttctttctcttgccttattgccctggccagaacttccaatacaatgttgaataggagtggtgagagagggcatccttgtcttgtgctggttttcaaagggaatgcttccagctttttctattcagtatgctattggctgtgggtttatcataaatagctcttattattttgagatacgttttatcaacacctagtttatttagcatttttagcatgaagggatgttttgtcaaaggcctcttctgcatctattgagataatcatgtgttttttgtcattcgttctgtttatgtgatggattacatttattgatttgcgtatgttgaaccagccttgcatcccacggatgcagccgacttgatcgttgtggataagatttttgatgtgctgctggattcggtttgccagtatttattgaggatttttgcatctatgttcatcaggtctattggcctgaaattttctttttttgtggtgtctctgccaggttttggtatcaggatgatgttggcctcataaaatgagttagggaggagtccctctttttctattgtttggaataatttcataaggaatggtaccagctcctctctgtacctctggtagaattcggctctgaatctgtctggtcctgggctgttttttggttggtaggctattaattactgcctctatttcagaacttgttattggtctattcagggattcgacttcttcctggtttagtcttgggaggatgtatgtgtacaggaatttatctatttcttccagattttctagtttatttggatagaggtgtttatagtattctctgatagtagttcgtatttctgtaggatcagtggtaatatcccctttatcattttttatcgtgtctatttgattcttctctcttctcttctttattagtctggtagtggtctattttgttaatcttttcaaaaaaccagctcctggattcatttattttttgaagggtttttcatttatctttctccttcagttctgctctggtcttagttatttcttgttttctgctagcttttgaatttgtttgctcttgcttctctagttcttttaattgtgatgttagggtgtcgattttagatctttcctgctttctcctgtaggcatttagtgctataaatttccctctacacactgctttagctgtgtcccagagattctggtgtgttgtgtctttttttctcattggtttcaaataacttatttatttctgccttaatttcgttatttacccagtagtcattcaggagcaggttgttcagtttccatgtagttgtgcggttttgagtaagtttcttaatcctgagttctaatttgattgcactgtgttctgagagacagtttgttgtgatttctgttcttttacatttgctgaggagtgttttacttccaattatgtggtcaattttagaataggtgcaatgtggtgctgagaagaatgtatattctgctgatttggggtgtagagttctgcagatatctattaggtctgctttgtccagagctgagttcaagtcctgaatatccttgttaatattctgtctcgttgatctgtccaatattgacagtggggtgttaaagtctcccactattattgcatgggagtctaagtctctttgtaggtctctaagaacttgctttataaatcagggtgctcctatattttgtgcatatatatttaggatagttaattcttcttgttgcatcgatccctttaccattatgtaatggccttctttgtctcttttgatctttgttggtttaaagtctgttttatcagagactaggattgcaacccctgcttttttttttctttctttccatttgcttggtaaatattcctccatccctttattttgagcctatgtgtatctttgcacactgataagtcttggctctttatccaacttgccaatctgtgtcttttaattggggcatttagtctgtttacatttaaggttaatattgttatgtgtgaatttgatcctgtcattatgatgctagctagttatatagcctgttagttgatgcagtttgttcatagtgtcgatggactttacaatttggtatgtttttgcagtggctggtaccagtttttcctttccatatttagtacttccttcaggaactcttgtaaggcaggctggtagtgatatttctcagcatttgcttgtctgtaaaggattttatttctcctttgcttatgaagcttagtttggttggatatgaaattctgggttgaaaattcttttaagaatgttgaatattggcccccactgtcctctggcttgtagggtttatgcagagagatccgctgttagtctgatgggcttctttttgtgggtaacccaacctttctctctggctgcccttaacattttcccttcatttcaaccctagtgaatctgataattatgtgtcttggggttgctcttctcgaggagtgtctttgtggtgttctctgtatttcccgaatttgaatgttggcgtgtcttgttaggttgggagagttcccctggataatatcctgaagagtgttttccaacttggtttcactctccccgtcactttcaggtagaccattcaaacgtaggtttggtcttttcacatagtcctatatttcttggaggctttgttcattcccttttattcttttttttctaatcttggtcttcatgctttgtttcattatgttgatcctcaatctctgatatcctttcttctgcctgatcaattcgactattgatacttgtgtatcttcatgaagttcttgtgctgtgtttttgagctccatcaggtcatttatgttcttctctaaactggtgattctagttagcaattcctctaaccttttttccaggttcttagcttccttgcattgggttagaacatgctcctttagctcagaggagtttattacccaccttttgaagcctacttctatcaattcatcaaactcattctccatccatttttgttcccttgctggcgaggagttctgattctttggaggagaagaaggccaaggcctttttttttttttgaaatggagtctcgctctgcagcccaggctggagtacagtggcacgatctcgactcactgcaacctccacctcccagttccaggttcaagcaattctcctgcctcagcctcccgagtagctgggattacaggaatgcgccaccatgcccagctaatttttgtatttttagtagagatggggttccaccacgttggtcaggctggtcttgaactcctgacatcatgatccgcctgcctcagcagcctcccaaagtgctgagattacaggtctgaaccactgcacctggcccaaagtctttatagttaactgcaaggtcctatgtggttataatctccttctcctcatctttacctctcttattctatgtactccaaccacaccatttcccctggattcctcaaacatatgccatgctcctgtctttatattaactggtctttcttcttggaacacctctcccccagatagccatatggttaactccattacctcctttgtgtttttgcttaaacattatcttctcagtgaggacaactgtgaacaccacatgccagtccaatctctcttactcttctgaatttcatagcacttttcatcttctaaattgttataaagtttactgatttattatgtttactgcttattttctgtcattccattagaagggaagctctatgagtgcaggtgtttttgtattttgtataattctgtctcctaagtacctagaacaaagactggtaaaaaggagatgcataataaatatttgttgagtggtgaaccaatcaatgagttattattaatatagaactagcatatatgtaacacaatatagacccaaagtcttttcatggagcaggaatacagtgaaatacagttacatcccaaatgcccattaactggtaaacagataaacaaacttttgtatagccatacaatggaaggcaacctagaacaaaaaggaacaaaatacagatacacagagcaacatggatgaatatcaaaaacatatgaaacaagccagattaaaaaaaactgtacataatattattccatttgtaagaaattttagataaatcaaaagtatggacatggaaagcaggttggcagttccctaatgccaagggtggtacagggatgtgaaacaggaattaactgcaaaaggacatgatggaataccttagggatctcaaagttttctgacacttgagtgtgctgttggttggactacatgtttattaaaacttattgaactgtttgctttaaatgggtacattttagggtccataacttattcttcaaaaagctgcaagcaagcctgggcaatatagtgagaccctatctctacaaaaaaaaaaaaaattacaaataattagctgggcatggtggcaggcacccatagtcccagctactctggaggctgaggtgggaggattgcttgagcccaggagttcaaggctacagtaagcaatgattataccactgcactccagcctgggccacagagcaagacgctgtctcaaaaacaaaaaacaaacaaaaaaagctgcaagcaataaacaaacaaatacagttaattctgaccacctactattagaatttaatctttctttaattcaggaagcacttcacaatcttagggcaccttcagaatgaatgagcacctctgtgtggcaaaaatgtggatttagtaatttgctaaagttcagagccttctctgtactaacctactgggcatccctagcacttggaggaacaaacttcttcttttttatttttatttttatttatttatttctttttgagacagagtctcactctgttgcccaggctggaatgcaatggctcaacctcagctcattgcaacctccgcctcccaggttcaagtgattctccggcctcagcctcccaagtagctgagattacaggagtgcaccaccacgcctggctaatttttgtatttttagtagagacagggtttcaccatgttggccaggctggtctcaagctcctgacctcaggtgatccgcccacctcggcctcccaaagtgctgggattacaggcatgagtcaccactcccagctggaggaacaaacttctcttcctccactgttaggatcatgtatttgtaggctgcaacacccaccctccaccgtacccatactatgacctccgccacaggagagtccatacctcacttatccttatgcccatgtgctagaggtaccacgcccatgggaagtcctcagtcaattctaggtgaatgagtagatgattatttcagaggggcatacaaaagaaaatttacagtcacagacagactcgatattctcttgctatggagtcaacattctatattattaccaaaattttacatgtattcccagatttttttttttgtccatacttggaagttaccattaaggagataacataaatgcttatttttaatttatcatctatgtattcagtaccctctatttgccaggcaaattttgttagtttctagggatggatgtgatggttaacaaaacaaagatttgggccttactggaagcaattattttgtgtaaattgggcagtcatataaaagatgtctttaaggactgttctctttagattttggtcaataaattaaagattattcattttatagcagtttttagagttttaatactatggatgagtactttgttttgcttatgaaatgaagtagagcaaaattacagacgcttttcctcccagggtagggagaatgtctttggaaaaggaaattccagcaccaccccttgaggtctttattttccagcataaatcttccaactgtggggctcactcactaagcaagcacacgtgagccacaccccgcctctgcagagactcacgcagggtgaggcagaggcaaggtattttgttaatccttttagcttgagcaagcagaagaaggaaaactcaggaaataaatcacatgaaaatatgagaacaataggaaagaaaagcctgtctttcaggtttgtttcctgttctaatacttgtggaatgtggtcttctactgatgcttaatataactagaatatgcaaagttgtaattctttccttaacaaaagttttcctttatctgttagcattatcctgttcaaaccagcatctctcagaattgttaaaatctaagatatagtagccatttagttgcaactttaccatagagtaacattttacaaagtaaacattagttacatatacagagttttcactgagtttatattatctagtaaagctcccatttgctttttatatttttctaagtaagctgactcttacaaaatgtagccaagttttgaagacatacaaagtttttaaaaaccagaagatcttctagtaaaaactacccaaatagttaaaacaacttttgcatatcgtttttagtatactattaggaaaactgctaagttttcattcatttccttcccattaagaaataatttttctattgctacaattcccattagccaaggaaatgtcactaattcacagggtgtctatggtcaaatctagaaataagggtgtaaattaatgtaatcttcatctgcttgtatatggccactatcaaccactgttgcctcccaggtcactgctgttctgatcaaccatctcatctcttgggactctgcctaacccttccctcccatcataattcctccacccctaacatctggtgtctcaaaatgaatcctcacacagctggcagcatctggacaaggcagagacctccaggattagtattcatggcatttgtgttctgaggaaggttccttcttcttcctgctccaggctagatttggctgcctagaaaaatctggcagtaacctaagttataggatttggtagtggtgactgtagtaattgtaaaccatcttctctaaaggcaccaagttgtatgtctgccatttggactttgacctagaaaagaactttctcacaaatggtccagattgccaatgtttaggcttttgtccgctttaactttaacctaatagatatagtggcttccatccaggaggagtgcaagtgtcactttgggtaccccaggtgggtgagtctaagacttcccacatcagacaagccagtgaagtctgtgttacagggtagaatgcttgaaaacctgataagtacaactttgtgtcataaaggcacactggctttcagaaggggaaattctatctcactaattcactttctttagtttctttctggaaataaatgaataaatcacagtagttctttcagagcttgaaaaatatttagagtgttccatggaaaaaatcagtagatgccattagtctatatttttaggaaggctaaatagaagctattcctcaaactcagccatggtatgatatgatgcggcattattataacagagaaaagtagcggtgtgctgaaggcagttcacacaggctggtgggccaaattgttacatttcaaggaattttgcaagctgtttgatatcagttttgctagctggttgaaggcctgtagaataggttattgtaggagtatttacatcacagtaaacaaagcagtctgaggccccctcctgcctcctcacccccagcccaaaccagttaagcatttaccaagatatcactggataagagattggtttagaaatagagaacaaagggtgggaccaatgggataaatgctgaagaattataaatagatagcttcctcagagttaggtattgggtctaatcctgtttagcattttaataaattccctagagagaggtagtatacagagaaatgtccatgcctttcagatgacattaaatgtttccagagttaaactataaacccatgggattaacacccagaactcttagtaaaactgtgtgagttctaataaggcaagagtaaggcaatttgggggaaaattatcttaaaattctcttgttaggtgataatatctaacctttgcgttacaacctagaaatgaaatttagagatttctgtagacgttttctatgttcattagtataacttgttagctgtgataaaaaggccacttaaatgccaagttccatcagaagctctagaaaccaagaacaagaactgtcccactcttagaaagaaaacttagtgcacacttcctgcagttttggttgacatgcttcaaggataatgtaatggaactggaagagtttcagagaaaattgcataacctggttagggtattataggaatcccagatgaggctgaagattatattaactagcaaatcatgaaaggtcttgaataaggtaaatatagctgtattaagcaattcctgaaaaactggaactatagtgcacctccttgatctttgaaataagaatttatagaagtaatagaaatatgctattgtttctcaaggaaaagaagaaatgatagcaaccttaaagtttaacttttatcagtatttaaaaattattacagttacatattttgaatgtgcaaaaggtactgtatatttcctctgatcagtgacctccctttatcagaaagactgtcaaaaggaagagtgaaacattctccctcttaacttacctttaaccacttttgtttgtttgtttttttcttacggcaactcaaagcaaagagctggaggagccagccattataattgcttactctcatcgcttagcgccccaggtgggatgtgtttccaaaacacatttttgtatttataaggaaatgtagttaggattaattttattgtcctaattagaactcacattttggttaaatcctcaatttcattaaaaaaaaaaaaatcagtgtttcttaagagtgaattaggcaaagggaagaagacaatggatcacacttttttagggaaaagatcttcctcacagtggtgggtgggctatttgggtgtgaaaaaacatagggcaacttaattaaccatgacaaaacagacaagtaagtgcctttcaaaaaaatcaaacaaggctctgcacgatcttaataataaaaattttagaaaaaaatgattttcatgttagttcagagttgattgtctaggataaattaaaaaatgaaagctgtggtaaatgacctaaatatattgcactttctgatattttttacattttaatgaaatatatgccttcagcaaagtgcacacatcattacagacatctcaatgaattttcataaaatgaacacatccagtaaccaccatccaatctaatgcaccatatacagatgttccatatactgtatatatatatacacacattatatatatatagcatgaagattacttatactaattaatcattaactgtaaatatgaagaatatttatttgtattcatatttttaagaagattgagatttaacaggatattatagaagggtttaattcacctttcaagtttgttatagtttttttccccttttgtgtattttaatcactttatttcacagtaattcttttgaaataaaggagaggtcagcactccagagttttaggtgggagacagcaaaaagtatattttgttgatctcacacgtagacctaccatttagatttgttgtcaagcctgattgaggccattagtgccgtttttaaaaaattatatttgttaaaaggaagataatttttaaaacgagaaaaaaatgggcacaagacatgagagtgccacaatactgcaaatagaatgtaaggaaggaaataacttttaagaaacaaattttgttaaattaagtaccgtgactaaatactttaattccttttcttgtagcccgtaaggatcatttgactttgaaccttttaagtcaaagaggagtagtctgaaagcctgaactccctaccaccctgagggggtgcgggtgcggcggggccggctgggggcttcccccaccccctgctcctgcgccctccccccgcttccccctcctcccctccctatcgccctcaccccccttcttcccccgtgacccctgaccccagctaatctgcatagaggaatgacaggcatccgctgggcaggatccgccgcgccggctgcggccggccgggctgggagacccgcgcggggtagaaggtgaggggacccggcgggccgctcggcacaggccgggacatgaacgcctggaagtctggctgggagcggacccatgatcgaaggaccaaaggagccgcttgatcgctggacctggccctgcgaccccagtcatgggccagacctcggtgtccacgctgtccccgcagcccggcagcggtgagtccggggcgcacgcgatgcgctcccgccgcgcgggcgcagggctggcggcggggccccggggcaggcagggttagtcgtctggtcgggttccgctcggacccgccaagtccctcggagaaaccccagaggtagcgctcgccaaactctttgtcgtgaaagaggaatgccttttgggatccagccgattttaccttaaaggcacaggctccatttttctgtgcgcgatgcctcgctgtggttttttatccaaattatttcggagccagaaacttacgggaaacgccatttgcgtattacagtgtttttaaaaacgcgaaacttagagagcaagagaaacatgccaacaggtttttctgtatttacgcttggcttccgaacagactaggactgaatgctttcaagcttgtcaactgatttatggtttgttattcggagtagaagcgctgatcgccttatcctggcagacgctgaatacttaataactagccccgaaatgcgtaattgtttcaaatgagacttgttttgtttatagtagatacagcagctataacatttagggaaacatatctcatgaacttagttctccaggactaaagttagttttatggagacgtgtgtaacgtgtctgagttctaatgctctgttttaaaagtttcttttttccattttcttaaacaaaaagagggaaggaaggtacgtctggcatttccccgacagtgtagggataaaaaaaaaaaaaactgtttggtggtgttacttgtgattggataaggaaataaatttaaaaggtactattttgatatttttccatcaacgattaaaaataaataatactcgaagggaccgtttatgttactcattgagatatttgatacactttttaaattgtgcaaacatcaacaggatcttgctgaaaggaaatgacagggtacagaggaaggttttttaatctgcctcaggatgtctagctagatagcattctgtcattccaaccccccaccccactttatacccagtgggtttctttaggtagcacagcttcactccctgagataccacaagctttgctgaggtttctgttaataccacagaagacccttctgcaaagaagagacatcagaatcagaatataccttctttaccattaatgacatggctacagctctgaaatcaaagacctcatgttgacagctttttgagagatatttgcggggaggggttgagtaggattttaaatttagtaaactattttgtgcaaataagacttggtttcctttgtcttaccttaaagtggtgtgagacttcttttcatttcaaggaagggttatatttttacatttgtgcaccggcgaagatagaattaaatctgtactccaatacaagagtatacagaaagtattgtcctgaatttagtgattttatcacaaaatattactcgagtgaatattagaaaagcaaattttgccttaataaaaatcaaggaatattatataaatgatgtctaagaagcaaataaaatcctaaagtgagactccctacgtcttagtacagcaaaaaaacccggattgctataattccaaataaaatgactgattataatgagaaactgtaatctacttaagtaaaaagtgttttaaacaaaaatttatgcttgatcatgaaagataattcagagaaatatctcacggaacggtgttatacttaaattgcaggtcctcagttttgcggattaaaagtttgtatgaattgaaatgaccaatccatacatcataaatacagggttttttatttttcagttaaggaatgacagtggttatgacttaagttgtggtattgtaaaagaacagttttctcgtggtatccagtgtctctaaatccgttagagctaccctgtttccctgaaggtttgccatcagattccaaatgaaaaccaaaaaaaaaaaaatttaaattaaataacgtttgctgagttttatattcatgtctgtatttttctgagtctgagactgtcaaactctctactattccaggtattttgttcactccttgttaactgtttaactctggctttacagatggcgtgaagatccttgttctgtttgatcttagccattgactagttgtttaagtctggagcagctgcttaggattacagtattaaagatgattctcatcttaaatgcttagtgggcgaaaatctgtttaagtcaaaggaatcaatagcacagagtttaattattcatacttatcgctcaatttggccttttgtaaaaatcttcattataggctagaagttagcttgctttccccgttttgactttaggctctctagagcctttcagtttaggttgcacctaattctctgggttctaggaagaccattaataattttttctgaaaatatgcagttagatccattattaaaaagaacagctgtattgatgtataattcacatactataaaattcacccatggaaagtgtacagttcattgtttttcagtgtgttcacagtgttgtgtgaccctcaatctctgttcccaccctattcaaccagtgggctctaccttaatgaaacactaatcaacttttctgtctctatagattttcttattgagaacatttcatgtcaatggaatcataatgtgtcattttgtgactggcttctttcagttagcataatgttttcaagggtcatccatgttgtagcatgtatcagttgttcatttctttttattgccaaataatattctactgtatgaatatgccacattttatttatccatttatcagttgatggacatttgggttatttctgctttgggctatttatgaataatgctgctctgaacttaatgtacaagttgttgtgaagatatgttttcatttctcaggtatatatttagtagtggaattgctagattatatggtaggtagttctatgtttaaccttttatggtgttgccaaacagtttccaaagaagttagaccattttacattcccaccagcagtgtatgaaagttacagtttctccacatccttaccaacatttgttactgtctttttgattatagccatcttagtaggtgtgaagttatatctcatggttttgatttccttttccctaattactaatgaccttgagcatcttttcatgtgctattggccatttgtatatcttctttggaaaaaatgtcttcagatcctttgcctaattttagttggataatttgacttctgttggagttttagttctttgtatactagatccaaatcccttgtcaggtacatgatttgcaaatattttctgccattctctgggttgtcttttcatcttggtagagtgatttgcagctcagaattttaaagttttgatgatgagcagtttatcaatttttttcttttgttgtttgtgtttttggtatcacatctgagaactacagcctaaccaaggcaagaagacttacacctgtgttttcttccaagcgttttataattttggctgttacatttaggtcagtaatacattttgagttaatttttatgtatggcgtcatgtagggtttcattcttttacatgtgaatatccaattgttccagcaccatttgttgaaatgaccgttctttccccattgaatggtgttccaccgttgccaaaaattgattgactgtgtacataagggtttacttctggattctcaattctgctccattgtctcttcttatgccagttaccacaatgtctagattactgtagctttgtagtaaattttgaaacctagaagtatgagtttttcaattttgttcctttaaaagtttctactggttattctggttcccttacattttcatatgaattttgcaatcaacctgtcaatttctgcaaaaaagccaattagagttttgatagcaatgatattgaacctgtagatcaatttgggtagtactgctgtcttaacaatatgaagtcttctaatccatgaacatagatgcctttccatttctttgtatcttctttcttttcaccatgttttgtagttttcagtgtagtgcagtggtgcgatcatggcttatccactgcaccctcaaccttctgggctcaagcgatcctccaacctcagcctcctgagcagctgggaccactggtgcccaccaccatgcccagctactttgtattgttggtagagatggggttttctgtgttgcccaggctggtctcaaattcgagatctcaagagatccacccacctgggccttccaatattgcagggattataggcatgagccaccatgcctggcctgaactcattttttagtcctagtagtttttcagtggattccttatgattttctatatacatgatcatactatatacaagatctatttacatgtgcaaagaaacaacattttaattcctccttttagagttgaatgccttttattttatttttttcttacttaatagttctggctagaacctttagtccaatgttaagtagaagtggcagttgtgagcatttttgtcttgttcctgatctaacaaaaaaagttgtttttttgttttttgttttttgtttttttttaccattaactgtgctattagctatgggtttcttcataggttcactttgtcaaaaagttctctgctattcctactttgtcagtgtttttatcatgaaagattgttcaattttgtcaaaggtttttcctgcctctattgaggtgatcatatggtttttgtcctttatcctattcatttgtcatgttacgttaattgatttttggttgttaaaccaaccttgcattcctaggataaatcccacttgggtaatgtgtataatcctttttgtatgttgctgggttaggtttacaaaagtattttactgagaattggatccattatttctaagtacaggctaaaacgatatgccctcaaataggatggtttcggtaccctctggcatcatgccctaggaggattgagacttctagtatttcattgtgaagtgtagagcatggtagattggatacaatacatttttgatgaatatatgaatgagtcaacaaatagtctcaataagcagcctgactgctttaaaccaatgattatatgaatgagaggtatgtattttttatattctttttttagtccaagaattacattactctggctctattgtctgaagggtggtatctgaatctagtaattatttcttctagttttttccaaccccaccccattttcacggtgccacagatcagcacttggctgcttctcctcaatccttgggttgaaagggcagacaatgccactgtccccatttttaagagacaagagaacaagtaaataaagtgtgcaggatcacacctatgttgtgatagaacctgtattcatctgtgtctctgggtttccaagttttgttcagggccctgtatttgtcttgtccagaatatttatccatttccttgtaaaccaggcacaggaagaggtcctaaaggcaaaagctgatggagtttgttttctttattccataatatatacatggtaggaagtcaaacattacaagatggtttgggataaaaatgaatttactccctcccagaatcctccagtcccacttttcatctataacccagcatgaacagtttttttcattccacacagttttcattcatagatatatctttatcagcagtcaaacaagacatactatacttactgctctatactttgaatttttcgtgtaatataacttgaaaatacttccaacttgttctctttaattctataaatgaacactattatagtatgtggatatatgaaaacttcctttaaaagaatcctgttgtattttaatattgttcctgggttctttgcatatgtatatgctcttatgaacaatactgaaatgaacatccatatctatgacctctctctgcactccaggctcaaatatgcaactccctatttgacaggtctgcttgaaaacttgctgggcatcccagaggtaacatggatctaatggaaggtttgattttgtcctccaagccagttcttcccttgactttctacatttcaccaaatgataccccaaccactcacttattctagcccaagatctaggagttattcttaggttttcctttccccctccacatggatccatcagcaggtcttgttcttttttcttcccaaatatatctcaagtccatgctcttctgtctgtccctactgccactatccaagctctgaggccatccattacatggacaactataaactacatgtcctaatgacatattagcagtagagttgctaggtcaaaagatttgtgtgttttattttgatagactttgctacattattctcaaagaggctttctcagtgttatctgcttattatatgagaatttctgtttctgtactctgtcaccaccactgaatatcagggtcactcttagcccatagcctcgtgagaattagaagtcacttcctctgggtgaggcagctagctccacagcacagacttaacaagtggaactttagcatgtatttaattcccactcattctcttacctatgtgtccttctgcagtcaacactctacacaactgtacatgaccacaatgctgtgcataaataattttttagactctttgtaaatctatatgtaaaaaatggcatcttattttgattatgagtgatgtaggacatttatatttctttttctttgaattgcctatttatagactttccttatttttatggtttcttacaaatttgtatattcaggagattaacctaatgtctatcatatattttaacattaaaaatttttttcttgtaccttaagtttgtttatagtacttttttatagaaacctttaaatttttaagtcaagttgattagtcgttttctttcttacagactagggctatttcaaaaatgctttcctctgctatttttctcatgttttgaatatttgatctctgtaatttattctagcttaagatgaatagatttaatagtataaaatttttaaacttttacatggccaaaaaaaattaacatcagaaagttgaaaaggaaaatcataaagttgaaagaaatatttaattatatatggaaaataatagttaatatcattaatgtagtaagacctcttaaaagtcagtaacaaaaagataagcaaccacataggaaaacaagtaaacaacatgaacaggcattttccaaaatacctaatggttacaattgtgaactcactatgggccaggaactactctaagtgctttacttgaattaactttttaaaacttatgacgttcatccggggtaactaatattaatatccccattttataaatgaggaaaaccaaagtacgagagctaagaaacttgcctatgttacctgaccaaagaagaacataagtgatcacttggtaaatgaaataaggtttaagcaattaaatgaaaaaaaaaaaaaaaaagggatgcaactgatcacctatgagtttagcaaagattaaaatgagtaattcccaaaagacaattgttttgtggtaatttaaattggtacaacttatcagaaaagcagtttggcaatatatattaagtcataaaatgtgcacttaggccgggcgtggtggctcacacctgtaatcccagcactttgggaagccaaggcaggtggatcacctggggtcaggagtttgagactagtctgaacaaaatggtgaaaccccgtctctattaaaaatatagaaattagccaggtgtggtggcgggcgcccgtaatctcagctacttgagaggctgagacaggagaattgcttgaactcgggaggcgaaggttgtagtgagccaagattgcaccattgtactccagcctggacgacagagtgagattctgtctcaaaaaaaaaaaaaaaagtgcacttagactacacttagacccagtagttctgctcatagaagtatattgtaaaagaaataattaattgctcataaaaacaatttttacaaaagccaaaaattggaattaacttaatagtcaagcatcaagagacttgttgaattgattgagatagacatgtggtagaataagccatttaaaaatgatgtaaaaatatttttaaaaggcaatttttatgataaataacatcaacatgtgaaaaggcaggttatgaagtaatatgattccatttttaaaatatgtaaagaaaaatttatatgtacacacacatagaggagaggaacttcattcttttttttttttttttttttttttgagacagagtctcgctcttttacctaggctggagtgcagtggcatgatctcggctcactgcaacctccaccttctggtttcaagtgattctcctgcctcagcctcccaggtagctggaattacaggcgtgagccaccatgcccagctaatttttgtattttaatagagatgagatttcatcatgttggccaggctcgtctcgaactcctgacctcgtgatccacctgcctcggcctcccaaagtgctgggattacaggtgtgagccactgcgcccacccaggaacttcattcttgaagagttagtgtgacagtcatggctttcccctgctttggacatgatcgaacccaaggtttccatatccactgtccacctggaccttgaccgtaattaaagtcatgagctcacctgcaactgtactagcttttctccagctgcgtggattctgagctttaagctcagtggctggttttcagctacttttttttcctttgtcagtgatgaaaatgaaaacattggtcccaatatagccaccttctttttaggtttaattgtttttttagtctgttcgataataatgtgaatgtctcttactttgagagaaagaatgtgagcaaaatttcaacatcacctacttctctttggtccatagctcatcagatttggtcagtgactaatatcccaaatattttaattttatttttagcagtctgaaatagaaaataataaatttattttatttttagcagtctgaaaacataatgactaatgagcaagtcacacgtcacctcttgccttcttaatgcagtggggaaggaaacaagaattgtaagaattggtcttacaattaagcctatttaatttgaatagagggaaaattccaacatcttttctttggggactttactgtagcaggttaactgctagtctctattcttgggagaaaatattaatatttagtgaagactcaactgatgcaaaagtgatattaaggatagaaatagtcttaagaaaataaacacttcttgtttcctccccacaaaagcaggggaacaaaaaccaaaactacagaaatgcggaaaggaatgggcaaatcacattacttgctaaaaggtcggtctaaccattatcatttatatttataaaccatccctccatttattttcatttcaaggggctggatgtttttattcacatcaaccttctggcaagtaaaacactgcagcccttaacactaaggaaatttggctgccaaggaaggactgaagtgctattttgcttaagaatatcctggaaagctgtgctggtatgtgcttggcaggtatagtcctacaaatcagcctgttttatgaggggatattaagaaggagaagagtggcaccttcatgcagcaaacagttcctaaattaaagttattatgtgtaaggtgttatgctaagcaaggtgggaagtttcaaagataaatcctacacagaccctgcccacaaagcgtccagtctagaagatgcttagtgaaaatgtgcagaaatgagagtggaagggaagggatatgtagagaattgtaggactagatcaggaggcaaaacacataatggggacaagaattcaggctctgaaaaggaaaggggtggaaggcaatactgaaagccacaggcaatgggaaccactgacgcttttttttttttaaatcaaaccagagaaatgattattgctttgcctccggagatgagttggcctgccgcatgcagtatagatttcatggggagagactgaaagtgggaccaagaagtaggctggaataatccagcaaggtgaagtggatgcctgatctggggtgaggggtgggtagagaaatgggagtagggtctcacccaactctcaactcccagagttacccagtttgtgtctgcaactctgacctttctctgcactgcaggctcaaatgtgcaactccctatttgacaggtctgcttgaaaacttgtgggcatcccagaggtaacataagtctatacagaaggtttgattttgtcctccaagccagttcttcccttgactttctacatttcaccaaatgataccccaaccactcacttattctagcccaagatctaggagttattcttaagttttcctttccccctccatatggatccatcagcaggtcttgtccttttctcttcccaaatatatctcaagtccatgctcttccgtctgtccctactgccaccgtccaagctctggggccatccattacatggacaactgcagtagattccagctgctctcctgcttctgttcccacccttctgcaattcattttccacagaacagctaaagtaatttcttaaagcataaatcatgtcactcactcactcaaaaccttcctgtcctcccactgcacttggaatgaaatccagattgcatagtatggccctcgaggctctacatgagcctatatgatccctgcccacctctctgacctcatcttccatcactttgctctggtcccctcactgcctttttcagtcctcaaacaagcctggatcagtcccacccatggaccttggccgttgctgcaccctgtttgagacactcttcccttcgctcttcgccaagctgactccttgtttcggctggatccttgtgcttcatagagaccttccctgcctacccctctccagaataacccacccaggtcccacccacagctctctgtgccttcactgcacttagcactcagatgatcttgtttgtttgttttattcattgtctctcttttctagaacataagctccatgatctaaaagacgttatctgtcttgttcaccaatgtctcttcttattcctaggtatatgcctgacaccaaaactatttgtcaaataaatgaatagctctgtttggccaggtcatacattagtagagtagtgggaactgagtagaaagttcaggggcatctaagaaatgtggagttgtttaaactgattctttaattctccagtctctaaatagcatgctctttgctacctattgattgatttttcagcatgacacattatctactgagctcacagtatggaaaccgaacacgtagttctcttttttaccctaccccaacccctgcctctccccatttcagaatcatacatttcctattatttcccattttcccattttctcatcttctcaagtcttttttttttttttgagatggagtgtcgctctgttgcccaggctggagtgcagtggcctgatttcagctcactgcaacctccggctcctgggttcaagtgattctcctgcctcagcctcccgattagctgggattacaggcacctgccaccacgcccggctaatttttgtatttttagtagcgacagggtttcgccaggctggtcttggcaatctggtcttgaacttctgaactcaggtgatacacccacctcagctcccaaaatgctgggattacccgtgtgagccactgtgcccagccccaacattcttatattgtgtttttgattttatcagtcatccatgtaatagcagaaatgccaacgatagctaaggcttgtggtaaaccacgatttctttttctctcctgcataccttttgtttttcctactggtgtttttgttagcttgctaagtgtcctacataccatccccacactttctcttgttatgtatttaacgaatcgcttctcaatatgttcaaatactcgagttattcttacaggttcatctttaagagcttcatacatagcctttgtcctcttcccatgtggactggattttctctgagcccactgtccagctgttgtcttgggatctctcttcatcacaccagggggattccttccactttcctcttgcattgaatcttcagattgctggatcccatgccccctttttttttctgggtctatttccttattttggcagagcacacagggtgcttcttgagaaaagctcacggggtgtatggtttttgagtctttgtattagaacgtggctttattctggcttcatgcttggtcgagagcttggctgggacataaggtagcaaagcagacttgctgcagtatgcacaaacactgccatccctcccaattaatcaggatgaacgttttccttttatctggaagacttagtttttctctttagcagatagcttttaactgatttcaaaagactttcttgggtgatggtcacacaagatctcaactttgacctggcttgttgcaatggtctaaaaaatattttatggacgtttaaaagttttgtggtacatagactaatttaaaaatgtgtttactgtgataataatgtgctggcattttttaagaagactcacatttaagatctacattgaataattgtggtattcctgtatttttctgtgtttttattttagggatgcgtcatctttatgggatgctcgttctgataggatcctgggggtattacaaactaccattgatatttcacaaaagtgcccaattgtgaaactcacctagtgtgcaaaatactgattgctgggtcccatattataggtcagcaaaatcaaagtcttttggagaggggtctcagagtctgtgttctcaacaaacattccagaggattcctaaggtgagaaacatcttctggaaaacaaattataggttagtggtactgtacagatggtcctcaacttatgatgggattacatcttgataagcccatcataaagtaaacaaaaatagtaagtcaaaccatggtaagtcagggaccttctgtatttaaattaaaaaaaaaaaattctcatttgaatctttatgtgtgtctttctctttacttgaggcaaaagttacaaaatatccagttcagagactcagatgttctgtacacaaatgccgggatgaattgggtcattcatatttactgttcatgagcaaatattcctattgtcaagtagaatgttgagattctgatggaatattattgccagaaacctgtttgcttttatgtacattttgttaatattataagcagcaaaatgatgcatttcccacaacaactaggtttgaagtaaatatatagttacattcgaaggcaaggaagttatcagcagaatgccaattactgtttaggaaaagaccacagaatttcaactcgttgccttttcaagaagacctctgtgaacttcatctggggttgctgcatactaattacttaacccaaaaccaaagtcaaagaacagggcactagatgaaaatagctgtttaataatgagaaggaagaactataagaaagatttttgtaaaatacatttctgaaaaggaggctgagcccttttcccttttagaactgtaggcggcaaattctgaaaattccaaaaggaagcaatcatttatttaagacttctgttcatgcattctgtcttggataatgtttggctttttattttcgcctctgtttgtacttcaggcatcctttcctttcaattgtgtgcctatttgcagcccattgcccactgtgaagtaaattccattcagtcttaattggggtctcttaaaagctttttctaaagaatttttcagcctccctatggaaggccactgttcgttgcctaaggtgtttcagggtgtgctgagcattccctctgaccttccttcttgtataaagatgtttctgacaacagctgggtggctcacaggactggggagggcagtctaaagggatgattcaggattgcactgatcaatttcatctattataaagggattttgtgtttttcaaaatttcttctgcatctgtaaagttagcttgtgttgacctgccaacctgtttatgaaagagccgggtgagaatggaaacttggaataaaccagaacaagttaactgagctcatgccgtgggttcctgttggcctgactgcgctgtttcattttcctaaaggcctctaaaccagaattgtatacatctaatgttctgtcgcttggaaagtacttgactgccaattttttaaagaaaacatgaaaagaataaaatcaaacatgagatttttagaagaatttagaactgtacacttttaaaaaactgaatccccttcagtcatccaaccacagaatgtcagaacacacgtatacctcattttccaaacaagaatgttttaatttaggaagccattataaagtaatcatagcaaaatccttcaaagaacttttctttttccttctttcaagtgggctgaggtggaggtgaggttgaaagctgtgtgacattttcactttaccttcgacatgttaataaataactttgcagataatagtaaatgtctgtacagtattcgtctgctaaggctgtcgtaacaccataccacagactgagtggctgcaacaacagaaatgtatttcctcactgttctggaggctagaggtctaagatcaaggtgtcagcagggttagcttctgctcagagcctctgtctttaacttgtagatgtctgccttccctctgtgtcctcatatggtccatcctctgtgcccacacacatctgtgctcaaatattttcctcttataagaaccccattggagtagggcccacccatatgacctcattttaccttaattttacttttttaaaggacctgtatttaaatatggtcccatgttgaggtactgggagttaagactttaacgtatgaattttgagggacacaattcagcccatagtagtgtcctttttttgtttttgttttgtttttatttttttgagacggagtcttactccatcacccaggctggagtgcagtggtgtgatcttggctcactgcaacctccacttcccaggttccagcggttctcctgcctcagcctcccaagtagctgggactacaggcacgcaccaccacacctggctaatttttgtatttttagtagagacggggtttcgccctgttggccaggctggtctcgaaatcctgacctcaggtgatccacctgccttggcctcccaaagtgctgggattacaggcatgagccaccgtgcccagccccttttttctgtattttttaaataggccatttaaggactttaagcaatgtccctaaaaccaatgtacaaaccaggacttattagcaatgtcccaaagcacactgcatccattgtcttttttctgatttttgagtttcatttcttaaccaattaaggcctcttccccactcacctcaacagtgccatattcatattacttgagtaagaggaggcattgaaggtgattttcagcaatggaaattaaccagtgtgactaggcagtacacttaggaagtaaagcataggctgtagagcatatggggtaaatttagaaaatggaatatgtgttcatgaccagcctgggcaatgtggcgaaacccgtctatacaaagaacagaaaaaattatgtgggtgtggtggtgtgcacctctagtcccagatacccaagagtccaagatgggaggatcacccgaacccaggagatcaagcctgtggtgatccttgatcacaccactgcactccagcctgggtgacagacagagtgagaccctatcttaaagaaaaagaaggaaggagggaaagaaggaagggagggaagaaggaaggaaagaaggaaggaaggaaggaaggaaggcctgcgacagggagtggggagggaaggaaggagggagggagggaggaaaggaaggaggaagaagtagaaggaggaaggaaaaaaggaaggaagggagggaaaggaaaggaaggaagaaaaaaggaaataaataaagaaagaaatggaatatgtgacattatgtttctgccattgtgtaagaaatcaataccagtatcttgtgattggagcaccaaattgatcgagtaatgttcaggaaagaaacccccaaactacttatcaagatcctaatcccagtgtggtcagtaactaatgtggccacctgactggttttataatcttctttgagggccctgaatgtgaagccctgtatttggagaaatgttttgttctcaaatgtcactacatatatagtcttccttttctgtgtttggttttgctggctctgtatgctttcattgtcttagatgtgtttgaaatccgcagggtgacatgtctcttttcaaagagctgctaaaataagaaagaaaatgaataagcgtgttaaagaaagatggtgtttaaacacctgtcaaagtaaagtcagaacaagaatgttcttgccagaaaacgcagagccccattgagacaggttggtaattcgaagatgattcattacgactaactgcatttgtattctagcccatatgcattgtaaaccacctagcaggcttccaatgatgtcttcctatcaattcgtaaatctcacaggaaacttttaactggtgcagtcagttttggtggactgcttatcttgtcaacgtgaagataatgcttcaacagcacacccacctcctctaggttcaaaattccttattttattgaaaaaggtccctcaagctggttaagcacacaaataagaattgggtgcatcagaatctagtgaccctaggtccttttgtaaaatgattaaaactctccttaaacctcagaaattatttaattttataggcatctcttggaccaggaattgccttgagatggcgagatacaagcattctacaaaggctgcaaacaagactcacttctcttaggccctgatccgaatccagattatgatggattgggcatggggatcagggcatgcagaagctcttagccaaacctctacaccctttagttgtgactctgtcattgtagacttttaaggcatcttgcagattagaatatgctgagcactcaatctgaggaaggttaaaagtcatagaatattggtgttcttccaagttgagaacagaacacttggatccaagaccctatttcagattcaacattcaataccctaaggcataaaaatggcgtcttactatagacagtggaaataactgataaggatttaattaattgcttgtggttttgcagtgccagtccaggtttattttcattgctgggcactgcagtcctagaggcaaagggaatgagcataaggttcctgctagatctttaaaagggaagggcagaataaacagagggccctttgataatgatttcttagccagtccagtggataacatgagtctcataatcaagaatcctctgggactttgtcatctacattgaatttataggtggtctttacttaaaatatctgaagttaatggaatcataaaacagatctttcttttctctttagattgtgacattaggcacatgtggaaacaacagtaaaatgcaacttcctgtgtttagcagccgtagcaacacatcttatacggtgcaggatttttaaaaaccaaaaggaacaacaatttgtatctgactaaatagcgcctaatcagtttcaccttgatttactaagcgttgtattaatcaagtaagcaactggccttttctataaaatagttttatgtttgttggtttgatttttaaaattttttattttttgcaggtgcaagcataaaaataaaaaattcgcaatttcccagctggtaggaaatagagccacgtccaactcttagctcctctctcattcttgtatatgatgtcaaccttcttgcttagtttctttccttaatccagggcatttctgctatagagtagtggggatttccctcgagtcttagttggttttagcagctcccagcaattatcttgagaccaacggagaatgcaggtaactgttttgggtgggtatacaggagtttatttatttcagggggcatttttgttttcctggagacctctagaagaccaggaaaatatttttccaagaaattttgctgccccaattgctccaaatcataaataacccactctccatttttattccccacaaaacctcttatcagcctttttccacttgcttacatgtattatctctattaacagtagccacaacccaaatcatgaattgtattaccccattctacagatgaggaagggactctgaaaggttgaattacagacctaaggttaccagctaggatggggaggaacagattattacattcagatctttctggcactggaagcccatgtttttcctttgcagtactcacaggtctgtgtttatatttaaatggctatttcctattttttaagcatacgcaaagtcatatcagggtgacacatagctaaagagttaaacaaaacaaaccattttcttctctggaagctttagtgtggaaatacctaagtgtcagccctctctccacttgtgtttgctccccttagggtactgttctaacaggagatatttgcttcacagtggaaaggtgagataggagaggtggtgtgttctgtttaaattggaataaaaacttgttgctggctgccagtcttaaagaatgattcctcgtcattgaacatgttacattgtagagtcagatgtttgccaccacaacactgggctattatgcaaggtagttctaccttgtagttccgatatatttagttaattgaaagcctaaaatattgccacataactgaacatctgtcataatgctatattatcaaagaatttaatttcagattaaaatggttttatagttttctatattgttccactgttttctaagagattcacattctcgtgtgtgatgcctaaagagaatggaaaaaacaaaagcagtttggatttagttccaatttagttaggtaacttattttcttgtttctttgccatggaacaaaattgcttttctggcttccccaattaggagaaagaaggttaagactgaagaaaaatctgagatgagaaagaaggaaatgttaacaaagagagtgctcttgaagaaattaattttcaccactcatcaccgggtgaaaatagaaacttcttaaaagacaatttcacatataaattattccagctgtttttcaattatttgtctttgatgaattgtctttcaattaccttgtaaagagcaattaagtgtttgcttacctgaaaactgtgtcagcaatgtctgtaccattcttatgagtgttaatcatccttcctgctggctctgatattttcccaatttcaaacattagtgtttgttatattatctttcaaaatatttggaattctacaggaaggcactgttggaaacaatttcctctgtgaaaaatctaaagacctgctaaaataaatcatagcctaggccttgtaaattattgccccacatttacccatgacttattctttttgtaaatatttttagggacctttttgtggcctaagtacagtataggggcaccaccaggaataaaatcaacttgctccctgtcctcatgggactcctaatctagtggtgagaagtattattttttcttgcttctcagagaggtagtcttttttttaacctactcacttaataacaacaacaattaaaaatcatttttatggtttctgaaaacattggtgaattgcaactggctattctgaggttctgttacgggctttttcccatcattctagaacatgttcaatgtttcttcagaccagtattgaaaatctaaataaaaattatattagaaaaggattttggaataagctagttggtttgatggtgctctaattggattcagaggctttctgtgtgtgttttatccaaatcctgctggagcaactcattctctggaatgcttgcttaacacacctgtcattttaaagaaagaaaccaaaatagaacatctcgcaagtggggcatcctcaataactatgttagaaaaagtataaaatcaatgctaaaggcatcattattataaaattatttttttaaaaagcaactagtggaattgtttctctcaagagaattaggtgtacaaaccaaggaatgttaatcttttgcttttcagtggcttttaaatggtttcctgtttaatttgcataggatatttctaccttttaggcaatgctatgaaactagactaaacctctgtagccctcaaacaattttaccctgaattttaactcataatttggaggccatcttgtgctatgtctgccgtgggaactaatgccacagtaccaccgtgtgagcctctggggtcccccacatttcctactcactacacactgcaggtctacgtttgggtggatggttgtttgactaatgtcagcctctctcatggcctgcaagcctcctaagggcagagatctgatctgtttttgcttaccattgtagcccttcctctataatagctgctcagttaattgtgcatgaatgtttccgttccacagtgaacacacttttctacagcctcattatttttgcagatatctccttcctcctctcccttggattgtccgaaccctgggtctccttggcaacactgttgccctggtaattctcttcaatggtggctctgttgtcctttacctctcctatcacagggggcgctgacattgcatcaactccccagtgctattccctgctcattttgcgtccagtcttgtgcatgccctcatctgaggtaggtgccgtctgctgagttttccttcacatttctttggtgctgtcatctcctgacttcctggtcatttcctcatattcactggatgaagttcagactctccctctccaccccaaatctcgctatgacctgaaggaattcagtccccatgcagtccccgtgtggctggtctgacatcctggctggtgcagctctgcagcccttcttctttcttgcatcttcaacaccccgacacccagggctccttctcctcagcccatgaacctgcttgagtgtccttcacactttatgaacttaaaacaaacagcaaacaaaacctttttctttacttgttcattctcaatgccaaaggagttcaacgttctttattgtgcaaagcccacttgctcctaaatgtaatcattctctaggagtttacccctggtcctcaacagctgcttttgtttagaagactccaccaaataacttcaactccagcttcttgctagagtgccagtaatgcatttctgactgtccgttggacatcttcccttgaatgttctgccagcacctgaagttcatggtgcctgaatacaagctaaaggtctctcctccaaatcttctctcttcttgacatccagccatacccttgtagaggttcaggccatggagttctcaggcagttcctcagactcctctcttctttctcctcagtgtccctcagatcatccatcatttccagtcccttttcgctccttctctccaagttcagatgcctgggttgctgcagtcatctcttaactgagctataaggacgtaaatctgggagccttggggactccgtatgactaattgacataaattcttctccatgggatggatctcccagcatcctgttttccatagtacatgcctgcaggtttcatgtctgccttggggagattgtccgggatactacatgtggccacggtctctccacagataccggccttggggaccctgtatgactgccaggaggctcttggacatagagagaacgttagtcacattatatatattctctgggcttttatttatccaccagcctttcgacttaaatatattggtctagatttaatgtgttattttaataatatttgtgttacattcatcctcaatgggaattttttcataattttgtctgaaacaaaatttagccccttacttaaaaactgtgatatttcagccaggcgcggtggctcatgcctgtaaaccaaacactttgggaggctgaggtgggcggatcacttgagcttaggagtttgagactggcctggccaacatggtgaaaccgcgtctctactaaaaatacagaaattagcaaggcatggtggcatgcacctgtaatcccagctactcgggaggctgaggcaagagaatcacttggacccaggagccggaggttgcagtgagctgagatctcaccactgcactccatctgggtgacagaacgagactccattgattgggggcagtggggagggggggcgagaggagaactgtgatatttcagtatattttatttcacaaattatatataaggtctaccagcttctcccctaaagttctgtgctgacgcacattcccagcatgaacagggtgatcattatcctatcatggatgagttgaaattctttcacttggcagattgtccattggggatatatcagctttttcttccttttcacaaacacagcacacactctacacaccatgacctgctccacttcagactccgggagttgttgtatatgactaacatctacggggaacaagataggttgttggttgattcctgtcacgtttttcctctctgtagcgacatcttgctattcctaagcagtcatcctatctgttcatagagacaacccttcccttgtagcgataacagtggcattcaaaacgtaaaatgcttttatttacattaaaattgatttttccattagcaaagtggccctttgcctactcaatcagaatttctgtaaaccccaaataagagcgactttatttaatctgttaaatatcctgtagcaagtctaggggatgttgttcatgtcagtgaatcaggatgtcatgcagctgcacaaacatattcgttctgcaggcctgttggccacaagtttaaactctggaattctctgtcagtgcttgcaggcagatggaagtctttagtagcttttccctctgggagtttaaaaataatgtctgcctctgttaaaaaaacaagtttaaaaattgatagtatcaaacttctaaaattaatattatgataaataaggattctgtacaatcaaattactttagtcagtataaagtatagagtacactgcctgccgccagcgtgaaattaaccgtgatgacactgggcattgttttagacagcaaaacagtacctaccctaactccttggattagcccaataagtggctgggagttgaattgagttactactcattagggtttatctcttgccttatcttaaaataaaaatccactcccacccactaccctcctccccatttttgtacagggaatacttgggaggtaaactccctgagtttaaatcctgcttaccagctgtgggatcttgctagttgcttggtctctcagcctcaacttcctcatctataaaatgggaatactaatagcaactacttcgcagggttgtagtaatgatgaaagaggcagtattgataaagcacttagaacaggtcctttttttagcataataaaatatcaagtaatagaataggtcttaatgtgacctacaagactgatacactcagcacaaagcaatatgaagtcatagaatttttaaagttggaaaggagcctagagatcatttaacctagtctcctaatttcagcaatgaaaaattgggatcctagcacaaggtcacagggctgattaagtagcagagttggaactaggctccaactctcttcttggcttacagtttaccatcccagttgggtggtcaaaacccagaacaataacacagatttattgcttgtcctgattgtgcaatgtcttctttgcttttttttttttttttttttttgagaagggattgcagtggcatgatcttggctcactgcaacctccgccttcctggttcaagcgatcctcctgcctcagcctccagagtagctgggactacaggtgcgcaccacgacagctagctaattttttgtatttttagtagagatgaggtttcaccatgttggccgggatggtctcgatctcttgaccttgtgatctgcccgcctcgtcctcccaaagtgctgggattacaggcgtgagccacggcacccagcctgcttttttgttttttacaaatagtcttactgctattttagagctactaggagtgttgctggttcaccatgagtttagctatcatatgccaatggagacagcctggtatagtgggaaataagcctggatcaggaatcaggtgacctagactcttatctctttcactagttaacaatttgggaagccagatagccttcctggctcccagtttccttatatatagggctttaatatatagcataatgtgaaagtactaaacatgatagttgtcccatggtggataacactgtaacccagtgcttttataaattacattgctcagaactactgagtgctctaatatgcattgtaagaatatatatacaacttttttttttttttttttttttttttacagaaaataaactactgctctacctttaatcttgcttcggtgaaattctaatttatcatggcttcagggcaacatcaaaagatggtagagaagtagattagctttcccagaaaccaagtaagggaaaaaagtttatagatgaatctcacagacattcagtgaaagaaatacaaaagattatattgtgtaattccactaagttaaagttcaagaagtgataaaacaggccagggcacagtggctaacacctgtaatcccagcactttgggaggcccaggcaggtggatcacttgagtccaggagtttgagaccagcctggacaacatggtaaaaccctgtctctacaaaaaattactaaaaaaaaaaaaaaaaaaaaagaacaggtaacacaaatcaatgctgctggaagtcaaaatagtggttatctgggggaatagaggtgagagggtggtattgatttggaagaagcataaggaggatttctggggctttggaatgattgacactttggtctgaatgtgattgtgagtgcaatatcatttacattctgtctgtatgcctcgaaaaaatctttttggaaaatctccatagtattaattttaatgactgtgggaacaactgatcttatcccaactgcctttagataactttgtagtttctttcaagtgatgggggaatggaaattggcaaattgggaggcatgtatgaatagcagggttacgagcaatcttcctccagagcgactaaaatcctttcaatacattctaatatagtaatgttttcacattctgttctttttctttaaatttaatttcttgcttacattctgttcttttactcttagggatttaaaaagatgatggcaaaataatttttcaaatacttttgccatgattattaccttaatgccgattatttttaaaggaaccatcagctgataaaaagcaattttcttctgagccaagatcttttctaactctaaaattctattattttcagatttttaagtgagggaatacatttatatatagaaagttcaaaaataatctaaaattttagattatttagatatttagatcgtttctttaaaaatttttacatttaaccatttcacatgttcaaggacatgactataaatttgttttaattttttcccataaatatgtatcatatgtctctgatgaacacagtactgataatgagaaaatttttcttggcattactttaaaaggtcagccagccttgatttattcacttcatggtaagtccatcatgggtgtgtgtgtgtgtgtgtctgtgtgtgtgtgtgtgtgtgtgtgtgtggtggagggatgtttggaatctcttctttgtgtattgtttacacagtaactgtggatgtatacctcctgatgcgtgctggagctgggcccattgtctaccattttgcaaggtgttgaatactacttaccttatctggatccatcatgtgctaaaaagtgttgaaacagccatttaaatgttctcttacttatagaatactgggaatggaagtattagtaaagggagaattttggagagaaagatggccaagtctgaagtatattactttccaaaactctttcagctgaaatctttactgttggtaaaagacagtaggcaccgaggccccttcgagcggacttcctcactcctaagaaaaaaatctttatcctcatttacctccatgatagcgaatgccacattttaaaatataaacttgattttagaatagttttagattcgcagaaaagctgaaaaaatggtacagagagatcttatatcagcatgatacatttgttacaaccaaggaacaaacactgatactattcctgttaactaaactctacagttcattaggatttcagtagtttttccctaatgtcgtcttttttttgttccaggatgcattcaggatgccatgttacatgtagcagtggtgtctccttaggcttctctggtctgacagtttctcagaccttccttgttttgaatgaccttggcagttttgtttttgtttttgtctttgagatgggatctcgctcagttgcccaggctggagtgcagtggcgcgatctcggctcactgcaacctctgcctcctgggttcaaggatcctcctgcctcagcctcccgagtagcgggactacacacacgctccaccatgcccggataatgttttgcatttttagtagagacagggtttcactgtgttagccagatggtctccatctcctgaccttgtgatctgcctgcctcggcctcccaaattgctgggattacaggcgtgagccaccgcgcccggccttgttttatttttgagacaagtctcgctctgtagcccaggctggagtaaagtggcgcgatcttggctcactgcagcctccacttgctgagttcaagtgattctcctgcctcagcctcccaagtagctgagattacaagcgcctgctacaaagtctggctaatttttgcatttttttttttttttttttgagacggagtcttgctctgtagcccaggctggagtgcagtggcgcaatcttggttcactgcaagctctgcctcccgggttcacgccattctcctgcctcagcctcccgagtagctgggactacaggcgcccgccactgcgcccagccaattttttgtatttttagtagagatggggtttcaccatgttagccaagatggtctcgatctcctgacctcgcgtgatctgcccacctcagccttccaaagtgctgggattacaggcatgagccaccgtgcctggccagaccttgaaaattttgagatgtactggtcaggtattttagaaatgtttctcaatttagttttgcctgatgtttcccttgtagttactacagggttgtgggttttgaagtaccattctccttatatcatatcaagagtacatactgtcagcacagcttatcactggtgatgtgaacctcgatccctggctaaggtcctgtttgtcagcatcttcaccgtaaagccacccctttctcctctctttccatactgcactctttggaaggaagtcactatggatagcccacatttaagcagttaggagttaagctccactttcttgagagagggttatgtatataaattatttggagttctgtaaggacttacctcttctcccacattcatttattcattcaatatttatctatatgagtatggatttgtggatgtttattttatactttgggttataatctaatactataattttactttgttgctgagattattccagctttggcctttggaaactcttgagtgggctcctctgtccctttaacctacctcctcccatcagtttgctttttgagcactttctgggactacaagatgttgcagggctcatctggtgttttccatgccccagctcttgaagcagccttttctgtaaggaggtggtgcttgcctattggagaatgctattagaaaccaagatctgtgcgttgggcgtgctcattgctactggggtgttactgcttctaggccttctgagaggacagagctagcaaatacatgtgtgtaagcaaacccatgcatatatacatgtctataattcatttacttatctatctgtctacctgggcaaacacgggttcatgcagatgtctccaactctcatcagggctgcatggatcattctagctttactctctcgcttatctgtaacttctctctccagtagtgagaaacctggcttccaccatctgccactcccgtacttccttgtttgatcccaatatacatgttcagcagtttcagaatttttaacctgcaccccgtgtgatgccacacattttgattcttctgttcattttctcttctccatttgccatttatcttacccttaaaaggaagatatttgacccaatctgctgtaaactctgattagcaagagagtaaggaactcctttagacaacggaaggcaaggatagccacttggctgccttagaaaccatgatccaagctcatctgtgatggcttataccatcacttcaccctgacctcatcactggcttataccatcagttcaccctaaccagtagtgggtagcttctgtgcccagatgttgtacatccgcccttgtttaatgatagcatgtatcttaagttattgtttcaattgagagagagaaagagacctcatgtaaatgtaggtaataaagttaaatcttccctaagcactgttctaatttttctttgccatatgttctgtggcttttaaaggggaaagtgacagaattataatggaaatacaaaaactgtaatagaaataaaaatatacacagataatcttaatattgtaaaaacataataaagcacaaaaaaataacaaagcctggaaaccatattttaaggaaatagagtttgatatccttagtgttttaactttcttaaagcatacacagcagagtgttatcaaagcattgtttaccacacatgatttctcctagttatttttgctatgattgggcttcaaaaatgcattctcatcgaccttcagatatttaaggatatttggagaaaagttgagaccatgttttttgccacctacttttttcccgcagggcggctctcagtttgtacaaaattagtaccaggagttcttttatggagattcttttctaaatggtccttcagttacaacatttgtgagctggaatactatgccacattagtctcagtttctcagtgcctgaaataattatgtgtggtgaaaaattaatatctaaaatgtcatatctattaaatagtataaacatacaacaaactctattaggtagaatcaatttttctaagaatctctataatttatttatcaaatttcaaagggaagactattcaaacctacaatttatttcatatgtatattagtctgttctcgcactgctgtaaagaaataccagagactgggtaatttatgtagaaaagaggtttaattggctcatagttctgcaggccagcttctgcttagcttctgggaagatctcaggaaacttataatcatggcacgtgagtgaaggggaagcaagcttgtcttatatggctggatcaggaggaagagagagagggaggtgctacacacttttaaacaactggaattcatatgatttcactcactatacagtatcaagaggggacggtgctaagcaattcatgaaaactctgccaccatgatccatacctcccaccaggctccacctccaacactgaggattataatttgacatgagatttgggtgaggatacatttctaaaccttatcaatatgataattatctagcctcatttatttttggcttatatggtcacatttgcactgggactgcctaactgatacatttctgtttaaataaaaaataaaacctgtgtatattttctgatttcttagcaattggtgttgtggggaaattctgttaggggtgggcttgtttcagtgggaagatagactgagctgtgtcatttaaagtctctacatttgattagctaatgactgtatttcaaaatatgctgtgttttaaaatgtagaactcaagtgtgaaaaggtaagttctgatgaatgacaagttactcttagtaacataaaaatggatcaaaattaatgctgaaaacaatcaggaaattttacctttcatctgggatttacctggcagtttgttcttatctgcatgtaaatgcaaaattcaccagacttactgtgaaataatttatggaaagtttcaaatggattttaatggaaaactgatccacaagaaaaattatagaaatatcaatagcaatgcccagtgtcctgggtatctaaagaggagagttaatattctgcccatactactcaaaagcagatgacagtggtcctcacattcatgatttaagagaagtacaatggcacatcggccaactgtgccaacatatggtttctaattgcaaatatggtctatgataggggaaaaataggctgttcttaattgcttcagagggaaagtagaatttttatgcagcatcagggaactggatatgtggattgggagagaaagatcccatgtattgtaagaaaatgaaaactggacatgtagccacagagatgaatttgagatggaaacttttgtttctatgttcataataattagcccttttatattttacaacatttaagttgttcaaagttaagcccttccatgagagttcagcacaaagtcttcatgaagaagtaaaaccatactctcagttccccctgggtttgccctctggttcaaagagggaagttggacaggagttaaattgaagtaataaatattttgctcctttactctgaattagcttcaaaatcagtctgtcccctgtatctctatctgttgtgctatggctgaaagtagggttaggaaccactttcagaagaatcagttagcgtaggacttgaatctccaattttccctagcaatgcacagtgtctgcccatctctgcccagatagtacctgaaattagagtagacttcactagtggaaggaataggatttattccaatttgtgtggaaggagaactcataaggatttaggaagtggcatctattgattgtctgtcttcattcagtttgagattttcctggttcttagtgtgtcaagtgattttcgatggaaacttggacatttttgtattatgttatgtgactctagatcttgtttgaaacctttggttttaactggctttgtctgacacctctatagcaggggaagcagtgggtgccgccttgtcaccccgacatggaggtaaaaatcccatttctccacctgtcctctgttgacatgctgtgtatgtgtgtggggtgtccttgttactgttgggcacaggtagaatttccagatccccatgtggtctcccttgataccacagttggggtggtcttgttcccagtgtgcaatgatttggccacctctgtattagggggaaggggagagatacccagttattgctgggtagggctggatgtcacggcttcctacatggtctccactgacactgtggaagatgcttcattatcagccaccaggcataaaggtgctagtttcctgcttggtcttctctgacaccactctagtaggggtattaggggtccttttcagagcctcatgagggtggaaatctagtaactccattcagcctttgctggcatgcatggtcacaggttcttctatggtgctcggctgtagtagagcagttattgtctaaaagtttcttatgttgctactctgcccctttcctggttatgtggctagagagtgcagacgtttgtggtctgtgcccattggtgtttctgggttgctggcttccatgcttgttggcctttcgaggtttcttacttcttcagctacgagtctgggatatttgaggcaaaaagaaaacccaggaatctcaccaccgtgttgtttcttgggttctgaggtcccaggcttgtctaccttcccttggccttacagaattttcttacatttttatgtaacacccgtggttgttttttttagttgtatttagccagaggaataagaaaaagttaagtttgggctgcgtgtggtggctcacgcctgtaatcccagcagtttgggaggctgaggcgggtggatcacttgaggtcaggagttcaagaccagcctgggcaacatggtgaaaccccgtctctactaaaaatacaaaaattagccaggcctggtggcatgtgcctgtagtcagtcccagctgcttgggaggctgaggcaggagaattgcttgaaccaaggaggcggtggttgcagtgagctgagatcgcgccactgcactccagcctgggcgacagagcaagactctatctcaaaaagaaaaagtaagtctgtttcatcttcttggaagcagaagtccttgctcttcaatttttgtttttatttgttttactatgaccaatattatattaagaaagttgttaaaaatacagagaagataaaagaattggtatcacgcctcatatgcgtatctaccagctggattcaacacttaacattttgctatattttactttattgcacttttatccatctgccttttccatctatctatccagttattatttttgacggacatcagtacacttcacctctaaacacttcagcatacatgtcattaattagacttcactgtcagtttacggttttttaaaggtaaattttacaaaagtgaaatgcaaaaaattgtaaataccatttgatgagttttgggtaatccaaccatcgttgagataatttccatcaccgctatacgttccctcaagtttcttctcaggttatttctgcctccaagaaaaaactactgttttgattttttcttttttgccataatttcaagtgctattttattgatggaataatattatagttcatcccttctggcctgcttccagttctttgccattaaaatttgatagttggtgtaacataagtcattgctatcttctgtcagcctagaacacagtgcaagcaaggcaacttaagattttgtgcatttcttctgattaataaaatagtgaagacatacaaagacatgtttttatcacacacagtacccaaattttccacatatttcttgttgttagtgtagttatcagtttctttgaagctcaaaaccttttttgtaatagaagcaaaagatagttttagccttgtaaaaatagaatttagcttcctggcaccaaattttattttgtgaatgagaaaccatgattttaactacaccataactgtaatattcattactgagaatgtcagactagtctctggaggaacagcctatttcacaaatacttagaatactctattcctgtacaaaatattgatggggttgttgcagatggattcagctgtgttgcacagacactcatttgtctggccccatctataatgtaagtctcttgcttctagtctgtttccccagaatgattttctaagtgggctgtaatttctgattgactgattgatatgagggaagtcctaccagctgtgaaatgggacaaataaactttatgtgagattccaattagagtggacgtgcttaccgttaacagcccagggaccaattgatgatgtggttttattacaaccttttttacaacctttctctgtctatatctttctttatacagttgacggactggacaaagcttctatagcaaactcagatggccccacagcaggttcccaaacacctcccttcaaaagaaaggggaaactatccaccattggtaaaatctttaagccttggaaatggaggaaaaagaagaccagcgacaaatttagagaaacctcggcaggtatgagtatcataacttgttagaagatgggataaattgtaaaacgttttaaaaggtagaaaattatgttttacagtgtgttttttcccagaaaaaaattaatccgtatttgaaatgaaattctttattttaagaataaaataaggatgaaacaacttaagagttctgatttgccttctttctatactgaccttgactttctaatatattcttatttaaaaatatatatttgtaaatttatataaaaaatggattggtgaggcgagggagtgaaatagtagaaaatgataagtggaaatgctattcatcaacattgtgatgacaggtatccatttttatatacacatgatgttatatatttagttagactatactatttatattaatatataaatatttaacgatttaactagtagactatactgctatacacataacgtaatgttaacggtcttgttcgttaattaaaacttttttaaaaatgtattttttgatgtatttattctttaggaaagattttagtggctatatgaaagaaaagttttgttatatttgattttagatttctatcatatccttaggacaaataaatggtctctgtcttaagagagtagaggcacaaccctattggtgtgaaaatgtttgattgttaatttagtttgtagatttgtgaaaccttaaaagttacattgcttagtgcctttcatatcaactcgtggacaaagctggctttaaatctcaggccagaattcagcccaatttaaacaagtgttagtgtgagtgtattgtgtctaagatagaaaagtgtttagtaagttcaacgttccccatgcttactgtccaaggcaatcccttcatcaaaattcctcactgcaccacagtctaatattgttagtggatgtacagggtcacagagcatatcttattggtctgtactaagataagaaccagagttttgttctagagctgtgaaatgaaattaaaaatactacacacaatgcaaggatatggaataggagcatcaaagctccccaaaaaagtggtctcggatgcatttgcagctatatagtttatttgagcattttatatttaacaagaaataatgataggctacctggaatttgtttcaaaataatcctggaggagtgtgaggtaggtaagattatagataaaggaagactggcaatgggttgttcaagctgggcaatgggtccatggtggttattattctcatttctctgcttatagatattggaaaatttctgtaataaaaagatagagaaagaagagaaacttggcttaagggaaaataatgctagtttggttattgggtcctcttcagcacctaagtggctttctgggttaggaggcagtgagaggtgagggacagggtgctgtgctgtgtgaggacacccggctgggtgactttgaacaggtcagatcagcctcagttttctcgcctgcaaaatcgggtagttgaatgtgctaaactcggaggtgcttcagttcctgattctgttgttggtctccagagacacccttacacccttgactccttccagtccctggctgggcatcttgttctcctctgttttttggttgtggaaggaacctcactggccttcttcaagtgcctccctctcacatgtgcttaagcattgggagaatctggctcttcacgttaccaagactacccaagatgggagcagggctccagacgtaacgtacgaaaacgaacataagatacaaaatggtgtatcatacattagtttttttcacattggagaaagatgtcatatctagaggaaaactgatatattcagttggtgcaaaagtagttgcgatttttgccattacttttagtggcaaaaaaccgcaattacttttgcacaaaactaatatttggatataaccaagagaaagttattttcttctttaaaaaattatctcaagcagtggaatcaagctgtttggatatgatcagggccatttgctgtctgataatcaatgaagtacaccttaggccagacccacaacatcttgaggtataaaagaaagttcatttcttccaagaaaagtaactcttctacgtttgtccttctcttaaactcctgggttggtattcacatggatatgaaccttattgtgttctgccgcacagcgataaataccacttttcctggtatgggtttctgttataggaattcttaattggtagtagataggatgtaacactaatttattaatgcattgtaatagcatgtttattattgtagtgggagttaagaagggtcccattcgtggccagttttggtggtccttgaatcagttgtattttggagtgctcattctacgtctaaaggacatcttgccctataaggcaggctgggcttatgccccagcttccagttctctggccttgttttaaagcagaaagtttccaatatcttcaactctgatttaggctgttcagtgtctggctgttagattctagggcaggagaatagatctcttttccgtccacttctctcagataccccccttcatttcttttcttctcctgcatgagaggtcccacgtaagctctaggttcttctatcccttccctattgttagaactcaaaatggcatttacatctttttttcccctacataatcattttttcccattttgctttgatttgatttgatttggtgggaggtgaggatataaacatccttcctttggatttttatatatgcttgtatctccccaaagctaagagtacaaatgccctgcctaaataaacacagttgtttctctaacttatcacagtgtattaccatcaaaaccaaacttactgaaaatctaacctatctctgctgcctctactttctttcttcccacattctcattccttttcccactgcaatctatctctgtgtcctgtattcaccgaggttactccaagcctccgaaccattaaatttagtgtcgttctcttattttcattcatttcaacctctacaacattttccattactgaacagtcagtcctgccttaatgtccaaaatacctcttccttaatttacaaaagctaccattgtcttgtttgtctttgacttctctttctctcttttgccttttctcttcttcttctcatcacccctaacccccagcaggaaggttgctatgtgccttagcccttctgttgctttgaatatgcacttctttcctatacccacatccctcaaactggcccaggctccagctgatgcccatgcacatctacccaagcacctgatgggtagcactatttgaggacagcatgttaactcaaaatccattcatatggtctaaatgtatttctgtggaaaacatgctagttgctaggcactgttctggaagctggtgttctgcagccaataagcaagtgaggttcctgccctcatggagctttcattctagacaggtagggtactaataaatgctatgatggacacagggagtgaaggaagagggagtggaaaagtactatctataaatgcattccaaccaaaacagatcccctgccaaccccagctatccttgttactgtagacatggcttcctttggcatccagactttgaaccacggagttctttgactcttctttctctcaccatcttctacattctatcagttcctaaaacgtttgatttattttctcctcacgcagagtctttaacatcagcctatcctgtcaattcctgttgtctagtcctatcacctaatgtctcaattagtgcaacgtagcttttttgctatgcttatttgtagctagctatagaaatctgtaggccactagagaagacaggaagaggtagggttctagcagcaagcttacctacgaggggaacctgacctagctggtgaggctgacaggggaggtttgggatgtcacaggctgtcaggaagccgagtgaccaagataatgactttacaagtatcaagcctggcaaatagagcaatgagtacttcactacaaaatggcacaagttccaacaggtagggtaaatctcagagcatccaggtgagcagtattagaaaattcaggcagtcctcagtaaccagggtattcttttctcaggtaggagtatttaggtggggcagatggtgtctgttatgggaatcagaaagacttgaacagggccttggtcacccaggctggtgtgcagtggtgctatcacagctcactgcagcctcaatctcctggcttcaagaaatcctcccgcctcagcctcccaagcagctgggaccacaggcacacgccacgatgcccagttaatttttgtacttttctgctgtacttttagtagagatggggtttcaccatgttgcccaggttggtctcaaactcccgggctcaagcaatctgcccacctcagcttactgaagtgctgagagtacaggcgtgagccacctcactcagtctatggccttatccttttttaaagaacaagggaatagagctgataagtaggacaggaacttaccaaaggactcaggacagaaacttgctatataaagtggaacacagggaatggatttggaagaggagtctcccaagatcctaagcctgtggtgctggagctactgttgctagaaatgacatagcccaagagctgggtgagcagggagaggagggcttgctctggtcagcagcagtggcccaacatgtgtggatctggggacataggtgggcagagcacccgtctcccctcttgcccctccatatcctcttggataaccaccatcaggaaacattcctcagatgggactttgctcctgtcacttcttgctcaaaaagtgtgactgggtctgcattgcttcttcagtgaaacccagactcctcagctcttctcagtttaacccaaactgaccttatcttttctattcgtccatagctcttggacttcagtcatgctgggtcactggctcagcatgccccaagccttcttggtcccttggcttttcttcttgctctctcctgttcctatgagcacctccttcctccagctatacctattgaaatactaccaatcattcaagggtcagtaacatgtctcttcctcctgcagatattcttgactttgattcagcaccagctgatcctcctttgcctgtactcctgttaggacatgtttattttaacttgttttcttgtttaagtgtctgtcttatgctcctaatttactacgtaaagtatttaagggcagagactatcacattcacttttgctgcacttcacataggttctttatgtaataacatacatgggatgtaataaaaaaaacatgccttgaattgcttctttattaaatacccactgtaaccaaaaatgcagtactgggtgctttaggactttttttttttttggtgggggaagggggtctcattctgttcccccaggctggagtgcagtggcacaatcacaactcactgcatcctcaacctccctaggctcagatgatcctcccacctgagcctcccaaatagccgagactacaggcacacaccaccacactcggctaatttttgtgttttttgtagagacagggtttcactgtgttgccgggctgttctcaaactcctgggctcaaacaattcatcctccttggcttctcaaagtgctgggattacaggcatgaaccatcataccctgcctatgctttgggactttataaaagaaattgaagattttaaaaattataacaaattaaaatactaacaaaacatgtacttcacaattacagccatgtaccactgttaagaagccaataaaattggaaaaaaatattttcctatcttttgtccttatttaaaagtaagttatactcctgtataaagaaaatcaaggcaacttatcttcaataaaatggagacttttatttgtgttggtggtaatagaaaaagaatgcctgtctagatttttaggtagcattctaggaatcagatctttgattttctgaaggtactgtgtactccctaatagtaataataatggctaatttttattgaatgctgttaggtaccaggttctgctccaagaacttgattcatattaactcactaaatcatcagtacaacctcatgaactgcaatctttaagggctactattatcccagttctactgatgaggagactggggctagaacattcagatgacttgcccaagaaaacacacctggcagtaggcaaaggcaatatttgaacctaagcaatgaggtcccatagccagtactttcgaccattcactagttgcatctctaaaaggtgtcttcctacccacatcagaaaggactgatcactgaaaggtggctctaatatatggttttgcctcacacattagtttttgctgtaagaaggattttgtctgaagaattactttatttctacttgactggcctgctttcctcagtgcacatgtagaaaaatggttggcaaggatcaaagttatgtttggtcctattaaaggataatattctcttgtaaccatagagacctaatgttgctatttaggattattttccacatctagaaagtagggcgaagttaaaggatttgcttaaggtgatatttgttaaggattgctctggttgcattaataaatgacagcattttgattttgcttgtcttattccactaagaagttggaaagttggaagtgttttttttttttttttttttttttggagacagagtctcgctctgtcatccaagctggagtgcagtggtatgatctcggctcactgcaacctctgcctcctgagttcaagtgattctcctgcctcagcctcctgagtagcagggactacaggcgtgtgccattacgcccagctaatttttgtatttttaatagagacagggtttcaccatgttagccaggctggtcttgaactcctgacctcaggtgatccacctgcctcggcctcctaaagtcctgggattacaggcgtgagcaaccgtgcctggcctagaagtgcttttatttatcattcaccctcacatcatattggaggaagaggaaggaatctttcctttttcctaatttactgtatcagggagaagttacgtaaccagccaaaggccacacagcacatctagatccacagagggcttcttgctttgtgttcgacacttctttttttttttttttttttttgagacagagtctcactctcgcccaggctggagtgcaatggcgtaatctcactcactgcaacctccacctcccaggttcaagcaattctcctgcctcagcctcctgagtagctgggattataggcatgcaccaccacacccagctaatttttgtatttttagtagagacagggtttcaccatgttagccaggctggtcttgaactcctgacctcaggtgatccacctgcctcggcctcctaaagtcctgggattacaggcgtgagcaaccgtgcctggcctagaagtgcttttatttatcattcaccctcacatcatattggaggaagaggaaggaatctttcctttttcccaatttactgtgtcagggagaagttacgtaaccagccaaaggccacacagcacatctagatccacagagggcttcttgctttgtgttcgacactttttttttttttttttttgagacagagtctcactctcgcccaggctggagtgcaatggcgtaatctcactcactgcaacctccacctcccaggttcaagcaattctcctgcctcagccttctgagtagctgggattataggcatgcaccaccacacccagctaatttttatatttttagtagagacggggtttcaacgtgttggccaggctggtctcaaactcctgacctcaggtgattcacccacctaagcctcccaaagtcctgggattataagtgtgcgccactgtgcccagccaagtgttcgacacttctttgtcctcagcaagtgtttactgaccatcttcatctattgtatgtgatacatacaatatgtcaggaactgttacaggctctagggatactctcatagattttagtgacataaaagagacaatcttccttcttgcaaaaacttgcattctagtaggagaaggaagcagaaaataaacccaaataagttagatactgtactagaaagtgagaagagaaaattaaagcaaggaattggagtagagaatatgggagggaggttacagtttcaaatcgggaaatgttcctgggaaggtaacattgaaggaaaggcaggaaggagggaagggaaagcactgagagaatcctgggaagtcatcacagagttagcaatagcatgcactttcagtaatggtgtggacacattgtgattctaggcctttacaaattttgtctgataatgtaaccattaaaatgcctcacattcacgaacctcatggttgttaatctttttgttgttgagacaggatctcactgtgttacccaagctggagtggagtgcaatggagtgatcatggctcactgaaggcttgaccgcctgggctcaagcaatcctcccacctcaagtcccctgagtcattgggaccacaggcatggaccaccatgcctggctaatttttgtgttatttgtggagacgagatctcgctatgttgcccaggctggtctcaaactcctgatctcaggtgattctcccaccctggcctcccaaagtattgggattacaggcgtgagccactgcacctgccttggttgtcaatcttgatatctactgcagctccatggctcctaacaaattatggaacttcattctatacaattttaccagaagaggagcagggtttaactctataatataagcattttgttatggctttctttcttcaactcaaattcgcaaggcagattctgacccaccatcaaaccaaaagtcagaaagccaacctcatggagttccagtttagaatggcgcatatgttggtgttttctggtggacacagtatcaagtcctattgagactgcctttctaagttgaaataataatgcattattgcctctgtcttaagcaatccttaacttacagactggtggtgtctctggtactgcatttttagattatttggaattatgggtatgctcccaaactaatttacaaaattgagtttaacccataatacgcctgaagcctgggactattaatatttattcaaatacagccaaacactatttattgttactatagtaaaacactttcataattttcaattgaaattaagaatttttgagttgtaaaggatcttagccatctagttctctctctagggcaggaatcaaccctgtctccagcagccctgataacatgcagtcattgagcttctccctgaattccttattcccagctctaattgttgaggaggtttccttttgtgttggcctgaaacaaattatctccagtctttctaactatcttctgatgtgtgtgtgtgtgtgtgtctgtgtgtgtgtgtgtgtatctcctaattacattgttacatgatcatccttccatcttttctttaagtttgttcatccctttatctattgtcagtttcagagtttctcaccacaggagtgtactagattgtctaggtcactcagtttttatggagttcctggcccagtgcaggtgtgtgctagggacatggtcataaacaagcctgaccagttccctgtgctcatggagtccacagggtgcctgtgcatctggcagtacctcatgtgttctttcttagctatttttaatcctaagctaacatggtgacttttccaaaagttcttattatttctacttcaccaaccacattttcagtatttagaattaagtctagaatagaatttcatcttacttaaagaggaatttaccagtaagaattaagcatcttgtaaatgtctagggagctggaagttcccatgaaaactctctatcacttttctgcttatttaatgttctctttgtggaaaatatcacccagagcctcctaacagggtgatctgttttatttttttataacaatatattttctgttctttctctgtaccctcatgtggatatatgtacatatcatatccacatttcttggatgctagtttctccgaaagcactagaagtctctggcattggtttttttttctattctggccactgtcctccatgatatctggttttataccattttgtgggtgttttcttctctcttgaattcaactttaagattctcttcaataggccaatttggtgagcatcttcttggcatgtcatttttttcttaaatttttttatttttaatgaatgcataattttcgtacatattttggggtatatgtgatatttttatataagcatacaatgtgtaatgtttaaatcaaggtaattgagatatacatcacctcaaacatttatcgtttctttttgttagaaatagtccagttccactcttttagttattttgagatatacaatattgttagctatagtcaccccattgtgctactgaacactagatctattctttctatctaactgtacatttgtaccccttaaccatccctcctccccactacccttcccagcttctggtaactgtcgttctactctatctccatgagttcagtttttttgttttagctcccacatatgagtgagaacatgcaacatttgtctttctgtacctggcttattttacttaacataatgtccttcagttccatccgtgttgctacaaatgacagaattttattcttttttatggctgaatagtattccattatggtggaataatattccattgtgtatatgtactacattttctttacccattcatctgttgatggacacttaggttgattctatgtcttggctgttgtgaacagtctggcatctcattcctattttcatgtaatgaaccacatgtcttgtcaggctattgtaggactgttatggtccagaaagtcagatcttgtcttcgacaccatcagttgaaatggcttttcccatttctttatccactcttttcatatgtcatgatctctagccagaagagaagagaaccacatctcaccttccacgccttcctgttttccactcaggacttctgactagctagaccatccagatggcttctgaggaagacaattattcttatttttaaaaatcagtagaggagggtttgaggagttttgatgtgccctctttcatgtcctaagaaacacattgcaagaagacagcgttccttctgattagccaggcaggtctatgcaaggctgtcatctctagcactggcacctcatcaagagctcctcagtgaccacttttgacttttcctgctgggtctcatgaatcctccttgtcatccattcatacagcaaatattcactgagcttctaccctatgcccagattctgttctagagaaacaagctcatgaagctgctattccagggaagaaataccagggaagggtgttgtggggaaaatcagagtatacgtggagatcgagaatagcggtcagtgagagaagcaagacactgggtcggagtctctggtacaccacccttctctatcttacctactgctccatgccagatctacacagcacatcaattctccctctcctgtgtgttatcttttttctcctattaactcttgacaggacatcttggttttgtcaagaggttgatctcttggttcctattttttcctcaaaacatttctttttgtgtggctttcttaactgtataattcttccgtttttttcttttttctttttttcttttttttttgagacagagtcttgctgtgtctcccagactggagtgcagtgacatgatctcagctcactgcagcctctgcctcccaggttcaagcgattgtcctgcctcagcctcccgagtacctgggattacacgtgtgtgagaccccacttggctaatttttgtttgtttgttgttgttttgagatggagtctcactctgtcacccaggctggactgtagtggcacgatctcggctcaccgcaagctccgcctccttcatgccattctcttgcctcagcctcccgagtaggtgggaccacaggttcccgccaccacgcctggctaatttttttgtatttttagtagagacggggtttcactgtgttagccaggatggtctcgatctcccgaactcgtgatccacccgcctcagcctcccaaagtgctgggattacaggcatgagccaccgcgcccagcctaattctttcatttttttctagaaaacattcaccttttccagactagagcaaaggatgatgcgacccaacttctttcaccttcccttttagtgggaaagctggtttatatttatagattgcctcttggtggctcctctccaaggaagaaaaatagaggtcccagccccgagtttctacacagtcccagaccatggggtgtcagggttacctttggttgtttttggcagcccctcttggaaacatttcctgtaaatagcccctcaacaaactgggcctttaaaaatggggcttttttgttgagccctggtttgtgccagctatgtcaatcccttgacctttcagaaaacacaagtagctttttgacttttccaaaatgttttcctgccttgcctctctctttggttgtggccatgggccaatgagcctatagttcactggaaaatgtatgtattcattctgacagctccagtgtggactcctgagattcttcttagaaatagctgtggtgtggcatatgctggaggcagatgtacaaaggtaccatgaacaagttcactttctatggcgaatatgtgatcatgaccttctccaaagaggttatctcttggtcattcaccatgtgggtgtttcctctttgttttatatgtgtctgtgtatatgtgtgtatagtgctaagaattttaatatacgtatagttttgcataatcgctaccacagtcaggatatatcagagttctgtcactccccaaatctcctttgtgctgtctttttttttttttttttttttttttttgaggcgaagtctctctctgtcacccaggctggagtgcagtggcgtgatctcggcaagctccgcctcctgggttcatgacattctcctgcctcagcctcccgagtagctgggactacaggcgcccgccaccatacccggctaattttttgtatttttagtagagacggggtttcaccatgttagccaggatggtctcgatctcctgacctcgtgatccgcccacttcagcctcccaaagtgctgggattacaggcgtgagccaccgcgcccggcctgtgctgtctttttatagtcacgccttcccaacccctaacttctggcaactactggtctgttcttcttcaccatagttttgttgtttcaagaatgtcataggctgggcaggtggatcacgaggtcaagagatcaagaccatcctggccaatatggtgaaaccccgtctctacgaaaaatacaaaaaattagctgggcatcgcctgtaatcccagctactgggaggctgaggcaggacaatcacttgaacccgggaggcagagcttgcagtgagccgagactgagccactgcacaccagcctggcaatagagactctgtctcaaaaaaaaaaaaaaaagaatgtcatataaatggaatcattcagtgtgaaatctttggagactggtttcttccactttgcagagtgactcacgagagcttcctccaggttgttgcatgtattcatcattccattttttgttgaatagtatttcatggaatagatgtaccacagtttatccatacatgaaagacacatgggttgtttctagtttggggtaattataaataaagttgctataaacattcttgtgtacattcttgtgtgagcaaaagttttcatttctttagggaaaatgtgtaggaatgggatcttggggtcatatgttaaatgtgtgtttaactttataagcaaatgccaaacagttttccagagttttgcattcctgcaagtagcagagaaaagtttcagttgctccacatccttgtcaacacttggtattgtcattattttttgttgttaaggtaaaaacatttgtcataaaattcactatcttaaccatttttaaacgtgcagctcagtagtgttcaatatatttacattgttctatgaatagatctccggaactttttcatcctgcagaactgaaactctacatctattagccaacttcctttttgcccccccagtaacccaccattctactttctatcactatgaatttgactactttagatccctcatataagtggactcagatagtatttttttgtgactagtttatttcacctagcataatgtcctcaagtttcctccatgctgtagcatgtgacaagatttccttttttcaaagactgtgtagtatactacattgtttaaatccattcattggtcagtggacatttgggctgcatccatctcttggctattgtggatactgctgctctgaacataggtgtgctgtaattagttttatgttaaccattctagtaggtatgtagtggtattttgtcatggttttaatttccctaatgggctaatgatgttgaacttttttattgatacataatatttgtgtatatttataggatacatgtgatattttgttccattcatatactgggtcatgatcaggtcagggtatttaggatatccatcacctcaaacatgtatcatttctaccattggggacatttcaaatcctcttttctagctgttttgtaatatacaatacattgttgcaattgcagtcaccctactgtgctattaaacattagaacttatttatttgatgtaactgtatgtttgtacccattaatctgcctctctttatcccttcccccactgacacccacacacccttcccagcctctcgtaactgtcattctactctctacctctatcagatcaactgttttaaactcccacctatgagtaagaacatgtatttgtcttcctgtgcctggattattttacttaacataatttcctccagttgtatctatgttgctgcaaatgacaggattttattcttttttttttatggccaaacagcattccattgtgtgtacataatcatattttctttatccattcatctttgatggacacttaggttgattccatatcttggctattgttaacagtgctacaataaacatgggcatgcaggtatccttttgatatactgagttccatttttgtgggggtgagtacctggtagcgggattgctggatcatatggtggctctatttttagtttttttgagaaacctccatactgttttctgtaatggctgtactaatgtacattcttaccaacaccgtgtaagagttcccatttctttgaatcctcaccaacatctgtcattttttgtctttttgataatagccatgctaactgaagtaagatatatcattgtggttttgatttgcatttccctgatgattagtggttttttcatatacctgtttgccatttgtatgtgtttttgagaaatatctattcatatcttttgcccacattttaatgggattatttggtgttttgttgttgagttatttgagttccctgtacatacctcaacatattaaagcccttatatgacaaaccaacagctaacataatgctgaatggggaaaagttaaaagcctttcctctaagaactggaacaagacaaggatgcccactttcacctctcctattgaactggaagtcctagccagagcaattaggcaagagaaagaaataaaaggcatccagaatggaaaagagaaagacaaactgcagatgacatgattttatatctagaaactcttagatctgataaacaaattcagtaaagttacaagatacaaaatcaacataaaaatcagtggtgactcttttctttctttcattctttctttcgttcattcgttcttttgttcttctttctttcctttttttttttctttctttttttttttttttttttgagacagggtcttactctgtcacttaggctggagtgctgcatagatgcttactgcagcatctacctacagggcttaggtgatcctcccacctcagcctcccgagtagctgggactacaggcgcacaccaccacacctggctagttttttatatttttttgtggagacagggtttcaccatgttgcccaggctggtttcaaactcctgggctcaagtgatccaccagcctcatgagatttttcacagacgtagaaaaatttgtatggaactaaaaaagagcccaaacagccaaagcaatcctgagcaaaaagaagaaagctggaagcatcatagtacctgacttcaaaatatattacaagtctatagtaaccaaaacagcatggtatttgtataaaaacagacacatagaccaatggaatagaatagagaacccagaaataaaactacacatttacagccaactgatttttgataaaggtgccaagaatatagattagggaaagaacatcctcttcaataaatggtgctggaaaaagtgaatatctaaacacaaaagaatgaaaatagacacctatgtctcacagtatataaaaatcaacgcaaaatggattaaagacttaaacagaagacctaaaactatgaaactactagaagaaaacataggagaaacactctagaacatcagtctaggcaaagattttatgtctaagacctcaaaagtataggcaacaaaacaaaaaagcacaaatttgactatattaaactattaataaaaagtttctgctcagcaaaggaagcagtcaacagagtgaagagacaatctgtggaatgggagaaaatatttgcaaaatattcatccaacaatgaacttcttttcatgtacgcatctgccatccatatatcctctttgatgaagtttctattcaggtcttttgcctgttttttaattgggttatttgttttcttactattgaattttgagatttctttatatattctagatacaagctctttgttgtatatgtgatttgcaaatattttctcccactctgtagattgtcttttcattcttataacagtaccttttgcagaggaaaaatttttaattttaatgaaatccaccgtatcagcttcttttaaaatagatcatgcttttggtctcctgtcatgcctaatctcaggtcacaaagatttttatcctatgttttcttctaaatgtttttatagttttatgttttacatttagatctatgatcagttttaggatcatttttatgcaaggggtgaggtttgggtcaaggctggttttttgcatgtaaatgtctagttatttcaatatcatttgttgaaaagatcatcctttttctattaagttgcctttgtactgttttaaaaatcaataagcatatattgttcttccacatattctctttggtaaaagtcttttgtccaatttttactgagtagtttgttttcttaatgttcagtttgagagtattatatcttctaggttcaatgcctttgtcagatatgttacttggtgatattttctgccaggctctagtagcttgtctttccattctttaacagtgtcttttaagagcaaaggctcttaattttgatgaaataccattttttttctcttttcagatcatgcttttggtgtcatgtgtaagaaatttcaacagcatttgttgaaacgactattacctttgcacctttgttcaaaaattgattggcaacatatatgtggtctatttctggactcactattttattctcttaatctgtgtctattctttcaccaatatcacactatcttgattattatagctttataagtctgaaaattaggtagtgtgattttccaaccttattcttcatttaaaattgttttaactaatctagtttgtttggctttcatttaaattttagaaccaacttgtttttattgttgaaaaattactgctggggtacttttttttggctaggatttttatttaaactgcattaaatctatgctgcagtttgggtagaactgatacctataccatattgaactttctaatttatgaactggtatgcctctccatttgattagcttttccatttttttattagcttttgaagtttttagaaaacagttaataagtttatacttcagtatttgttttctttattttttagctactgtaaattatatatatttttaaatgtcaatttccagttgttccttgtatcatgctaccttattaaactcacttatcagttctagtagttctagtgaaaataccttaggattttctacatggacaattatgtcatctgtgaatgggaatcattttatttcttccattctaacctgcatgttttttattttttcttcccttttttcaccagctaggacttgtactacaatagtaaacagcagtgttgaaggagatatccatgctttgttcctattcttagggggaaagcattcattaagtatgatgttggtgtaagattttttgtgtgtgtttgtttgtttgagacggagtcttgctctgtggcccaggctggagtgcagtggcgcgatctcggctcactgtaacctccgcctcttgggttcaagcgattctcctgcttcagcctcctgagtagctgggactacaggcacgtgccactgcacctggctaatttttgtatttttagtagagacggggtttcactatgttggccccaggctggtctggaattcctgacaacatgatccgcctgcctcagccttcaaaagtgctgagattacaggcgtgagccaccacgtccagcccagttgaaggtttttatacatgccctttattaggttgaggaagttcctttttgttcctgactttctaagagtatttattatgaatagatattggatttctcaaacgcatttttctggatcaattgatatggtcatttcagtttttttctttagaccactattatggttgattacattggcagatttttgaattttgaaccagtttttgcatccttaggataagtcccactgtgttgttttgttttgttttgttttttgagacggagtttcgctcttgttgcccaggctggagtgcaatggcacggtcttggctcacagcaacctccgcctcccaggttcaagtgattctcctgcctcagcctccggagtagctgggattataggcatgagccaccacgcccggctaattctgtatttttagtagagattgggtttctccatgttggtcaggctggtctcgaactctggacctcaggtgatctgcccgcctcggcctcccaaagtgctgggattacaggcatgagctacggcgcccagccagccccactgtgttgtggtgtagtattctttttatatgttgctggattttattgaataatattttgttgaggattcatggtattgatctgtagtgttcttgcactatctttgtctaggtttgatatcagggcaacaccaactttatacaatcagttggcaactgttccctcctcttctgttcctggaagagactgtgtagatttgttgttattttcttcttgaaatgtttggtagaataaacagtaaagcattatggacctgaagatttctcttttgaaagatttaaatagcatattcaatttcttttatagttataggaccattcaggtgatctcttttaacttgggtaagtttaagcaggccctctggtgctttgaaatggaaaagaaagtgaaacttttcctctagatttctttatggttaaccaactgccttatctccttccataaagtctatgtgcaaatgctactttctcagtgagatctatctggattgttctatttcaaatctctcctctcccccagaattctttaaattaaatggccttgttgacatataattgatataccaaacagttcacccatttaacgtgtgcaactcaataggttttagtaatattcatgagctgtgaaaccatcaccacaatcaattttaaacatttccatcactctagaaagaaatcccatactcattagcagtcattccccatttcaccagtctcccagctctactttctatctctgcgggtttgcctattcttgatatctcatacagatggaatcatacaatacatatgtggtcttttatgactgatatctttcacttagcaagctttcattggtcatctatgttgtagcgtgtatcagtacatcatttcattatcaaataccaaacattccattgtatgaatataccacattttatttattcatcagttgctggacgttgggtttctttctattggcggctattatgaataatgttgctgtgtgcatttgtatataagtttttgtgtacatatatgttttcacttctcttggtttcatttctcttggttatatacctagaaatggaattgcttagtcatgtggtaattcaatgtttaacattttgaggaactgccaaactgtttttcaatgcagccacaccattttatattcctactagcagtgtatgagcattctaatttctctacactccagccaacatttattactacctgtctttttttattattgctatcctggtgggtataaagtagctccacccagcacttttgattactccttgtcttttcttttctgatttatttatttatttgagacagggtcttgctcattcacccatgctggagtgcagtggtgtgatcatttctactgcagcctctaactcctgggctcaaagcaatcctcctgcctcagcctcccaagttgctaggaccaaaggcatgcaccacaacacccaacttaattttaaaaaaaaattttttttcatagagatggaggcttgctcagctgcccaggctgggtgtccaactggcttcaagtgattgtcctaccttgacctcccaaagtgctgggattatagatgtgagccaccatgcctagcctgattcctcctctttttctaccttacttttttcattttccatagcacattttaccgtctaacatctataaattatttctattgtttgttatctgaccccacttcctagtagattataaattccatgagaacagggatttttgttttcttctttggtgagatctcaaagaaacttgtatagtgcctggcttatgttaaacattcagtaaatgtatattgaatgaacgaatgaatgaatgaatggctcttgatggaccttatcccatcctatatatggagcatttgcaagtgaatcttttcgatttggaaagtgctggatttggggtgaggggtagggaatgactgcttgttttcaatccttctttagtgttcataccactgagagttgcttaaaacagcctcaagaaaccctgaaaagccataacagactaaatgaatattttaccaatttagtgggtagggtggggagctattctctcatgaatggataatgaccttaagtaactgtgactgctctgtatggcagcattgcaaaggtcaatgtgggaacatctttctcagaaaggaagtgtggtgggggttgtattttaattcaaccatttgtgttcttgtgtatttcacaacaaaacctaatgagaccaaatgagtgctagaaattctgtgggcaagagatattatataataattttattacgtatgcttttaaaaaatatcgtctattattttcctaaaggtatataattgtgttaaaacagatttcctctatgtgctctaaatataaaggagactaattatttctccccttttcttctcccagtagaatggattttttttcttggttcaatctttttatacataggtggatggaaagactcattatggcccatctttttatttatggagcatttattattcattataggtctattctagtggtaaaacccatttatgggaaagagtaatagaatatgagtgctaactttttgtgcatttgtcataattgaagttagtggttttataaatatgggatgcttccaccatgggtttagaatagcccagctgcacaataaatggcctaaccatcaggtcctacctcttacagatcgataaaaccatgaaatctttttttctaaatggagttgaggagtctcccttgcttcctgtacattctggaaaaagtgggatattgtgtttaatccaagccgagctctggatttaaatgggttgcaccatagacctgactagtatctcaagtctcccgtcttttccagggggagttaggtttttctagtgaattcagataagcaaggcattttcactgagcattctgtgaaagcattctcaaatgagacatggatgctactgattttgctgatttctgattacaaatgacacattttaaaaatcacacacatagaatgaattgcagaattgttaacttgctttcccttttttttccatcacatttgattgctaagggggatgtggagaaaaggagcactgttcccacccacatcttaattaaataaggcctccattgggttgagacaaagtgggtttgtattgctttaagagaagatccgattgtttatatcccttgcttgggtggataatttcctaatttcattttcctttggagtggtgccactttaaacacttttaaaggtactacagaagcccttctggcctgggtcagagaattcatgtcaggaaagtccattattttatttcctttgcatattatttccctttgtggttttgttttgtctttttcatcctgtgatatgaatctggtccttatcactgagggctaagtcctggaaagtgactgttttttggcttacatattttcctgatttatttctcacttagaatataagatgcaatcttaatttttacttcttttgtgttaggtgtttgctcacctaggcttataacactttttgtccgaaggtttctccaactgattcccaagcctagactgtaagttttgaaattggtactcatgaagtttcctttattccaaagtataagtgtttacttagtacccataagacagggcgtaagaggctatatacaaaaatacaagataataaaaaaacatgattggaaagaagactagatattagaaaattattagaaaactgattatgcattatcgtgatgaaaattctttcttgtctgtttttcatttcagcatttatagaaatctatagtcctaaaatattttacaatttgattttattttaaaatccataatgtaaatttaccatcttagccattttaggtttacggttcagtagtgttaagtatattcacatcgttgtgcaacagacctcccgaactttttcatcttgcaaaatgaaaactctgtgcccattcaacaacttcccatccccccaccccaccacttaccctctgtaatgtttttttaaaaaaacttcagatgaatcaaatgcaaaacattattgacaccaatgaaagtttaatcacctgtgttaagtaagacagtgacatattgctggcattccgtcatcttttctttttgctgagtttttcatttcaattcaatgctaaaaagttcaaattagttactaccccatgaggcttgaaaatgttccctttggataatttgggtaatttctatatgtgtagcattgtgaagtaaagtagtttttcctaaaaaaattaaagtttaaaaaatgtatttctgttactcatttgaagtttcatttaggattaaacttaatataggaaaaagatatgtgggtattaataataatgataactaactcattgagtatttactatgtgtcaggcactcttttaattaattattaataaatttttatagacacgttctctctctgtcacccaggtgggagtgcaatggcacaatcataactcaccttaacctctaactcctgggtacaagcgatcctcctgcctcatccagataattttttaattttttgtcgaaatggagtctcactatgttgctcagcctgtgatactattttaaatgcctgcaatcttctcagttaccctatgatgcaggttactattataatctcacttttactcctgagtaaactagcgaggcacagaaaagttaggtaatcaccctaagttccaggccttatgcaaagcatagccagtatttaatcctcagaaccctgccttgagtttgcattcttaatccctatactatgctgccttctaggtcaataagcatgtcaaatgaaaatattggtggattattatcaaggaatatgcaaatgtatacaggagaaatggaaagtagaggagaaaaaaactcctatttctttggtctgtaatttatgccaaaccctttacaattttttttttttttttttttttttttttttttttttttgagacggagccttgctctgtcacccaggctggagtgcagtggcaagatctcggctcactgcaagccccgcctcccaggttcaagccattctcctgcctgagcctcggagtagctgggactacaggcacccgccaccatgcccggctaatttttttgtatttttaatagagacggggttttactgtgttagccaggatggtctcgatctcctgacctcgtgatccgcccgcctcggcctcccaaagtgctgggattactggcgtgagccaacacgtccggcctacaagatattttaatcatcctaacgtctattcatgctaggttttagtgcctgtgttttcacatgtggaaataaaggctcagagaagttggggagtttgcctgtgttcacctaccaataacttgcagggtctggatttgaacacaaaggtatattcttaagaggactggaatacatcctatataaaagtattctattatatagagtctattatatataatgtaatataacatcgtgaacttctatataaatattatataggaatgatatttattttatacctttctgtaaatattatacaggaaacaatataggacaagaatacttctacacataacatattctagacctcttaagaattatatatattatatatatgtctatgtagtatatagcagtctattctttttaaattaaattaaattttatttattattattttttagagtgatggtgtctcactgtattgcccagggtggtctcgaactctgggctcaagtgatcctcctgtctcggcctctcaaagctttgggattacaggcatgagctgccacacccagcccagtctattctaacctattgtatgaaatattctattatatatagtatgtattaagataaatatattcttccttctacatttcatagcctttcagtcttcaagaaggatgagaccctgatattacccaaataatcacaatatttgaaacacagagtggcaaggagggattattgaaaagagcataatgtctaagtacaaacttagctttgctatcaaaccttaagtgttacagtttcagctacagtgaaaagttacctttccccaaactgcatttttgtgtttatcttagaaaataaaaacttcagttgaaactacccattttcctatcactgcagggttgggcaggaatcaggtgtagtttatctttcctgctttagtttaggcctggaccagttttgccaaaggaatactgttctttacaaatactgtgctctctgttgtgtaggcaagatggtaggtagtggacagaatgtgaagaatgctccagaaaataaactttttaatcatcttaagaaacctggtctgattggatatgtaaaatgaaagtaataaacatggatttggggaaattcctactcaaatcttcttacaacttagactggttatccccacctacctgagttggtgttgttttaatatgtattgttcatggctcaactcaataaaaaataggcttttaaagattatacatttttggccaggcgctgtggcccacgcctgtaatcctagcactttgggagtcctaggcaggcggatcacaaggtcaggagttcgaaaccagtggggggcgcctgtaatcccagctactcaggaggctgaggcaggagaatcgcttgacccgggaggcagaggttgcagtgagccgagattgtgacactgcactccagcctgggcgacagagggagactccatctcaaaacaaaacaaaacaaaagattatacattttttttcatgacccccctgaaaagatcaacctaaaatataaagaatttcagccacctttaccccagggcaatagaattagatctttaaatgagttgggaccagcacagtgactcatgcctgtaatcctagcactttgggaggccaaggtaaatggatcacttgagctcacgaccagcctgggcaacatgacaaaaccccatctcttaaaaaaaatacaaaacaaaaattagctgggcatggtggtgcatgcctgtagtcccagctacttaggaggctaaggtgagaggatggcttgagcccgggaggcggaggctgcagtgagccaagatcgtgcaactgtactccagcctgggtgatagagcaggaccttgtctcaaaaaaaaaagaaagaaagaaagaaagaaaattaaatgaatggaaatgtcttcatttaggatgctttagtgtcactaagatttcttttctatctaatcttgcttgctgttgactgatgaaatgagatattatcccatcttgatcaaaggtgttgagtccctgaaatgtgtagattgaaagcagatcatggagaagggtgttagaagttcaggctctctggagcttctcttccaatggctattgtttatgatctcttagtttgaaaagcttcattaccatttacagctgagattcactttatttatttattatttatttatttatttttgagacggagtctctctctgtcccgaggctggagtgcagtggcacggttttggctcactgcaagctccgcctcccgggttcactccgttctcctgcctcagcctcccaagtagctgggactataggcgtgcaccaccacgcccatctaatttttgtatttttagtaaagacagggtttcaccatgttagccaggatggtctcgatctgctgacctcatgatccaccagcctcggcatcccaaagtgctgggattacaggtgtgagccaccgcacccggctgcgagattcactttaaaatcagttctctagcctgttctttttgggacgagattagagtgtaatttctctagggatgattatcattattcgtatttcaaacattggtcccctctgtggtgtcactgtgtcttaggtttaccatcttttactgtaaagaaacaggaaatggaaacacgcaagcttttctttgaactagatgaattcaaaaacacctgtcttaggcattcgtgtttcttatgagtttgcgagagtccgagtgaaggggaaggacaggctgtgttacacgtagcactcaaatcttcgcttctaattactctcctgagattgcttgtacttcctggcccttctgggattgaggacttgctcattgtttgaatcttggacctttattccttcggaattagaaccataggtccccatgggctgatctcccatgtccattcccttctgctgtttgcgcaggtctaagacaatcacctcttccctcctcccacctcggtcttatctgtgacctcctactacctgaaatttgtaaactattatatacttttgttacaggaactgggtcctgctcaagaccccaagagagggttcttggatctcggacaagaaagaattcagggggagtccataaagtgaagtgaaagcaagtttattaagaaagtaaaggaataagagaatggttactccatagacggagcagccctgagggctgctggttgccgtttttatggttatgtcatgattacatgctaaacaaggggtggattgttcatgcctcccctttttagaccgtatagggtaacttcctaacattgccatgccatttgtaaactgtcatagcgctggtgggagtgtagcagtgaggatgaacagagatcactcttgtggccatcttggttttggtgggttttagctggcttctttattgcaacctgttttgtcatcaagatctttaagacctgtatcttgtgttgacctcctagctcatcctgtgatttggaatgccctaaccatctggaatgcagcccagcaggtcttagcctccttgtacccagcctctattcaagatggagttgctctggctcacacgcctctgacacttttacaaaaacaaaacaactattacaaaacatccttttaattaaaaaaaaaaaaaaaggaaaaaataaaatgaatatttgttcaagtatgtctggaaggatacacgagacactaataaaagtggagaattgcttgtggagtaaggctgaggttcaagtctaatagttgggaggcggggtgagagtgagaatttacactgtatccttttataatttgaactctgtgagaatgtactaccattttaaaaatacccatttaaaattaactttaaaaagtgttctgctgtctgctttcttaagaaaaatcagaaagcagcgtacctctggtgggaaagttggaatctttacaattatgaactcagattggagaatacaaagcaggagtcttttggttacacacacctgggttcaaccaggttcctactgtgtgactggaaaatgtatttagtctctgtaagtctcaatacccttatctgaggaggaaaataaaaataattgcttagctgagcgcagtggctcacgcctgtcatcccagcactttggaggctgaggcaggcggatcacttgaggtcaggagttcgagaccagcctggccaacatggcgaaaacccatctctactaaaaatgcaaaaattagccgggcatggtggcgcatgcctgtaatcccagctactcaggaggctgaggcaggagaatgagtcaggagttcaagaccagcctggccaacatggggaaaccccatctctactaaaaatacaaaaattagccagtcatggtggcgcacgcctttaatcccagctactcagaaggctgaggcaggagttcaataccagcctggccaacatggccaaaccccatctctactaaaaatataaaaattagccaggcatggtggcgcatgcctgtaatcccagctactcagtaggctgaggcaggagaatcgcttgaacccgggaggcagaggttacagtgagccaagatggccccactgtactccagcttgagtgacaaagtgagattccatctgaaaacaaaaataacaataataataagaagaagaattgcttagcttatcttttagggatagtgggtagaaaataaataggaaaatgttctccaagcacataagaaatagatgattactatcagatttctgggtgaaattgcgacagtaatttcccaagaggaggaaggaacacagatcttcctctttcttaagtcctggccaagtttcaaactcttgagtgggtaaagaggggctatattagttctcctttcatatttctgccctcaaaaacctagagaatctgtggtgactactggaagaaaattcaatttaaaaacatttatttgaggctgggcgcagtggctcatgcctgtaatccaagtactttgggaggctcaggcaggcggatcacctgaggtcaggagttcgagaccagcctggccaacgtggtgaaaccccatctctaccaaaaatacaaaaaaaattagctgggcatggtggcgggcacctgtaatcccagctacttgggaggctgaggcaggagaattgcctgaacgcgggaggtggaggttgcagtgagctgggatcgcgccactgcactgcagcctgggtgacaagagtgaaactccatctcaaaaaaaaaaaacaacaacatttatttgatacttttttgattagtcagggctcttcactgctgatgaatcatgacaaacttaatgaaagagagaactcattggctcatgtaactgaaaaatccaggggcagaaaaccttcaggcgtggttggatccaggtgcttacaagctatctcattaagaacctgtctcgctccctcttttgagtctgtatttcctccctgttggcttttgttgttgttgtggttgttaacttcagttctcctcttgcggaggcaaggtggccactagccactcttgctcatatttgtctggttttaacagctccagaagaaagagaaagccttgctttcctattgttccagcaaattttttgggcctggatcttatttctgcaacttgagcatgtgtccctctctgaaccagtcaccagtgccagggagaaactgggctctgattggataagcccaggagcccaagagccttgtgcccagggatgaggttagccttctacaaataacatggactaagagagggggaatgtggcttcccaaaggaaaaatgtcaggaaggccatttctaaaagaagtagaagaggatgctagacatgcctttcctccttccccccaaaaagacacttaggtccccaatatctactctgtgcgatatattattttgggcattatgggaatgacatgataaacacgacatccctcagaaggcttagactagaatcatgtgattatgcaatcgcatacacatgaatttagtaatgaacaacttagtaagtgctataacagaaataatagttaatagctaatatgtattgaatgctttctagatcctaggtactggtctcagtattttacttggtttaacctatttagtctccaaaagaaccaggaaagtagttgctatctctccattttgcagatgaggacgctgaggcacagagaagttggttgaaagtgcttttggaacacaaagttctagcccatcaggatagtgagatctccatgcagagctactgtgtgaagagaacttaacattttagggtagatttcacccgagagggatagggaaacagtctaaattctaggaagaaggaacaatacatgaaggaatggagctgaagaaccgcagatgtttaggaaatggcaagaagtaaagtttgactttaacaccaggcttgcaaaaaagagatggaaggaaagtgatgggaaaaatggttcgctgggacgggttgtaaagcttggctgccgttccaagtccagctggttccacagactgtagaattctttagtaggggagtggctggagcagataaacaaaaaaatcgccagacccctgagtgtttttaggtggggatgttggctttgtatctctgctgtacattcttgggatgttttggaaggtttttgcaaatgtcctgttgggtggcattgaagcggttgtttctttaaatgacttagctctgccttagtgaagatcttgttaaaagcagaccattttctgacattctgttttctgcaactgctattgaagaggggcaaagccgagccaggctcttgtagaacactttcaacacaagacaagtggttttgtgtgtttctgtcacagttttacagtgaggccattcagtactcagaactgagaagatagcatggcacgcttatttaatagtcttctatttgctcttctattttgtccagtcattaaatggtgttagaattgagaattaggactctctttcctcgccaaagaaaaacacaagtgacttgttgactacaagatttactctcacagatatttccagagtaatatgaaatcccagccaagtatccgcagaaaaaagccagcggcatatgctccagcctcttttcctgagtgcagctccacagctacctctccatgcccagaaggacatcataaatcatttctaatttatgaggagcccagtcgtgtactacaccctgctaggtgctggtgtttgtcgtctacagactgtgagctcccttcttcagtgcatacagagactttttcagatcatccataggacagaaggttgagaatttttttccctaggactggcccagccaagaattaaggagggagaagacagaagattcttgtcgctcagggttttgccacaagcctcacttgctttttcccaaattgaggactgggaaggggcagaaacaataccattctcatgattagctattttcttttattcaacaaatacacatattttttcaaagccaacagcctgcaagtcaacgttggggacacagcagtaagcaaaacagaattttggttctcaatgagattatacttacacatgttaggaggtgacgatgggttttgcagggaaagaagagataaagttgggaaggggaatagccattctacatcaggagttcagggaagggacttccactaaggtgacctttgagcagagacttgtgggacaggatggagtgagtctagcagttgtctggggatatggcctcctgggaaggacagaggccaccatgcagggccccaagaaattgaagccaagagccagaaagaagtggttaggagccaggcacgtgggaggcgggacagcctaaggggctgcggtgagttcagggattgttggaagtaagatgggcagccatgggaagtttttggaagattaccagagtataagcctgaagtcaggaaaatacagggcagtgtttccttcacttcccagagagaattagagtgtgcgctgctgttatcagaattgaactgtcaaaacatcaattagcccaatgcagagtgaaacagaaatcatggctttgtttgatcttggtataaaaaaagctcttatgcttttccagttgggataaaagtgagaggccatgagtcatttatttactcaactggcgataatacttttcatggagacaccttagctactgtattcagctacgacattcagcgacctgtgccccactagcgtcttccctggcagtatcttggttgtgctgtagctgtggtgcatagatttctgtgcatagattggtgtaagcttcaaagtcaaagagcagctggtgggatacttgggatcagattcgagcaggctgcaataacagcaggctctcagtgatgacctggagccgactgctgccgttttctgctcacaaacaactgactttagtccggagctacagagagcttgggttagattgatgcgcagaagttacagggagtgcgatttgactccttctctggaataccttcctcaaaatgagggtgatcgatactgaagtgggttgcgccttaaagtgagcatcttccctctgaatgattttaagcaggtgagcacatctcaggaatattctgagacagcccctgctttgtgcggtgtgttggactagaatgacctctcagattcattgcaatgcaaaccccctctgagcccatgaaaaagtgtccagtgaatgtgctctgcaaacatgcaggcactatataaacaagaggcaaatattttaaaaggtgaagaatgagatacttgtactgctgtgagagcggtggttggaatgttgtgccccagcaacatactttccgtgctcggtcgcctgcagtttgttctcattggccctgtacagaggtatccgcattgtgtgttaaatacgctctcagcgaaagaccaaacaaatagccaacggcattttcctatcagagcctgtttataggaggtagagcaaaagaacaaagctgttggttttgattcttggcaggaagccaaggctgctgcttcaaagctccagagtttacaaggaagaaagagggggaatttttagtttacaaggaagaaagggggaatttttagctgagactaagttagaatttaagcaaaactcaaaactaaaactaaagaatcctccgggatccataatggaaaggcagaataagaaacctggtatgtttcaggctatcggatgattttttagtgcaagaacgaacgttttaaaaggtgcccgagcagagattacagacagcctcgattaatgacacaggatcactcagcatttgagctggatgaattgtccttagtgatccttgaattgtgtcccttattttacagataatggattagaggcccaggaactcaaaatgactgcccagggtcactcaacaagttgtaggaattcaaggactagaatccaggactcctggcagccattttgtgttttgggcaattttaaagaagcagcaaaccagtaaaagttttgtttcttatgagcaaagggccggttaggaagacagccaccgtgattgaatgctgaattggcagtgcatttggtttgcgagaatgtggcccgatccctaggccagcggcacttgctcttgcagttgccaccttcatccttaagtttagggcagaacagccgtgaatctctgggcctgttcccaggaatggaggccaagacaactgttggaggaggtctacagagtcccgccacccctcagagcccagtcaagcatgaatgggcttttacaatccgtaggaggctgcagtggtcaaggtccttctaaagcacctgcaaaatcccagcagtgtcccacctgtcactgtgggtgttctttggcttcctgccgttgataagagttctctcctttttgacaagaggccgaacaaattgaaactgtatttaaataacaacactctttttacataatagaacacccagtttaaaaaaaaaaaaaagactctttgcccggttaacttttttcattgaaattactaacctttaagtgagctgttgttacttgcttctggaagatacaggaagaatggggtcagtgaggaatctaaaggaagggagggaagccttctgtgtatgtctcctttttaacccaaagctgttcgttgtcattcttttgaccatttattcattcattcactcattttcctgtttgtttctattctgattctatccaaaaaaagtttgacaaaatgtgcagtaaagagcttatatattgtacataaaatataagtcaagtcaggttttagagaaggaggaaacagagattccatccacgaattgtcatatgaaatctgtgtcaaatatccagttttactctgatctttctagcaaccaggatttaaaaaggaatacacaatttctattatcagaaaggaaaaaaaaatccaggttcttcaagagactaagcgttgctattctgtggcacatgcaattagcaaacacttaaggaagactttcatgcacttactacaaagctggctgcccagggcgcatcctcccaccctgtctcctatcagtgtccttgcttgaggccctggagcccctgagcaaacatgttcttagtgttatcacaaatgtcttcttagtgttatcacctgctccctttggatgtgtcagaacctggtttggggtaatggctttagtttagttgaaacgatgttgtctagagcagttccaggatttgcagataatgagcccaggagtaggaatcggggaacgtcagaaatctcgtgctactgcagctgcatgttgtctaccagtgtagctttcctgctcttcaaagtgccctagactccttatctggcccttcgctgctgtatcaaagtgcatttttgaacagaaggtctggaggaaatagagttctgcagaacacgctttgggaaatgttgactcaggattaatagatgacatgaccacatgttaattttacgcaccttcttggcccctgaaagtgaggaatggactttgcagttgcatggacatatagagcacaggatttaatactatacacactcaaggggaacacaattgagatcctgctccggagctcccaagccccattccaaagttctaccaggcatttacatttgttccagaagaaggaagaatcaatgttaagatccccatggctttacatgtctgtgaaaactgattattattatttttttttttctgagatggagtttcgctcttgtcgcccaggctggagtgcaatggcacgatcttggctcactgcaacttcagcctcctgggttcaggcgattttcctgcctcagcctcccaaatagctggggttacaggtgcccaccaccatgaccagctaatttttgtatttttcggagatggggttttgccatgttggccaggctggtctcaaactcctgacctcaggtgatccacccacctcggcccccgccaaagtgctaggattacaggcatgagccaccgttcctggctgaaagctgattattcttaactgccttctccatcctcctaagacctggggattgtcagctaatatataagaactctctagaattagtgagaacgcaggggaaagagttatagaaatatgatgtgttgggcttttgtaatagatggagtgagagagaaaacactagaaaatagttcattttcctggaatgcaaatgggttacccagaatatttactgatgtttatgtgtttttttctttaatgtaagcatacatatcttcttcatacactgcatatccatagaattatatgttttagaatgcaacatttctagcttcagcgtgagaagcaggctttatgctctctagttgctatgtaataatatgcctggacgccaggccaaaggtggccatttgaaagaccagggatggcggttggacttcagatcatgggctgcagccatttgctcttgtcatagctgtgttgattccactcagatcatgtgttttttttaagcaactaagaaaacgagtttgagccctcatgtgaggagaataaatgtgctcaattctacttggaatgtttttcataattatcttaaggaatgacttgattcttacttgtgcttgttctttttaaaagtattagaaaggaagatatccacacgacaaagtagagaggagctgataagaaggggagtgcttaaggaattgcctgatcaaggtgaggaaattaatcatacattttaaatattttggtccttcattctttggtttttcttttgttttcttttgaaatttaaagggatcatggtctttgtaaggtaaagcggtgattactgcattccaagcgccgtgcttccattggtaatgcctttgtgagctgcagagaatctgaaatattatagaattctagtgactttcctggtgaatccatcaccatatgtcattctaaacctaaaactctgcaaaggtacatccgagggcaatacagatgagatacaaatgcttacggctccttctcttctctattcttgagcttcagtctttctattcacatgaaactcatgtgtttgagtaaatgcaaagttttagcttggttcatgctattttgtttcttaagactaccaataaaagagaagagagaaggcacacatacctcttgtcctttgcactctataataacactgaaatgtacaatcaataaagcatgaataggcaaactaaactaacctgctttctgctttctctcatgtaattttgcagtactgttctcttttcatttctctgaatctttccctagcaatgattatttctaattttttcccctatctctgatcttctctttttttctctatcctcccgaggaggaactttgttcagaaaagacaaggatcagatagaaactggtactgaccctcaaaagaagacgctaacattggttatttctccaaataaataatacctaatgattttcatcgcttccactattaaatttaaaattaaaggacattttgttgcaattttgttgattaagctcatgcctcccttcccctcacatttactgtaataataaagtattattattgtacttttatgggaacaaataaaatgctattaatttagaattgaaattgaaattgaaataataatacagctgttttcctgatatatgttccttgcaaaggacttaacattttttggcattcactatttgtaaatcaaaatgacatgcttttttccagcatctgaataattccagagtggagctgagaaatgctttcctgtttttctcctgattcaaagaaagtagggaactctgcagtgaatagtagcattttcttaagccctcgcaattttaggtattttacttcaatttctgacctgtcaaacttttcttactctactttatgaatgaattttatgttttccctgtttttctattattttgaagctatttatttcctgtttgagacttttaagagttaaaaatgcacatttctaactttttaaacttaaaggtaggcttgcaatatcaaaattaatcccctgtccaatgtctctgaaggcaatagagaaataatatacccattgaaagcttaacactgggccatcagctttatgggatgggccaatgcatttattagacatcgtttatttagaaatattttaaagaaagtacaaaatggaaaattttatgattgaaactgttaatgggtttaaatgtgaagattaaaagcccatctttttttcctaattaaaatttgtaggtagaaaaagaatttgctctgtctgaaaaccaagtagcaatagtcaatttaaagaaatgatttttattctgccgaatctgtgaaactatttgcctcatagattataatttcttgggccaacatatacttctcagaaatctgactctctgatctttttatttaacttttccagtggaaactaaaagttttaaaacataaaagaacaaaacaattttttaacctaagcataatataataataggcttaatgtttgagaagtcataaaatactagattttactttccagcttttccatggtccctatctagaaccgtagaaattatctaatggttgaaggttcctgaggatgtcagtagtaaatggagtccttccccttttcagctgagggctggagaaaatagttttctgtgattttcccaaaagcaattatctggagaatttcagtctgagagactagaagctgctgttcttggtaacaacctcctttctgctgccagtgaagattcattgtttgccttgatcttcttgaccttgcgtctgctcttgacagtgcctgtccatcaagccctttattcagtgagccagatagactttaaaaatccctctagctaccctgagtctgaccccatcccaccatatcccatactctcccggctattgttatttttccttttaggttctcttatttacatccagacataccttcaacctaaaagttcagtgattcgtcttctctcctgggaagtctatgatctagtccaagtttgctgcttacctctgcttttttccctccatcttttcccttagcttttgacatgaggttgtggaggtggttttgcctgtgtgccatcctttccttttctcccactgtggacttttgtcacttgccttttggtcatacatgattttctctttctatctgtccctcctttaactatgatatatccccaatacacctgtttactagaaggaggtgacccccttcaaacaccctcgtgttccttatttaaccacttgttcctgtttgtgctttatctctgttttctttaagctgacaactacgttttgagttttctctttcctttgctctcgtgagatgtgttgacttgggccgcttattgtcacctgccatccagctcagcatcttcttgccttcctttgctctgcttgtattttacttacacacacacacacacacacacacacacacacactatatcaaggatttaacttattttaattctaaaacaacttccttaacactcaatactagaaagccttttcaatatacacaccagctaattaataactttacttcccctctgttttgttcttgaattccatatttatcacaaatgtgtctcttttttctacaattattttcatactaactagctttatttcatgcctcaaagtaagtattttccacattgttgactatttctctctatcataggataagacactttcttcttgtgtcacagctattaaaatttccaggtttttctaaatttaataaatcagttatttaactaaagaattttaatataataatgcttaaaatagaattaaattgtcattgacatgacttcaatatacttttattatcaactaactaaagtcaaagaaaacaaagataaatttatatttgagttacctaaaaactgaagatttttatacataagcaagtggttttctattttgtttggaattttccattcttcatttttattttatctggatatattgtgttctcctcctttttatagctaatttcttgggatttaataataggatttaagaatcatttgggttctctttgttttgatgtatagtcttttaaaaattcttactttaattttattaaaatagttgagatttacttgtaatggcattgccttcaattattgtttattttagttttacacgggacttagttataggttattgggagttatatgactaagcaacgattgctttttcattctaaaaatgacataatttcatgatatgtagttgatttattaaaatgtcatgtctgtttgttcagaaggcaaatggattttattgttaagccaaagcaattcaatcctatttaatgacaatttgggaaatggtttctgttttataatgattgccaagataagagtagtaaaaaattgaaagagctgtaatcaagcagatttttaagtttgctcaaaccttccatttgttaatttttcttttacaatgctagcaaagcctcttaaaattttccagatataaagtagggttaatcttttcaagaatcactgaattaaatgtttctgcaaagtctctttcactttagaaacccccaggaattatggaaatacaggagttaaaattagtaatttatgatttagatctctcaacattgtatccattatggttttttaaaattcctttgtgattacttttttatgtgtgttttttttttctcgaatgttttcaaattatttttaggacaacttagggactttttggctagttatatataataattacctgagtatactttaatctttccataaacaaataaaaataaaaatagccttgctatcatgttttccctgaacatagagtagcagttatattactgtgtgaagttagcacatcatatacttaatatattctggaaccagtagtacttggaaattttcatattctcccacttattgtttgtatgtgtaattacatttcatgttatttgtgtatttgcattcaccttgtgtttttggtgcttgtaaaatgtttattccattttccagattattcctctcgccattctgtttctgaatgacaaagaaacacataactattgacttcagacaaacctaagcacatgaacgagggactctgctgccctgggatattggataattaggatgatcattcctgttgtcttgaaatggcgcatagatattccctccatagcagcttttccccaagacagaggattttctagctcttttgttttgaataaaccggtgaaacagtgcagggtgtatttggttcccagggactgaaacatgaatctaaattttacaatcctagtaactggaaaacttgtttttaagaaagccagcaagttagacatctaggtgtttctttcccattttagatggagatgtaacagttaactttgaaaattcaaacgggcacatgatacccatcggagaggaatctacccgagaggaaaatgtagtaaagtctgaagaaggtaatggctctgtatctgaaaaaacaccacctctggaggaacaggcagaagataagaaaggtaaaataaagacaaacccatattatttactttagtatatagctcaatgtctagaaccagcacttaggctccaactagtgactctaaaaccagcagtctgcagaggagaggtttacaaatagaaaaaagaaagaaatgataactagtaaagtgaaatcggatgattttctcaggtagatgcatccattttataagcacagtatttgttttttcaattattaaaaatgttaattaaaagtaataatcagaaggggtggcctctttaatcattagagatgtctgggaagattatcctttcttaggagctttgtctcaggatcataatgaaagtgagaaatctgaacatctttctctgctggttacaattggacccgtgagcagttcagcatggaggaatatcaaaacccacatggcttgttcagcccagcactgtctccagcagtgggaacttggcaggtggcatccacatatccagcatcataggttccagacgtttctgagagagacccaggaatagctcccagagatgccacggactgtggttgctctgctggctgattcccacagcctctgtgcaattggaaacttcaaaatgtgccagaggcgattatgctattcccagaagacttctttagagaccttggttcctagagtgaatatgctacagtagattgagatacctgcaaaatacatgtctatcagggactcccagaacattcacaaattcctagttatggattgatgacatctcgataccactgctgtgatgcgtaggaacctccaaacatgaaatgaaacttctaaaaggaaaggttttgtggggagattctagatgcctccatgcagcatagaaaggaatctttaggaaatatactatttcctattttataatgtctgtctctaagttgaatggtaaaattttgtcaaacctagtgtgtgttctgtgggcattttgaactcttagaaactgatgaaagtgaattctcttcctctgttcttgacccagatccttgagagcgaaagggaaaaaagattatttgatggccctattaaacacaccattgtaacttaaaatcatcctctgtggaagttcataaccgttcattatttgcatatatattagcctttaaaagttttagaagcctgtgtaaataatctgttggaaatgtattattttgctttatttcaagggctttatctagccttgttccattgaaggactctggttaagcttatgtacacaaattatgaaattaactaatactttcaatgataatattcctggaacataaaaagaaagtagacttaaataaattttagtgggattcagttgaaagtattaacgcaagtagtgatgttttttgtttaagtctttctgtcctgtctcgccagactgttgaatttcaaatccatctgtggtttgtccctggcagccttctcacatccaagaatcgcatcctgcattacgtaacagtgccatctctggtgcctggtccgtgcagggtattcgtcactggactggccagacatcaaaggaagtgtttcccttatcaacataataaaaagttcctgacagttttatatgaattaaccaacagaccttgatgttcttgaaagaagatagcagaccttatgggtccatgaatagttgagagatgtttttctttgcttagaattagtacattcaattcttccttatctgataaggtccaagagagcctgttgcttggctagtaggtacatgaggaaggagctgggagtgctggatgctgacataccactaaagaggcagtgcggctgtctcctgtgtggaaagtgcacacaccaaagccacaaggagaagcgctaggtatagaagccacttcgtgagactgaaaagaatgtcacgcataactaatattacagtgtattatgttaattagaaaatgccttatgacaaaggtaacaatttatttctctagaaaaacatttttcattctgaagaccaactcaagcttcacttttgcctctgctcctcttctggtctcactgcttgtgtgagctcactgccgtgcaaaccccaccatcccatgatcttaattcaccctttattttgggatacagtgctccctttcctcctgcatgaagccaacttattcaagagcattctgtcatctatttggttatatttgccaaaccatatcatctgcctttagagccctagatgtgtattatatctcttcataagacaatatctcaatactttaatatttgaaacatcaccgtcaaagaaagcaaaacaaatggcacgtggtgtccttcacacttgctctgtgagtagattccacccaggccccctgggcatttctggggctcctgaaggcacctgattctgcagttggtacagtggtcttgggcctcctctgcctaatactagagacttcttccttaaggtctttggggctcttggtctcccattattctttctcagtaagtgcctttatatatataagagcagaaaaggccgggcgccgtggctcacgcctgtaatcccagcactttgggaggccgaggcgggcggatcacgaggtcaggagatcgagaccatcctggctaacacggtgaaaccccgtctctactaaaaatacaaaaaaaaaattagccgggcgtggtggcgggcgcctgtagtcccagctactcgggaggctgaggcaggagaatggcgtgaacccgggaggcggagcttgcagtgagccgagatcgcaccactgcactccagcctgggcgacagagcgagactccgtctcaaaaaaaaaaaaaaaaagagcagaaaaactcacttgctccctgttaaacaaagcttagtattaaatataagaaatcttatggctcacgcctgtaatctcagcactttgagaggccaaggcgggcagatcagctgaggtcaggagttcgataccagcctggccaacagggcaaagccccatctctactaaaaatacaaaaatagctgggtgtggtggtgggcacctgtaatcccagctactgggaagctgaggcagggagaattgcttgaacctgggaggtggaggttgtagtgagctgagttcaggcaccattgcactccagcctgggtgacagccagtctcaaaaaaagaaaataataataattttaaataataagattttataagaattctaagaaatcttgcttgacattatttttattaagttattattttaaaatcttcaatgaaataacaagtgatgaacacttatttgttccacaaataatgaaagtctaccataggtgagactctactaggggccaggaaaagagtagtaaatgaaaaatggcctttgccttaagagcatgacctgtgaggagaccagaatgcaaacgggcaattgtagtgcaagatgcgaagtaccgtagaaggcctgagcacagcaacccaagggagctcacagtgagggccaacattggttctcagaggaagatatttatgaactaagacatgaaggaaacaagaaggaggtcatcaagtgaagcagaggaattgggtaagaattgcattctaggcagggtgaggaccacatgcagccccaggcttgttctaagtatcgttgacctcaaaccttccagggctcaaaggagccaagcctggaagtatgggaaacagcttgttttccagaccgcattgctggaaaggctagcgtccttatcaagccagaatgacgaggcagccctttctcaaccttctcttgaagtgataatactcctatatgccatcagtttatatcatgtcttcagatcacatggtaagtgtaaaatatacaacttgacataattcattacctcccagctccaactaaagctctgttttctactgatgtgtgtgtcaataactattagacagtcagtcccattcgttgaatagacatagtgtttacagcattgtgttcgatggaattttaaatttcagacaaaaggagtttataattcagtcaaaaaattatactatttgcatactcatatgtccctgcgtgtgtgtgcatgcacacgtgcgcgcacacacacacacacacacacacacataacttaagaattaccagaatgacaaatgttcacacatagttggtagcgttcgaagagtcaagaggagcggacgtattctctaaggagccaggagaaagtctgtttgcagtgtgttcattttctccctagtaggtcttgtcattgccaaccaatctggtgaactatctcctccttcccaaacccagaagctggattctttccggtatacctttagaattttaagccttaggcagaaaggaaaaacatccctcagtgacatgctattaagggagaggataaaacatgtgtagagtttgtggtatataagagaattaaggtgacatgtgttacagatcagtttgactttcactatggatgacactattgggcttagtctccatacttcatggtattatactgggggctaaagttacaaagatgtatttaaagaatagacttcaaccatatgtcagaagactgggaaattaatgtatatttatatattttaagttaaaattaaattttataggtgtgtatcaacttgtatcattctcaaacctaactgacttttgtgatttacttgcctggttaagactggctgagttaagagggccattactattagtatacatgatactcagcttagttgaggagacaagatatataaacagaaaggcaaaaatacaaaatagcttctgataaatgttgagtaagtggctcacacaataagcccaagtaagttcagagatagaagggtcaacttgggccacagtgacagaagaggattttgtggctgaggcaggatcaaaggtgaactttaaaagtaaagctttattgattacctattgtaactgaagtcatctatgctaattatatatgtggattgatggggaatgtggttaaaagagaattctatacttcacactcattaggataagaaacaaaataatataaataataataaaatgcagtatattccaatattaaaaccctttctagagcattcaattatgggagccttggttaaggctcgatcttgtcttaacactgtctcaaggtttttattgtgccccatttttaaagaaatgctgcttagctttttggactagaatggtattttagtttaattctcatcagccactattagaaagaatacagatgtgaatatatgaatgaactttcagcatctcatctgtctttcagtaacaagagactaatactctttctcctccggttacacaaaaccttgtgagaagctgctattcttaggtatgagttttggatgaattttagcctttgtctttccaaaataattatttggtttacattacaaaatagacctaagtatttcttcgattcggcaccatctagatgtacctatagttgtgacagtatttgaaaaggccaggcatggtggctcatgcctgtaatcccggcactttgggaggccaaggcaggcaaattgcttgagcccaggagttcaagaccagcctgggcaatgtggcaaaaccccatctctacaaaacattcaaaaattagctgggcgtggtggcaaacacctgtggtctcagctacacaggaggctgaggttagaggctgcagtgagccgtgatcataccactgcactctagcctgagtgagagagcgagaccctatctgaaaaaaaaaaaaaattttttttttaagattttctttcatgcacacacatacaaaaaaaaaaaaagaaaagaaaaggaaggaaggaaagggcagaggaagttattttagaacaggaagctgccaatgtactgggaaagctttagaaaattttgctagtagaagatgattcattctaaagcgcattgttgcctcatgtaaaagattctccagagtctctcttagcttacaaaataattgggttttgatcacagcgaggctgaacacagatccctttcagatggatcaggcttgagttctcaagggtaaccatgagtccagcagttgctgtagctgtcattcctcaccccacagcagtgactgtaacgtgttcatctgccactctccaggagccttcaactttgttaaatcattgtttgttcaatttaaatgtagcacttcatgcccacatcatcatccagcaaccccagatccaaggctggaactgaggcccctgactgcaaacatttacacacatcctcaacctaatttcgtcaaagtagtttgtataacccggttttattaaagggtgattcgtgtaccctgagaacacttctcagtttgtctttcagcctttgttttcaccctaaactgtgctctgtctggtgcagaactccatgctgattctcaagtaccaagcagacacgctttgtgtcactatcgtcatgtcttgctccttgtgtttatatggtgtgtgtctgtatcagtctgcttctgttcactttctcgtttatagagaacactgaaaaccactctgaaacaccggcagctcctgctctacctccttctgctcctcctaagcctagacccaaacctaaacccaaaaaatcacctgtgcctccgaaaggggccactgctggggccagccacaaaggtgatgaagtgcctcccattaaaaaaaataccaaggctcctggtaagcaggcccccgtccctccacccaagccagcaagccgaaacacgacccgagaggctggtgagtatgcccccagtgccctgtggggtcacttctagggtgcttggctctgggatggggctaattgtttcttctaggtgtgatgggcttttggtgtcttaggacattacaccagcaggttcagctttgacacaaagaatgcccaggagattcctttgttgctctctaccaaaggaaattcaacccattgaatagttcacctcattagtttttgagtgaatatactggtttcatcttgagtatccactatcagcaccagttgaaggatactgggagtagtatgcctgatgaatgacaatgatctgatataacattatttagacattgactgaccttctacctatatgagcctatgggtggctttttggcttggattttctttcaaaatatctaaggtttgcatataaaaatgtgacaattataactttgatatatttactggatgttaatgtgttaaatcctcagcatccatagtcatctcccttctgataaatgacaaagggttcatgtcacttgtttcagctccaccccaccactttctactgcagtgaaaactatttcagtggagtggaaagttacactctcagtgttccacacctcccctgtagacttgtgtgttctaaggcaaaacatcctggtgtcatgtggttataagttactattataaatcaccagtggatgtttgagtgacctgcaataactcatgcaatatgtatccagctttgctttacaatcagatatgcttgatgcaaagtggaaactcccatttttttagtgaagaggaagaaagatgcctaccatgtcatttatcttttaaaaggacattaatcaggccaggcccagtggctcacacccgtaatcccagcactttgggaggctgatgcggatcgatcacttgaggtcaggagttcgagaccaacctggtcaacatggtgaaaccctgtctctgctaaaaatacaagaattagccaggcgtcgtggcgtgcacctctaatcccagctactcaggaggctgaggcaggaaaatcgcttgaacccaggaggcagaagttgcggtgagctgagatcgcgccactgcactccagcctgggcgacagaatgagactccatctcaaaaaaaaaaaatctattttccttaaaatcaacagcaactttctagcagttgactgtcaggatttgccttggtgttgatctttttcctctcataatgtatgaccataatgctcaaattcagagagcggtttagttgacagtataacagatctctgaatgccaatagacatccctctccctgtgctcctcatgtcccgcctttgacctttagtgtctgggtctcttctaataagctctaaactgaaatttcccagaatgatgtgccaacagtgcccagtggccatctcctcagggagcagctgtcctcacccatcagtgtccattcttgttgggatctgtgtgtgttttctagacttcctagaaaaccctagaagcactgcttaaagtgagggaggcactgatcttcttcttaaagaacagccccaaatgatcactctgtcattgggaattaagctcctgtcttgcactaacttctccactttcccattctccacgtggtagtggctcactctgaactcagcttggactctctttacttccctcagaagaaagccgatgattaacaccaggtcaggggacagctttcataaacgattttgaggtttttccagatattttgcttgaagatttatttaggcactcatgatgctcctaagagaatagtacagtcattttattcattgtattgtaaaaggcctgacttttccagaggctatcacagagaaaacaggggttgcacttaagtacaccaacaagcccatcatgtaagaatcgttttatcaaatattgataatatccctttatgatcctactgatagtccatttgtaaccgtttagaactttctgcatagtaactttgttttatttgaataatatggaccttctagaaaagtttgttcaaatgctactcttgatgttcagcccagtgatttaagttgttaaaacaaccataagttaagattctttctctattactaagttagtgtagacctgtagctacctaggtatcggttttagaacattcagcttctttgccagagaaatcgggttaaatctccttgatttttgtttctcattgttacacattattaacaacaaaagtacttaactgaggagaggcgacatttttttttatcatgcccttaattgaaggtaacttaagcaacatgtttgatttcaacaaagacctgttatttaagaagattctttaagaaaaactataatgtggcttgaatttgcactctgggcagtgaaaaaaaatgtatctttttcctcaagccaaactaaaattaacttttctgttaatgatgaaagaattttattggccaggcattgtgactcacacctgtaatcccagcactttgggaggccgaggcaggtggatcacctgaggtcaagagttcgagaccagcctgtacaacatggtgaaaccccatctctactaaaaatacaaaaattacccaggcgtggtggtgggcacctgtaatcccaactatttgggagactgaggcaggagaatcacttgaacccgggaggcagaggttgcagtgagccaagattgtgccactgcactccagtctgggtgacagagggagactctgtctcaaaaaaaacaaaaaaaaagaattttctttaacaaattattagaattgttatgtggaaaggattctgtttaacttagctaagaaaataattgaacatggttaggcaccgaatccttagcgtctttgttgtgaaaagtaaatgtagactggacttagattgaaggagtgtgcttaatgagtttgacttctaggctagggaaggttgttttctataaagtaacaggtctagatttggggaagaagaattctagttatgtatatcttaaacgataaagaccccaaaaccatagggattccttttaagcctggaacctgtcactaaataagactggcttctttagtatcagtctaatcagaataaatgaagtcttacatctcattgtctattctttcatttattcttcatctcttcaccctcccaattgacttcaataaagtcataactggaggtaagttataataacatctgtatacagtgtggattggcttcacaatgctaacaagatgttttctaatcgttctgtgaaagatagttgaacccttcatgaagagaaggagcataacaacattataacagaagaagccattaggataaatttataggtcatgaaagaaaagagtattctcataggagtttattttatcatcatatatttactaagatgacataaagaaaaaagtagttaatctttttgttttgaaactgttttgattgagggtgccctatccggaagtaggcaaatataccatagctatccttcgatgaagaccttcttggaacttaagcattaaggaagatcacatttgcgaaggtggagtcagaagacctgagaatgatatcctttccattcacattatttagaaccagacacggtggctcacacctgtaattctttggagccaccaaagcctctcactttgggaggctgagatgggtgaatcccttgagcccaggagttcaagaccagcctgggcaacatgacaaaaccctgtctcaacaaaaatacattaaagttagccaggcatggtggtacacacctgtagtcccagctactcaggaggctaaggcaggaggatcacttgagcccaggaggcagaagttatagtgagccgatattgcaccactgcattccagcctgggcgacagaacaagaccttgtctcaaaaaaaaaaaaaaaaaggagcaacccatgtaaataggttttgtaaacaacaagtttttttctggccttttgatgctttgaagggagtgtacctttcctgtgtggccatgggttttccctttaccccatctctactgcagatggaagtagagtccagcatggcgagctttcttctctggagctactggaaagctggtgtggattttctcttttagcagtaagatgagtgattttgtttttgacccagaaagaagctggatatataccccagtctcttctgaatacaggccaccactctattcctagaaagacagcatagaacatgtataatttatgatgagcctaattgtgtgctacacccagctagctgctgatgtctgtcctttacgcaccataacattccttcttgagagcataccgggcttttttcaagtgaaccatagacaaggggcagaagattctccctttggctggctcagctaaagactaaagtgagagaagacagaggactcttgttcctctgagttttgccgtaaatatcacttgctccttgctggattggaggaagggaggggcagaagacaagactattatcatgattagcctattttctcttatacatttattcaacaaactttaaagggaacattttaaatgttgttgacagttacaccttggttactttattttaaaaagcattgtattctttgattttttaatgcaaggtctctctattgtagctggctcctctcattcaaaaaaaacaactggctctaaagcatcagcttcgccatccacttcatccacctcatctcgtcccaaagcttcaaaggagacagtttctagcaaagcagggacagtggggaccaccaagggcaagagaaaaactgacaagcagccaataacttctcacctgtcctcagacacaacaacttctggcacatccgacctgaaaggagagcctgcagagaccagagtggagagtttcaaactcgaacagactgtccctggagctgaggagcagaacacaggcaaattcaagtccatggtccctccaccccctgtggctccagcaccttctcctctggccccccctctccctcttgaggatcagtgcattactgcctcagacactccagttgtcctcgtcagcgttggagctgacctgcccgtctctgccttagacccaagtcagcttctttgggctgaagagccgacgaacagaaccactctctactcaggcactggcttaagtgttaacagagaaaatgcaaaatggtgagttggggaacaaaccccctattttatctgagaactaaagatcactaatatattctgttggaaatgaagcaccgggtttgctttcttatataatttaatctactgagtgttaggtaggcatacatgtgatccaaccattgctttgtcagagccctgccctgggaatgcctagggctgctggagaaaattacattggtagagctgacaaataccacttgagatcaatgttttcaagtacacttagaacctgcttcagcactgctcagcagtccacagttcccttctctttcctttcagtgcttattttaaatctttactttaccattgtgcttacctactcatgtcagcaagttactgagccttccccttcaccaagaacataaagaagatcagaagagaactctcaaatttgaactcttttttctccatcagtagagttgtcccctttcttgttcctttaaattcccacccagcttaaatgttatgtcctctgtgaagccattcagtacttctagacagaattggttattgtgtctactatacttaaccctgtgggacagaattagccaacatgtcttacataagacacctctgtgtgcccagcaaccactccagagtctgatatgccataggcacacaaaggatgctcattgaattgttgaaagaaaataaaaaagggatttaagatggttatagataaagtcagcctactttaacattgcggaagcagcattgaagataagatgaccctattgctagattttgtagagtataatggaagataaaagatagtgctcaagtagtcttagtttcatttaagaaggtacctgaacaaaatgggccaaggaactcaatgttacctcaccctcatccagttggtgggttagttgctttaccaccacccagttgcccaagctggaaacctggggttcatccaagggtcctcattctctttcattctttgcatttcatcactcacaaagtcctataaatattctacttacaggtaaataaaacatattagccctgtctcacgagtatgaagggatggatggctgtcagagtatagtagacgcaatgataaattctgtctggcaaaggcttagagctcttgcatcctggctttttgctcctgagtctaagaacaaaacctgtattcattgttcaaatcatgtaaaaggttctctttcaaaacaatctgtcatgttagacttaaaaaaaattattacattaattaggttggttttggtcaagaaactaaaatatcaactttaattctttaattgctaatgataataacctttatttattgaatactcatttagtgtcaggaactaagcactgtacatgtattatcattttatttacacaagtcttcccaaaagtatccctgttttatagataagaaaactggcactgagagagctaaaatagtttgcaccagactgcccagttggtggtggtgaagccagaatgcatacccaattccatgctctgaatgaataatttcatgttttccaaagcagtggcttctacttctactgccatttctcttctgttagtttctttgggtttttttaagtcattttgagcaccaatatttgaaggacagccaagaaaaaataaatgtcaaattacaaattaatttattttctttgtttgacattttaataaaagatatgggaaaagaagatttattgaaatgaacggttatggtgtctttcttaggacattttgtgctgctgtaatagagtacctgagactgggtaatttataatgattagaatattggcttacagtcctaggggctgagaagtccaagatcaaggcagcagcatttggcaaggatcttctttccatgtcatcacatggtggaaggtggaagggcagagagcacaacagagtgaacctacccctgtgagcccttttgaaaatggcattaatctattcacgagggcagagccttcatgacttaaacacctcccactaggccctacctctcaacactttcacactgaggatgaaggtttttgttttgttttgttttgttttttgagacagaatcttgcactgtcacccaggctggagtacagtggcatgatctcggctcacctcaacctctgcctcccaggttcaagcaattctcctgcctcagcctccccagtaactggaactacgggtgcctgccaccacgcctggctaatttttgtatttttagtagagatggggtttcaccatataggccaagctggtcttgaactcttgaccttgtgatccgcctgcctcagccttccaaagtgctgggactacaggcgtgagccaccatacccagctaggattaaattttaacccatgaattctgagggacacattcaaaccctaggagcattcttaatacttccagcacacagcaaatgtcttcatttaactatagtgagtattttccaacattgccatcacttccaaccattagaactgaacattcattcttacagcatatattttttgattgccttttctgtgctgggcaatgtactaagcaccaaggatacaaaagtgagcaaggcaatatagttaagactagcttttaccaaaatattgtctgatgtgcccaggaagtataatgtttaaggtaacatctgaattttgggaactagattgggtatacgggattattgttcaatatactaaagaataaggtgcaacatgtaaagtgtttcctgatatagtcttaaacactcagagagctcatatccaaaggtggcctgactctatcccgttcatttccacaaatatttaaggagttcattttattgtgctaaacaacacacaacatactaagggcttaatatcagtcttcatctcaagtatatgaagaactgtcagaccaaagaggtaagcatctgttcttcattcctactgggactataatcagagggagtgagcttagtacatcattagccattgaggctatttataatagatattcctgtccatcaaggtagttataatgctttcctagaagaggccatagggattttcttctctgtatattcttcaaaatttaaatttcagttcatcctacagggatggtttgtgtttgctcttgaattaatgaacctggagtaagtagtctctcaaatttccttccaaattccttctgcctttttcaagtggatatttggattagaatatctggctcttagtcactttctttacttagaactttccttctgagttatgtttcatcaactaatgtgtgaaaatcttgtcattttatgaagagacttctgtttggaatacaaatatcaaaactttcaagaagacaagtggctatgtataaaaatacctacctctcttcccatatggcagggtactaattatttggtaggcttccattcatgggcagcttcatcagtaacacatatgtgtgatacaatataaggtgaaaactaataagcccatttggaggccatatccaaaaggctactttgtacagttcattttcacaaacatgtatagaatgcactatattgtccagtgtgcccaggaacccgagggggaaaaatgaggggtaagtcatgagttgattaatacaaatttggaatatatttaacatcagatataatttataacataactcattaagtgtaaaatataatagtataataaatgtaaaatttaataggtagaccgagtcttcagtctggattctagacaagacttgctaccttggttaggcaactcactcatggtcttctttgattccatgaactataagttatctgccctccttatacaatagaatacttgtaaattgtagatgtatgctggactctttgaaaaccatgaaacaaaatacaaatagtaagattagaataataatcaatatgataattaattagtgaacaatgacaccaacaaataaaggactcatctctcaaatttgttctgttattcagaacatattattaattggcatgtattttaaacattctgtgatcacccataatggcagccaattcaaacaagaatggcttccagtggcaatcaactaaaaacccagactgtggaaaatttttcctataaaaatagatcttctcttatttaagatgagatttcacactgtggaaaacagtatggtggttcttcaaaaaattaaacatagaattaccatgtgatccagcaattctacttccatgtatatagccaaaataattgaaagcaggcacttgaatttgtacaccagtgctcaaagcagtattattcacaatagccaaaaggtgaaaacatacagatgtgtattgattggtgaatggataaacaaaatgtgttatatacatagagtggaatatcattcagccttaaaaaggaagcagattctcacacatgctacgacatgaatgaaggaaccttgaagacattatgctaagtgaagtatgttacatacaaaaagacaaacattgtataatttctcttagagaaggtgcttagaatagtcaaattatagagacaaaaagtagaatggtagttgccaatggctgggagataatggttatggggagttgtttaatgggtagagtttcaatttgggaagacgaaaaagttctgaagatggttggtggtggtagttacacggtaatgtgaatgtgtctaatgccagtgaactgtacacttaaaactggttaaaatggcaaattttatgttatgtatattttacacaataaaaatgagatttcctatttccctgtttgagaacaagaatatagtctgttgggtttttctgataagtgagaaacaaaattttgacagtgatcactcaggtttataactatgaagtagggttttaaatacctcatattctgataaagtttatctgtgtttattgctggaagaactttttaccagaaagcaatttgggggatctttgtgtcttaaaatgaagattacattatttttgatgtgatgtttttatgtaaattactatgtattttttagtctagtctttgaaaattggcaatctttgtacattaatagtaactctttaaatcatagacttttactaggctaaataatagaaaattattgcttccttgcatatcaccttttttctttctttctttcttttttttttttttttgagatggagtctcgctctgtcacccaggctagagtcatattaccttttttctaaaaagtgtatttaacttgcacattgtctgttatgttacaagaggcagttttaaaaatgaaaacacacataggataaatgagtttttactatttacatattgggataaaagcaggattaattcatatatgtactttacatatatatatatgtatatatatatatgtatatatatatatatgtatatatatatatatgtgtgtatatatatatatatatatatatatatatatatatatatatgcttttttttatttttttgagacagggtctcactctgttacccaggctggagtacagtggtgctagcatggctcactgcagtctcgatttcccaggctcaagcaatccttcccaggctcaagctgggactacaggcaagcgccaccatgcccagctaattttttattattttattttattttattttatttatgtatttatttaatttatttatttttgagacggagttttgctcttgttgcccaggctggagtgcaatggcgcgatcttggctcactgcaacctccacctcccgggttcaagcgattctcctgcctcagcctcccgagtagttgggactacaggtgccggccaccactgctggctaatattttgtatttttagtggagacaaggtcccctatgttgcccaggctggtcttgaactcctaggctcaagtgattctcccacttcagccttccaaagtgctggagttacaggtgtgagccaccgaacccagccatatattaatgaaagaagatgtacttttctacgtcattaccttctgggtgctgtgatgcaaaacaatgagtctcacttttccaggaacttgtgggattgagaaggcagagaagcaatgggtggtcaagatgtagtatgctaagcactctagcgggatcgtcttcaggtccccatgggacagacgtgggggcaaggaattaaactgaaggtccatgaaagcttcctgaaggagctgaggctgtagctgacacttgaaggaaaaaataatttgcaaaatgtagttttaccctatttgtttgctaaatgtatcagataccaagcgtttgcattttacagatgaaaaatgtaaaaccttgagaattaaggtttcatttcagtgactttagcctggcctatgtcaagtgtctgctttcctcagcctgaaggaagcccatgaaactagagctctttttcttagtgtcagtgccgccaagggttgctctgagcttcacatcactcccatgcttttctgcctttaacagtttcacaaccaaagaggagctggggaagacagtgcctcagctactgactcctgggctgatgggcgaatcttcagaatcctttagtgcctcagaagatgaaggccacagggaataccaagccaatgactctgactcggacgggcctatcttgtacaccgatgatgaggacgaagacgaagatgaggatggcagtggagaaagtaagactgttttcaagaggcagggaggagcgtgggtgataagcagaagcagctgcagtttataaagaataaaagcctcattaggaaccagacatctgatgttttctttcccctcatcctcctttctcaaattagaaatgtgtatatcctaaagtttagcttttgatgggaggcctttccagaagatgatgtcacatggctggatctggcctttgtcgatgagctagatgagctagatgtgctagatgtgcatattagtatttgtgctgagaatcaaagctttctaataacagagacctttctcactatgaccaaagagagcccttccactctgggcctgttgttgaagaaagaaagtcagtgcagattcataggcttactcattggaggtgtttgaaattttcactcgcttttgtactggggtttatagaaaggggaaggaggaatgagtcaagaatgccaaatacctcattagcattaagaggctgggcacggtggctcatgtctaattttgggaggctaacgtgggtgaatcccttgaggtcaggagttcgagactagcctagccaacatggcgaagccctatctttactaaaaatacaaaatccagatgggcatgctagcgcacgcctgtaattccagctgctcgggaggctgaggcaggagaatcgcttgaacccaggaggcagaagttgcactgagctgagatcgcgccactgcactccagcctgggagacagagcgagactccatctcaaaaaataataataaaaagaatgctaaataccttgctagcattaaaaaaaatcatacttccacaataagtaagatagtaggccttctaggaaataataatatcatttatgtattaaaaataatggcaaaaaccacaattacttttgcatcaacctaatataacttagagatatggaaagtgcttttatttttttttaactttgtgctggataacatgggagggattcactgtggactgaatttgtagattatggcaagttattactatattagtgattaaatggcactttttcaaatcccttttaatttgcatggagcaaaaaaaaaaaaaaaccattatcatccatgtggtgttacttatcatttgttgaaattttcaggattctggggtaattaagggttaaacattggtagactctgccaggatggcgtctgagtagaggaaaggaggagacaaggattaactgtacagaataaaagcaaaagaactaagttttttaaacttgaaaaagaaacagaattgtgcaatcattcatttctatgatccaccctctcagcaaaataaactgcagctatcactttccaaacgatgaagtgatacttctaagttttttcatggtgtcccaatatttttcagaacattaaaaagaaatagcgcttcagtcctctcaaaatgaactgcatccaactcaaagtctttttttccttaggttaattaagattctcctcctgcatgaggagaaagaatttggtctgggctctatttaaagtccatgccatgtgtaacctgagtgccactggctaaaagcctctctctctgcatttctgctctttttcaatcctcaggtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattggaaccaagttagtcaggtaattgctaacattttaggacagtactgactaatttgtatttttctccctcccaaagcttcctacctaactggggtcattgtgaattccttatgtacagatacatctggcctactgggtcttttaaagttggtcttgcatgatgaaacactcgaagaacctgtcctttggcccagctagccagtggctttgaggtcaccaaagcctattccaggagtcaaaaacttttttttaaagaccagttggcaaacatttcaggctttgctggccagacagtctctgttgcagctactcaactgcgctgctgtagcataaaagcagccataaataatagataaacaaatgagtgtggccatgttccaataaaactttatttattcataaagctggatttggcctgcagatcacagtttgctcaacaatcctggcctaatttatggactcactagcattcctgggaatgccatgaggttctgccctgtggactgtgagactgcagaaatattatttgccttcaatggtctgcctccatccaagtcaggtagccttaaccctcatatctgaacatccctcttccaacttcaagtaaatggatcatctgacatctcttcctgcctccaaccattgtataggatttttgcttttgccactggtgactttacaagtccctttaactggcagttttaatagaagtgagcattcatgccagaggtcttatttttgatgatcagtttaagcacatgtaagaattagttgttctgctgacttgtcttactctgcatacacaacagggtgcataactgggagaaaggaactgtctagaatcccagagcaggatttggaggtggggggaaaattgctgtccttgcttggaagtggtataactggaggcaggattggcatggaggctgctgaccatttctccagaggaagagtaacccctaaggcacctccttacagctgagttgtgcagaaaggtgtcagagacagcagctgtggcatctatctgaaggaaaagcacagcctaccagggaacctcgggggaggcttagagggtctctctgttctgtaaaccctcttgcgactctggaagaaatttgggaatgtttaccagtggtctctctcgctctcgtcttcttaattcagccctaacctgtgaccatttctggcttcgggaaaaagccagcagaagcaagagggactaacgtgattaatggtatcgagctggaaaaacctacagttctaaacttgccatcttaccaaggaaaaacaaggggcctctctgaggcccagagagattaaggaaatgtctcaaggacagacatgcagttactgagtagcagaaccagaattagaatttcgctcctgggctctctgcccaattttcttttgtatactgtctcctgttttgtactttctactctatgtaagagagtatatgcttctaggttttctgattgttttattactcttgtttatgttttactatgaagaagaatgtaaatcattgaataatatttgcataaaataataatagtgttatcatagtaaggagtaaaaaagtgtgaagtatcctatacccacctcaataaatgtcaaagtagcagtaaagaaaattttgtaagtttttgttaaaatcctaaacaaacgaggagttgtaatcccagcactttgggaggccaaggcaggcagatcacctgaggtcaggagttcaagaccggcctggccaacatggcgaaataccgtttctactaaaaatacaaatattagccagctatgatgactggcacctgtaatcccagctactcaggaggctgaggcagtaattttggaggcagaggttgcagtgagccgagattgtaccactgcacaccagcctgggcaacagagtgagactccatctcaaaaaaaatgtaaaaataaatttaaaaaatatatactaaatatcttactatagggagaaaccctaaagtcatttcctttaaaaacagaagcaaagaaaaattccttaaccttactgtgctaaaagtctggtcacaattatttgtggtgaagaaaaggtataaattgtaggaaagatatactgttattatacatggttgtatacctagaaagctctaaaaactgacccaaaattgctatatataatgatttcagcaggtttgcttgatgtaagattaacctataaaaatcaacattatgtttatataacattgttacatagaagaaaatacaatgaaaaagggagattgcgttcacggcatagcaacaaccgcattttaaatacttaactattcacaggcagaagtccgtagtcaggtacctagctaacatccaggccgatctgttgctagaaggaaaggagactgtgtaatgggggtcagtgagcagcctcagccatgatctgtaggcccacacatacctggtttgaaccactgcagtttttggtctctgctacagcttagcttatagtctaattaatatatagctcattagggtctaaaataggatgctgtgcctggccaggtaatcttaatattactgtcacatgacactccccaggtaggtgagcgatccagtatggtgggagcatggctccttgaagtctgcctggcagccccattccttctgtcttgctgctctcccatcccctagatggtctcagctgcatgatcaaagctggctcacaccatcatgctgaagttctagcctgtggaaaaaggaaagagaaagaagggagcatgcacccaggcattttaaggatgagaaggggaagtaacaaacatcattctgctcacatcccattgcagaaactcagtcacagcacgatacctggcttctagggaggcagaagtctgtagtcaggtacctagctaacatccaggccgctctgttgctaaaaggaaaggagactgtgtaatgggggtcggtgagcagcctcagccatgatctgtagtctccaaactaatgggaaggagacttttattttgcagctttaaaaatggatttttatttctcaaaacatgaaaaatagagctttgttgttttattctgagtctcctactagggtaccttgtttttaacctgtaatatatcctttttgtcatcataggaggctgagccagaggcccacaactgaagaattagagcaaagaaacatcctaaaacgtgagtattctatactatagaatgattccttgtgtaatcgctaacaagctgcctctacagatgatcgatttatcagtaagaaaccatcatatattcatttactcaagatggactgaaatagtccatttatgtcacatttatatgtaattgtttatatatttttttaatttcttgaatttgatatttgattttatggctttgagccttatacccgcccctagagcagagtcatggtcatgacaattgtgtttaagaaagatgaaatatattccatgtattctttcacccaaatattaaatagaaaaagaatgctctagtcttctcgcaaataaatgtcaaagaaaaggccaaaagaatccacaaggaaacaaatcaaacattcctatattattattaacaatacagtttgttgctagtttaacaaatggctcaattcaaaacaaaattttcaatccattgcattttcctatgttatgataactcggcttccttcttgagttgtttataatttctcagcactaaaacgttctccattcattttcctactttattttcccattctgtttttccctctgttctctttgactttagtttttactcatccctgcagtagtatttattggagttagtatgttaaagctataaagctaatagaaatacagtttgtcatgctattgtgtgtcagtgtggacaggcactgcagtgagttaagaaacggatatttttaaattgagcctagctgtagttttatatattgttaacccagtttcaaaagatctttttattgtatgaaatatcaaagaacagggatgggtaaaactccggctagtactgcaatggtagtgacccatggtgtgggggaaatccttgtcagccaggcttttcgagttatcttggcctgctagaagacccctcttctccaatctaagatactttctttcctttagggaagaaagattttagtagcatattgtattacagttgttagtacgaaatcaattcaacaatgaaaatgaactaccatccagtgagaggaactaccatccacccagtctatgggatcactttctttggaatgcttttttctggcttttttttttttgacataactagaatacagctccaggaaggacttaagtggctactaatgtatagaagagccaatttggaggaggaaaaattcacggctagaaaagaaggaaaattttgtgtttttgctttgctgaggaagagtagaagcagcatctcattttgacacaaaacaaaccaaaaaggttcattgcttttcatgataggttcctgggaaatgcttgttgaattaagttttaagcatgctcaaatgcagaccctacgctcctaaaaaacacagagattatgtcttactggatgcctgatccaatacctagaagaaaaagggaagagcacattttgggtaattctttcttgatcctgtgagataaatagtgccaaaccacaatggagtttggttatctgaggaactgtttcatagatctagaaacttaccgcgtgttgatcttaagtgctgcattggcctttatatcccattttcctggaggtttgggaaagagtgagacacttcagatttgactccagccctttttttccttccttctaagttcacctaagcatatttatttctggaaacagaggcatatttccagcctagagaggctgataactggcttatgatttcctgacccactattgtacagccaagggaggcagaagaaaactgggagaggtcatctttccctgagcagtcacaggaaactgaatggcctaacttacaaacactctactcagcccgtttgtgtcttggttcttccacatagattgctcttgttcgtttgtttgtatgtttcatctccagcttttgttcaagaacagtagaaaagtatgtgatacagtgtggtttttaaggacgtttactttaactaggtcatctttttttttttttttttctgagacggagccttgctctgttgcccaggctggagggcagtggcactatctcggctcactgcaaccccgcctcctgggttcaagtgattttcctgcctcagtcgtcccgagtagctgggactacaggtgcgcatcaccatgcctggctaatttttgtatttttagtagaggtggagttttgctatgttggccaggctggtctcgaactcctgacttcgtgattcgcccaccttggcctcccaaagtgctgggattacgggtgtaagccaccgtgcccggccctaactagggcatcttttctggcaaactagaaaactaattcacagaataaaacattcaacaatttttagagcccatcactagttcaataaacatgagtcagatgccaataaatgtcattagttttcattggtgaccacaggacaaattatatttcttagtgtcaattcaccatgccagtccttacttgatgtctttcctaattattttggtgatactagagctttttaaaaagacatattacatatacgtatttatattatattatattatattatattatattatattatattatattatatttagttattcattttagaaccagttcctaaaaactgataaaatagaaagcaacttttggtacttaaaagttcaacttttgctaatcaagaaaggtgatgtatttagctgagaatgtaattctagccatgtcttctatagagaaaaatgaattaggccattgagttctgcatatatttttccccaacattttattatgaaaatttttaaacatgaagaaaagttggaggaattttacagtaaatccgcatatatctaccatctatagtctgtcattaacatcttgctttatgacatatctatgcatctgttgatccagctttttttaatgcactttaagtttatgtgtgtctttttcatttgctaaaaacacccatatgaggccaggtaaggtggcttatgcctgtaatcccaaagccttgtgaggccaaggcaggagaattgcttgatgccaggagtttgagaccagcctgggcaatatagtgagatctcatctccaccaaaaattgaaaaaacaaaacatctacatggaaacatgtaaaaagcagaaagaaaaacaaatccacaaaaaaatttggctttttgaacccattttatctgaattaacaactcaagaagataatactccaattgctggtatttttatacttttctttcttcttttagctcatccacaaaattctctgggtaacattgctcgctaggcgggtttcctgtggtgcttgctgctgtttaaccacatgtattatttgtttatttatcggaaatgcttcttgcgggtcgtccgaaatgttcgcccctctctgctctgatgagagtcactgagagcaagatttgtcaatgaaccacgtcacttccttcatgcatatcccaccagcctgtttaaattgaccagaaagatttgcatcctactttataattagtcctctagtgaatcaaaaaatgaaggaagcatacaaaaaacttggtgtattttcaaatactgagtttaaggtttaaacttgactctatgagagattttacaatgactgtttaataagattcagagaagctgtcatggtagctcatgctggtaatcccagctacttgggatgctgaggcgggaggatcacttgagtcctggagatcaagacaagcttggactacatagggacagcccatctctacaagatgaaagtaaagattcagaggaacagtcatgttggcttccctctacctctcaccctcgtcctctaacttcactaaaagtacaattttgaacatggaaaacttaaagaaatcagtttctgatgtcaaaaatgaattcaattccctaactgcatttggcccttctctttttagacatcactgttacctggtagcactagctgaacaatatgcttaataaggcaaaactttcaaatattcccttcaaggaaatatcatttttgcgtatttaatgacgactggagcatttgttagctttgggatgtattatatccaattttttaatctttgaaaagtaccttaaaaatatagcataaatactgtataggaagaattgacaaaaatgttctcagaattatatttttctttttattaataatgtcatcaatatcactaacaatatcatcactttttatcaacaatatcaacaatgttattttcactatcgtgtcaccttgtaaagctctggtttaaatcacaagaaccacagtgtggcatttgtttattatgtattttgacaatccacaagctttatccaactcatatgaggtaattctttgaacctaagtatgcatttttaaggatatgaaaggatatatattttgtgaagcaattaaaaccctagagtactttcataggaagaaatttaaattataaccaaatttgtttgactggcacaaaatgaaaggatattaactcattgtttcttgtcttgtggatgattacagtttatgtccactctttgtctaatcaccttctttcttatgcattaaagttattatttcagaagaacatagaaacttttccctgttcagagaaggaaaactgatagagaatttagcctgttcaactaacaaatacagctgttgcaaatattgaatactgatatgttattcacagtaaaaataatcttagttgtaagaagtctatttgaattataaaataaatatatttcatacctgtcatggattaaaaaaattttttttaattgaacccgggaagcggaggttgcggtgagccaagatcgcgccactgcactctagcctgggtgacagagcgagaatccgtttcaaaaaataaaataaaaataaaaataaataaacaaatagaagaagttttcctttttcaaccttttggtcaaggctttatatggtgttattttcctgcaaaagagttcataatagcactttctaaaacataatctttcataagcatcggtatccaagaagcaaaatgtatgctcactgatcaaacagatgatcagctaaacgaagcaacagagagatgttcctcaagtaagcaacaaccagcaaaacctgaaggggtgtttatttctttaaaaattttggacatttttctttaaatcccatctgttgggcagcataaaatcgtactacttggtgaatcactagagaacgagaagactttggaaaggcaaagtcacaagaaaataaataatttccacccagagtacatcataacctcatttagaacattctggtttgaaagcaaagtccaaggaaatgcttacattctgcttctatggaaacgaaggaagacaaatcaaatattttggttggatttgagtggaaatcagcagctcagacatgcatcggatggttctaatttgctcttttaatatgtctcagattttcacacgaaggccagatccagaagtaaatttttatctgaattctggtaaattgtgcttataagcccatgaaatgatcagcaatagagggctttcattagaatatgggcactcctgtggtttttttaagaatacaacaagacatcaggaagcaaaaacgtttaaaattagtaaagcaaaccagtcctacaaaaaaagcatgtgtgtgtgtgtgtgtgtgtgtgtgtgtgtatgtgtgtgtgtgtgtaagatgatcaaccttcctacaaaatattttgacaactttttaacaatgttggttgtgtgtttgatcattatttgttagagtcacatgatcgtggcctgatacacttttctgaatatgaaatcatctatagtaactgtcatcacgactttcctcctttaataaacagaaaagaatgaagaagaggaacaagaagcaaaaatggaacttaaacgcagactcagcagaaaggtaatgaaatcataactattaatgagcatatgtgttttgagatatacttttaaaaaaaaatactaatcctctctgtatgtgtaaatcagatgtttagaaataattattcctattagtctataatcatagacatcaaaatcacaagcctgggcaacatggtgaaaccctagctctacaaaaaataaaaaaattagccggcatggtggcacatgcctgtagttccagctactcaggaggctgaggtgggaagattgcttcagcctgggaggcagaggttgctgtgacctgatatcgtgccactgcactccaggctgggagacagaatgagaccctgtctcaaaaaaatgaaataaaataaaataaaacaaatcaatataatgcacatgctatgagtgatgtttctgattgtgtgttgtgctaattttgaataattaacaagggttttaagttgcatttactccatgaaagtatgtactctgtgtgaaaatttttaaagacacaaaaaaagaaaaaaataaaatcatgtctttcattcagagacagccattattaacatttcaatgcatgtatttccattttaaaaaattgttttgagtcaggtgcaatggcacgcacctgtagtcccagctacttggaagctgaggcaggaggattgcttgagcccaggaggtcaagaccagcctggacaacatagtgagaccttgtttcaaaaaaaaagaattaattgaaaattaatctcgcttgattagaacaatgaaaaaaaaaaagaaaaaaagaagtgaaaaaagtttttaattatgataaaaattatttcttaaaatgctcacactttccatttagtgttggaaatattaaacaagtaagtaatttgttactcctgaagatttcccactattccacatcacagctgggtaagtaatttattaagtgaacttgatcatccagcctgcctgctacagtgctacccagattgacaaatgtcttacctcccaaactcagacaattgttgccacttatttatgaatatataaatctgatgttagggccatcacttttttctgtgttaaagtaatagcctttggaaaaatcaagcaccatcagagtttatatttcattataaatccttctaatcattcttcaggcataccttatgcacctaaaaatggataaagtgactaaaatgtgacatctacatgaagtgtgacctgacccacatttttgtgggctggccagggagtcttcaacaaaagcattccaaggcagatggaggcaatgcttcattcccacagaaaagctatgggactatgttgaaagtgtttggttctgtttttcaaggaaaaacatccttaatttatccattgtattagtccattttcacactgctgataaagacacacctgagactgggaagaaaaagagatttaattggacttatagttccacatggctggggaggcctcagaatcatggcaggaggcaaaaggctcttctaacatggtggcggcaaaagaaaatgaggaggggaagcaaaactggaaacccctgataaacacatcagatcttgtgagactttttgactatcacaagaatagaatgggaaagaccgagccccatgattcaattacctcttcctgggtccctcccacaacacatgggaattctgggagatacaattcaagttgagatttgggtggggacacagccaaaccatatcattctgcccctggcccctccaaatctcatgtcctcacatttcaaaaccaatcatgccttcccaacagtccaccaaagtcttaactcatttcggcagtatcccaaaatccacagtccaaagtctcatctgagacaaggcaaatcccttccacccatgagcctgtaaaatcaaaagcaagctagttacttcctagataaaatgcgggtacaggcattgggtaaatacagctagctgttccaaatgggagatattggccaaaacaaaggggttgcagggcccatggcaagtctgaaatccagtggggcagccaaattttaaaggtccaaaattatctcctttgaatccaggtctcacatccaggtcacactgatgcaagaggtgggttcccatggtcttgggcagctccacctctgtggctttgcagggtacagcctccctcttggctgctttcacagactagtgttgagtgtctgcagcttttctagacacatggtgcatgctgttggtggatctaccattctgggttctggaggacagtgaccctctttgcacagctccactaggcagtgccccagtagggactctgtgtgggggttccaaccccacatttcccttctgcactgccctagcagaggttctccatgagccccaccccacccccaaccctgcccatggcaaactttggcctgggcatctagacagaggttcccaaacctcagtttctgacttcttttcacccacaagctcaacaccatatggaagctgccaaggcttggggcttccacgatctgaagccacagcccaagttctacatttgcccctttcagccacagctggagtggctggggcacagggcaccaagtccctaggctgcacacagcacagggaccctgggccctgcccacaaaaccactttttcctcctgggccttcaggcctgtgatgggaggagctgtcatgaaggtctctgacatggcctggagacattttccccatggtcttgaggattaacattagcttccttgctacttaggcaaatttctgcagccagcttgaatttctcctcaaaaaatgggttcttttctgctgcatcctcaggctgcaaattttctgaacttttatgctctgtttcccttttaaaatggaatgcttttaacagcacccaagtcaccttttgaatgctttgctgcttagaaatttcttctgccagataccctaaatcatctctctcaagttcaaagttccacgaatctctagggcaggggcaaaatgccgccattctttttgctaaaacataataagagtcacctttgctccagttcccaacaagttccttatctccatctgagaccacctcagcctggaccttattgtccatattgctatcagcatttttgtcaaagccatttaacaagtctctaggaagttccaaactttcccaccttttcctatcttcttctgagccttccaaactgttccaacatctgcctgttacccagttccaaagttgattccacatttttgggtatcttttcaggaacaccccactcctggtaccaacttactgtattagtctgtttccatgctgctgataaaggcataccctagactgggaagaaaaagaggtttaattggacttacagttccacatggctggggaggcctcagaatcctgacaggaggcaaaaggcatttcttacattgtggcagcaagataaaatgaggagaaagcaaaagcagaaacccttgataaacccatcagatctcatgagactcattcactatcacgagaatagcatgggaaagaccagcccccatgattcaattacctccccctgggtccctcccacaacatgtgggaattctggagatacaattcaagttgagatttgggtgaggacaccgccaaaccatatcatttttttttctcaaagctcataaatgtcaaataatgatcaaactgaaagactttattgactcaatttctagggatgactctagttttcaatggcccttaagttaccatctgtagacaatcaatcaccccctccttattgccctgggcacagtcttgtgatacaaatcatctttctcaatccagctgggcccctccatgaggcagcagtgccagcccttaccctctgcacccacttgcctccaccatacatagctccatgccgtaggtgcaggtcagcccgtagcactggtagctaccccatgactgggacagtcctgaggacaagactggatggagaatttctaacctatattgccattggtcactttccttctagccagttcttaggagcaagggcttctctacctccttatttccacctgccccaaagtggcagcaagaagctagcaatatagattggacagcaactagactatagcagatcacttagattattctttctcttgtccattgcctaccggggctctatgaagatagagggagccatagttggcacatccctgctccagtgggctcagggtatgggcctaggccttctaaaagtccttgagtgctttgaatattacagtattggcttagttcagaaggaaactgaggcccaggaaagggctgttaatgactacagaatgtagacccagtgcaaaataaggaatatctctggacaggtgttgtggcttatgcctgtaaccccagcactttgggaggctgagatgggagaatcgcttgagcccaagagttcaagaccagcctgagcaacatagagagaccccccacccactctgtttaaataaaaaaaaaataagcaatatctccggagaggaccacttagatgatgggtagtctggctgtatacagagtatatataagagaggaaatatatgaaaatgggccctatggctacaatagaggtctaagtctacctctctggagataactgtgataccacccaactaagaaagaccaaaatgggagtgaacctccgtagcagagagtagataatgcctgtttaccaaggggccagctttctttcacctgtcagagtcttattcttcggtttgagaaaggacccagaaagaaaagcaatataattacaaatctgaatttgacaaagaccacaaggaggaaccgaagttgttagaagtatcttaaaggttggagttgattttaagcagtgatggcctcaaggaagtacagttctccatcaactctcccctccccattcgtgtacatcggtttttctggccaagggcatgtgtctgattggggtcttgtccttattatgaatatcttaaggacagctgtgctgtaggcacaccctttattggaccctttctatgtcataactttgtacatttctgagtgtatgggcttaatattataggaacaggtttttattcccatttctaaaaattccatggcttttgccttgataattcaatcaccaaaccagccattctgtatctgggttactattgtgtctgcgcattgcatgttccttgcgtcagggatgatagacctttatcacagtgccaggcaagttggggaaaatagcataatgcaggtggttgccaaagactgtgacctatctaaaacgatgatttttttatagtctcaaaaattagggcacatggctttctagttctcattagaaattcccaagatgctgttgcctttttttttttttttgatctgaaagtgaccttatttaaccataactttgaagtgttctctatagaaaacttgccaccatgaggctgtaagtggtttactgaactctgcctttttccttgtcctcctgcagctcagcctgagacccacagtggcagagctacaagctcgaaggatcctgcgatttaacgagtatgtagaagtcacggattctcctgactatgaccgccgagcagacaagccctgggccaggttaacacctgcagacaaggcaagaatcccagtggattttgtgttgattgtattgcttttctggaagctccaatatccacatcccccctacttaagtcatcccaggggacgagatcttaccaaatattacaacagttttctgcctctgattatttaagccacttaagtgatacatttagtgatatcaatgtagttctttcaactaagtctcagagaaaagtagttatttaccatataacctacctgctttcatacctggatgaggagggctttctcacatccaggatttatccttactcttagaaaatataacttatacaacttatcattttaaagggatatgttaatagaaaggtttaatcttcgtcgagactggcacacttttaatagaaatgacaagacagcaaatagtttaggctatgtgggccatacaatctttgttgcaactgcccagttctgccattgtagcatgaaaacagccacagacaatgtgtaattgaatggatatgtatatgctccaataaaactttatctacaaaaacagatggtgggccaaatttgacctgcaggtcaggcttaccaacccctaatctaaatcattgcacacaattcctgaaaaatgaaatatacagtgggttctatcaatgtagaaagacttttaccttattagtaccattgttccataggcaaagattcgtgccaaccgtttgtttttaaattgttctaatttttatctcttagcaaaatctggtattgaataaactcgtgctatacccagttttttttaatcataagtacttttgcttaaacatgccacatcttaatgctaaaactaggcatttaatcatgctctgtgctgactctttttaataggaagcttcattatttaaaatacctgctatgcatcaagcatatactggagatacagattcagaaatccttagctcataagtagaaatgaaaagtaagaaggaataagatcacaaaggaagaatgttcagaacaagaatagaagagaaggaggctgagaaaagcactccagggatgttttaggaagaagcagcagaagaatattgagaagaaatgtccgtgaagtggggaaagaggagaagctggtagcacagcagcttggaaggactgtgtcagggaggacggacggccacatgtgtgcagtgacatggtgagagggagcattttggtggcctgatgggtggaagcctgtggtggagacaacgaggatcaaacacaatcctgagaatttgggctctgaagtatgatgaggcagttgttcaacgtatggctggtgattgtgaaggtcaataagcttgggtgcgtaaatttggaaaatgagatacagtatcaagggagtgatttttttttaatttatgggaaatacttgaacaattttttatgtggtgaaggggtcaaaagaaagggagaggttgaacatacaggcggaaaagtcagtaactgatagcgtgggaaaaatcactggagtagcaggtcagtacttatgtgaaagaggcaaggagcagacccttgaggacggagggagagcacaggctgaggaagctaggaagtcgtatctcattgtgcttttactttgcctttcgttcattatgaatgagattgaacatattttcatatgcctattgggcatttggataccactccaccgaagtgccttttgcccattttcttttgggttgtcaattttttctgattcataggagttcttcatatattccagttatgtatgttgcaaatattgatttaacaagattctttttttttttttttgagacggagtctcactctgtcacccaggctggagtgctgtggctcgatctcagctcactgcaagctccacctcctgtgttcacgccattctcctgcttcagcctcccgagtggctgggactacaggcgcccgccaccacgcccagctattttttacaaaatatttttagtagagatggggtttcaccgtgttagccaggatggtctccatctcctgacattgtgatctgcccgcctcggcctcccaaagtgctgggattacaggcgtgagccatggcgcccggccaacaagattcttaaacttaatacagtcgaatttatcaacctttttctttatggcttatgattttgtttctggttttaaaaattctttgcataccaaaatgatagatatattctcatatactgtcttctaaattgtttataattttgcttttcacatttaacttttttgtttacctggagttgttttttgggggaaggtataagatatgctttcagtttgcttggtcatctgtattatatgtttgttttctatgtcattatttgttcttttctcttcttcctcctaattttttgggctttattggctattctgttctaacctaagatagactctccagatcattaattttcatccttccttactttctgatacaagcactgaaggttagaaatgactctgtgtgtcagtgatttgcaaccttggctacaaattggaatcacctatagatctttaagaatgtggatgtctgggtcccatctccagagatgctgatctcattggtctgggatgtggccttcatattgggatttttagtaattataaatatctcacatgtccttgaaaacaatatgtgttctatggtttgagggtgtgcaaattttcctgtaagatcaatcttgctagttctattcagatttctgtacccttagttatttttttgtcagtttgatccatcaggtaacaaacaagacatgttaaatctcccactatgtggatttttttttttacttctccttataattctgttaattttgcttcatttattgtgaggtgtatcattagatatatatgtttagaatgcatacattttcttgatgaaactttgttatatttaaaaatataatttttaaactggattgtcaaaatgagttattttatactaccttagtactatgaattgaagcagcaaacctctgtgatgtttagctgatggcttcaaattttcagggtacatttcatcactccctgcctatccccttacttactaagcaccagcttgcaattttttgtttgtccttggagggtcagatattctagcttacccttacactgagggtatgccatttggtccccaatttatggagagagaattatttattagacctgagtgggttttgtgtgtcttctgtatttcaccaaatcataaagatgcctgctcaaattcactagatttaacacaagtgccctcaaggtcaaagccagtttcatttctcacttaccttatttttctggccatgatcttcttttactcattctcatcaaagtattttttactcttttcccagctgtttagtacatttaaagcagtttttagatgccatgtttagcattttaattgtttttcaatagaagagttagtcaaggcatctggtatgccattttgctagaaatagtactgcattatgaacttggtgcaaggtttcttccatcctcctttcctttcagttgtgggcttctggtcattcacctctcatttagtggctcctagttgaccctgctctagtcactgtttctgtgcagtgaccttccccaaaacttagtgattgaaaacagcagctattttatatcttacagattttgtaggttggggatttagtcagggctcagctaggtgattcttctgctcttcatgaggttgactaaggtcactcaatgttattcagctgacaaataggctactttggaggctccaagataacctctctaacatgtctggtgtcttggtaaggaaggctcagagactgggctcaattctggctcctagtccgccaaactacctatacatggcctcttcagcatggtggcccgagtcatcagtcttcttacttggtggctcagcaaatgtcccaagagaaccaggtaaaagctatatggcctttcctgatctggctttggaaggcatccagcctcacttccactacgttctattagtaacaggcaaatcataagaccagctcaagcttcaaggaaaggggaattaattagctccacttcttgacaggggagtggcaagatcacaattgtggccaaatttggaaaatacaattttccacacccaccattcccagctatcttattattcaaatgcaaaacttcagaaaggcaggtagggccagataaatgagtaaagatcactgcagttgccaagtatgcaagcagggagagtctaaatgactaaccaccctcatgtggaaactaaattgtccaaaccctagaaacagttccttttgactcttgttcttttgttggaaggtaaagctcattcatctctagctgtaacagagaggatttttttttttaattttatgttgaaacaaaaatgggattttgttctggacttctaggttgcaggggaaaggtacatgaccaggttttctgccacaggctttgtttctgttcatgagtgctttgaaggcatatgactttgacatctcccttgcagatctgagccccagagcacagccactgcccctctctcctcacacatgggcctcattttctccctctgacagtatctctcacatttctcctgaggctttttaaagtctaaaaagcagcatttttagaagtggatttttattgtgtatgtgtgtgtttctctggaagaaaattaagaggtagaatttcttttaaatagaaaaaatattggccaggcatggtggctcatgcctgtaatcctagcactttgggaggccaaggtttcttgagctcaagatttcttgagctcaggagtttgagaccagcctgagcaatgtggtgaaactctgcctctactaaaaaatacaaaaaattagccgggtgtggtggcgcgtacctgtagtcccagctactcgggaagctgaggtgggagaattgcttgagcccaggagcaggaggctgcagtgagccatgccacggcactccagcctgggcaacagagctagaccttatctcaaaataaataaataaataaataatatggtacactttttaaagataaaaaatagaaaaatgcaacaatttaagatgtttatgtgtagtatattgtatatacacaagtgatgaatattcattgggccatatctgaatattcaaaaatgcaaaaataaaaaaagaaccactttaatgcacggtacttttaataatttctaaaaataccatttactacctaacactgaaaaaaattgttccctctagttgttaaaagataagtgtgatgaaatagtacaatattattgcccaaagatcctaagactatcaatggtcttagtgtatattttattttagaatgaaaataacacatgctaatcaccattattaacaagcatttctggtttttgttgctttttaccttaaaacattttataatatattatttattatatatatttagatcagatttaaaatattgtattaagttaattcatgtaaaaattataatttagctattaggtttaaaaatgagttttatttttaacttttgagctctatatcccatttttaaaaactattcaaagtaaatatttccacctctgctttaaaaaataaacaatgaggccaggtgcagtggctcatgcctgtaatccaagtgctttgagagggtgagttgggtggatcacttgaggtcaggagttcaagaccagcctggccaacatggtgaaaccccatctctactaaaaatacaaaaattagctgtgcatggtggctcctgcctgtagtcccagctgcttgggagactgaagcaggagaatcacttgaacccaggagacagaagttgcagtgagctaagattatgccgccgcactccagcctgggtgacaaagcgagactccatctcaaaaactgaaccaaaccaaacaaacaaacaaacaaaaaatgagcttcctttcagcctaaaggagacatcttttttctttctcttatcttagtgccattttcttagccccattaagctaccaccttgcattttaaagagtagtagccaatcagtcagtaattaatcaatgcctctcctttctgtgaaggaggaaggcccttgctggttgtggtggggaatctccggaatctggtagtctggttaaatggctcatgttggaaaagagaagtggtgggagaaatgccttattaattgtgaacttgattgagctttattcacctttaaaataaaattttcaggtcggggcacaatgactcacacttgtaatgttagcactttgggaggccaaggtgggagggtcacttgaggccaggagttaaagaccagcctgagcaacatagcaagaccctctctctacaaaaactaaaaaaattagccaggtgtggtggcacacccatgtattcctacctacttggaaggctgaggcaggaggatcccttgagtctgggagttcaagactgcaatgagctgtgattgtgccactgcactgcagcctgggcaacagaatgagaccctgtctctaaaacaaaaataaacaaaataaaattttcagttttagaatatatgtacttagagcactagaaacagatatatgtacagtaaaatagagatggcctggtttcctgcactgaggtagatagacgagctggcccttcagtggcagagaggtgaggtcagagaaggccattgaattggcctgaagacctaggcttgcctgccagtaaccatctccttagagtagaacttggaagctccatggaggagagaggggcaggctttagaactgggcacttctaggatggattgatccttgacttggccacttagtagttgtttgaccttggccaagtcatttaacctaggtttacttactagtaaaataaagtcaattatatctatcttgagaattaggtagaatatctctagaattcctgcttgtcaataaatggtagctattaccaatattatactcatagtcagggatgagaagccaagctttgttccccattggtgatattttcaccgttgattcctgagtttacgatctagtctaaaattatccagtgaaagagagtgtagaattttttcagatgagatgtgcttttgtccaacaggtcactcagtaatcacttattaaaacccttacaatatattaggtatcgtcctagatactggggatataaaattgaataagacaaactgtctttccaggaacacagtgtctaaacaggtcctaagaaagcctgagatttttgttgtccctaagctattctttgccctgttcattgatgccttagcagcagaagggagtacacttgcctccctgtggcattgaacttgattgatgagtagtccagaaatcctctccacatcccatcataattttatccaagaaataaaggatatcaaaatggcaattctagttaattctggccccacagctcatgctatttgagaaggcagcaaggtctgcattttctttttcttttctttctttctttctttctttctttctttctttctttgtttttattatactttaagttctgggttacatgtgcagaacgtgtaggtttgttacataggtatacacgtgccatggtggtttgctgcacccatcaacccatcacctacattaggtatttctcctaatattatccctcccctagtcccccaccccctacaggccccagtgtgtgatgttcccctccctgtgtccatgtgttcttattgttcaactcccacttatgagtgagaacatgcggtgtttggttttctgatcttgtgatagtttgctgagaatgatggtttccagcttcatccgtgtccctgcaaaggacatcaactcatccttttttatggctgcatagtgttccatggtgtatatgtgccacattttcttaatccagtctatcactgatggacatatgggttggttccatgtctttgctattgtgaatagtgcctcagtaaacatacatgtgcatgtgtctttattgtagaataatttctaatcctttgggtatacatccagtaatggaattgctgggtcaagtggtatttctagttctagatccttgaggaatcgccacactgtcttccaaatggttgaactaatttacactcccactaacagcgtaaaagcattcctatttctccacatcctctccagcatctgttgtttcctgacttttgaatgatcgccattctaactggcatgagatggtatctcattctggttttgatttgcatttctctcatgaccagtgatgatgagcatcttttcatatgtctgttggctgcataaatgtcttcatttgagaagtttctgttcatatccttagcccattttttgatggggttgtttgcttttttcttgtaaatttgtttaagttctttgtagattctggatattagccctttgtcagatgaatagattgcaaaaattttctcccattctgtaggttgcctgttcactctggtgataatttcttttgctgtgcagaaactcttcagtttaattagatccccgtttgtcaattttggcttttgttgccgtttgcttttggcgttttagacatgaagtctttgcccatgcctatgtcctgaatggtattgcccaggttttcttctaggatttttatggtcctaggtcttacatttaagtctttgatccatcttgagttgatttttgtataaggtgtaaggaaggggtccagttccagttttctgcatatggccagccagttttcccaacaccgtttattaaatagggaatcttccccatcgcttgtatgtgtcaggtttgtcaaagatcaggtggtggatgtgtggtgttatttctccgttctgttccatcagtctgtgtatctgttttggcaccagtaccatgctgttttggttactgtagccttgtaaagtttgtagtcaggtagcaagatgcctccagctttgtccttcttgcccaggattgtcttggatatgcgagctcttttttggttccatatgaggtttaaagtagttttttccaattctgtgaagaaagtcagtggtagctggatggggatagcattgaatctgtaaattactttgggcagtaaggccattttcacgatattgattcttcctatccatgagcatggaatgtttttccatttgtttctgtcctctcttatttccttgagcagtggtttgtagttctccttgaagaggtccttcatatcccttgtaagttgtgtccctacgtattttattctctttgtagcaattgtgaatgggagttcactcatgatttggctctctgtttgtctgttattgatgtataggaatgcttgtgatttttgcacattgattttgtatcctgagactttgctgaagttgcttatcagcttcaggagattttgggctgagacgatggggttttccaaatatacagtcatgtcgtctgcaaacaaagataattggacttcctctcttcctatttgaataccttttattgctttctcttgcctgattgccctggccagaacttccaacattatgttgaataggagtggtgagagaggtcatccttgtcttgtgccggttttcaaagggaatgcttccagtgtttgtccattcagtatgatattgtctgtgggtttgtcataaacagctcttattattttgagatacgttccatcgatacctagtttagcatgaaaggctgttgaattttgtccaaggccttttctgcatctattgagataatcatgtggtttttgtcattggttctgtttatgtgatggattatgtttattgatttgtgtatgttgaaccagccttgcattgcagggatgaagctgacttgatcatggtggatcagctttttgatgttctgctggattgggtttgccagtattttactgaggatttttgcactgatgttcatcggggatattggcctaaaattctctctttttgttgtgtctctgccaggctttggtatcaggatgatgctggcctcataaaatgagttagggaggattccctctttttctattgattgggatagtttcagaaggaatggtaccagctcctctttgtacttctggtagaatttggctgtgaatccgtctggtcctggactctttttggttggtagactattaattattgcctcaatttcagagcttattttggtctattcagagattcaacttcttcctggtttagtcttgggagggggtatgtgtccaggaatttatccatttcttctagattttctggtttatttgtgtagaggtttttatagtatcctctgatggtagtttgtgtttctgtgggatcagtggtgatatcccctttatcattttttattgcgtctatttgattcttctctcttttcttctttattagtcttgctggcagtctatctattttgttaatcttttcaaaaagccagttcctggattcattgattttttgaagggttttttgtgtctctatcttcttcagttctgctctgatcttagttatttcttgccttctgctagcttttgaatgtgtttgttcttgcttctccagttcttttaattgtgatgttagggtgtcgattttagatctctcttgctttctcttgtgggcatttaatgctataaatttccctctacacactgctttagctgtgtcccagagattctggtacattgtgtctttgttctcattggtttcaaagaacatctttatttctgccttcatttcgttatttatcaagtagtcattcaggagcaggttgttcagtttccacgtagctgtgcggttttgagtgagattcttaatcctgagttctaattttattgcactgtggtctgagagacagtttgatttctgttcgtttacatttgctgaggagtgttttacttccaattatgttgtcaattttagaataagtgcaatgtggtgctaaggagaatgtatattctgttgatttggggtggagaatactgtagatgtctattaggtccacttggtccagagctgagttcaagtcctggatatccttgttaattttctgtcttattgatctgtccagtattgacagtggggtgttaaagtctcccattattattgtgtgggagtctaagtttctttgtaagtctctaagaacttgctttatgaatctggtgctcgtgtactggatgcatatatatttaggatagttaactctttttgttgaattgatcccttcaccattacgtaatggccttctttgtctcttttgatctttgttggtttaaagtctgttttatcagagaccaggattgcaacctgtgctatttttttactttctatttgcttggtaggtcttcctccatccctttattttttttattttttatttttttgagaccgagtctggctctgttgcccaggctggagtgcagtggtgcaatctccgctcacagcaagctccgcctcccagggtcaccctattctcctgcctcagcctcctgagtagctgggactacaggtgcccgccaccatgcccagttaattttttgtatttttagtagagacggggtttcactgtgttagccaggatggtctcgatctcctgacttcgtgatctgcctgcatcggcctcccaaagtgctgggattacaggtgtgagccaccgcacccagcccatccctttattttgagcctatgtgtgtctttgcatgtgagatgggtctcctgaatacagcacactgatgggtctagactctttatccaatttgccaatctgtgtcttttaattggggcatttagcccatttacatttaaggttaatattgttatgtttgaatttgatcctgtcattatgatgttagctggttattttgcccgttagttgatgcagtttcttcctagcatcagtggtctttacaatttggcatgtttttgcagtggctgggactggttgttcctttccacgtttagtgcttccttcaggagctcttgtaaggcaggcctggtgatgacaaaatctctcagcatttgcttgtgtggaaaggattttatttctccttcacttatgaagcttagttcagctggatatgaaattttgggttgaaaattcttttctttaagaatgttgaatattgacccccactctcttctggctggtagggtatctgcagagagatccactgttagtctgatggcttccctttgtggttaacccaacctttctctctggctgcccttaacattttttcctccatttcaaccttcgtgaatctgacagttatgtgtcttggggttgctcttctcgggcaatctctttgtggtgtattctctgtatttcctgaatttgaatgttggcctctcttgctaggttggggaagttctcctggataatatcctgaagagtgtttttcaacttggttctattctccccatcactttcaggtacaccaatcaaacgtagatttggtcttttcacatagtctcatatttattggaggctttgttcatttcttttcactccttattctctaatcttgtcttctcactttatttcattaatttgatcttcaatcactgatatactttcttccgcttgatcgaagtggctattgaggcttgtgtatgcttcacggagttctcgtactgtagttttcagctccatcaggttatttaagctcttctctacactggttattctagttagccattcatctaaccttttttcaacgtttttagcttccttgaaatggattagatcatgctcctttagctcggagaagtttgttattactgaccttctgaagcctactctgtcaactcatcaaactcattctccgtccagttttgttcccttgctggcgaggagttgtgatcctttggaggagaagaggcattctggtttttggaattttcagcctttctgccttggtttctccccatctttgtggttttatttacctttggtctttgatgttggtgacctacagatggggtttgggtgtggatgtcctttttgttgatgttgatactattcctttctgtttgctcattttccttctaacagataggcccctcagctgcaggtctgttggagtttactggaggtccactccagggtctgcattttcaacaaatcacctgttgcttcttcccggcataacgcctgagctgactgggactgatgaagcagacctgttaccactcaccactggccaattttaaacttagtttcagacatttttgtttcctttttcctctctataattctcatgatgccaaaatgactacatatttggtctcagttgctatctcatagagctttgttgttgttgttgtttctactctagaaatacctagttttggctcaatggcttcccattggttgtacaacccagcaccattggagctctgatcccccataacctcagcccagctctttctatctcatgtctttcaacaaaatcagtcccagactgggtgtggtggctcatggctgtaatcccaacaatttgggtaggccaaggcgggaggattgcttaagcccaggagttcaagaccagcctgggcaacacagcaaaacctcatctccacaaatttttttttttttttaattagccagatgtggtggccacacacctatggtcccagctacttgggaggctgaggtgggagggtgtcttcagccttggaatttgaggctacaatgagctgtgatcacaccacctgcactccagcctgggtgacagaacaagaccctgtctcaaaaaaaaaaaaaaaaatcagtcctaattacatatatgtgaagaattattaggcctaaaacctggtctcctttgcaaagaagagagttaagtttattatacatgtatttgtctaaagtgtctgatttactttttttcctgttttaaactctctcaggaaatctttctctttattccaagaggaagtagctcttgtaataaaactatgatcaatcttcagtgaattttaaaaataagcattctatttctttaattgcctgtagtcacatctttctggtatatttttttcaaacaactagtccttacaatttcacatcacttccattgccatatcattcacataactgactcatcatttctaattgtaagccagcacacacaacatgcagatctgaagcaattttcctgatgacaggggcccagaagctcatattaatggaaagactgtaggatgtgaggttaaaaggcttgtgtatgagccccatgtttgtcatttaaccctcatcctgtttagagaaagaaagtgcacctcgctgccagtgctgatttaattttacataaacacgctctttgaggctgaagcaaatctgacagattttcaatgtgaaaataaaatagaggccgattgcagtggctcacgcctgtagttccagcactttgggaggccgaagtggggagattgcttgagcctaggagtttgagaccagcctggccaacattgcgaaatccatctccacaaaagatacaaaaaattagccaggcatgatggcgcacacctgtaggcccagccactcaggaggctgaggtgggagaattgtttgaacccaggaggcagaggttgcagtgagctgagatcacgccactgcactccaacctgaatgacacagtgagaccctgtctcaaataaataaaaataaataaatgaatataaaaactgttcttggagttgtttctaaatagaacatcaaaatcatctattttggaaaaatcagattcatcgaacgattttttggccaacaactgtttgagaatgatgttaacatcacacatagaaaggctgtgttttctaggatttgacattttcagcaatagagaaatactgtattttgtaaataggaataccactactaaaaccataatgctataaatagaatgatgtcttttgtttccaaagtcgatatactagagcgttgcgaaaataaaagcaagatatttcatgacaaacttatcctgaggtaaacaactgcagccgttagtgttgccaggcaaatattctcagggcaaacaggaaaagggttaatgcgcatctctctctagcaagtcatgtgacctctctaggcctccattgcatcagctgtaaggtaaaagccttggaatagttttcaggttatcaactgctttttaacaaaccaccccagaatttagtggcttttaaaacagctatttattttgctctcaattctgagttatgaatttgggaagggctcggcccagcagtttgtttgggatccctgtggcatcaggtgagatgctgggttagataattcacttccaagacagcttcttcactaaccgtcggtgccttttgctccttggcctctctctctctatctacccagcatcttaacctccagggcctttccctgtatcttgggtttctcacagcatggttttctgagagtagtcacttttttttacatggcagctggctttaaagtagcaagaagcaaaaggtgccaggccagttaagggccacatcagactggcacgtatcacctctactgtgtgcatttgttgaaagtggttacaggactcacccagagtcaaggctggagagacagacttcacctcttgatgggggaatagcaaagtcacattgcagatgagccagtaggatatgcctgtaaatagtaaactgtctctcttatgcatatgtatatggtcatcagtgaattataaattgtatcaatatgatggatctatagcacacaatttacaattgtaatgttttgtaaattccatatctcagttgatgctcacagaatgctttcattgatttttgccatactcttagatcagtagtagccaacctactattgcaaataaggactttatcttattcatggttaagtcaacttcggtggcattatcttcttccattccagtggactcttcataaataaaagtgaaagaattgtgaatcccaatcacaaactagaataatttgtttttcaagaggctcataataatgacattttattgactctacagtgtacaaagcactttcaaatatgctcttgattaattctcatgatattgtgaagaatttcctcctggttttccagataagaaaattggggtttggagtgaagtgactcactaagggtcacactgctaatgagggcatagccaagactagaatccctgccttctgactcccagtggaccgcttttcacttcctctgctgaaaccttacatttggagaagaaatttaaaatgaacatcaagacaggattctctgccactattcaaattaaaatacctcctttcggccgggcacggtggctcatgcctgtaatcccagcattttgggaggccgaggcgggcggatcacaaagtcaggagtttgagaccagcctggccaacatggtgaaacctcgtctctactaaaaatacaaaaaattagccaggcacggtggtgcatgcatgtaatcccagctgctcgggaggctgaggcaggagaatcacttgaacctgggaggcggaggttgcagtgagccaagatcgtaccactgcactccagcctgggtgacaagagtgaaactccgtctcaaaaaaaaaaaaaaaaaaaaacctcctttcaaggaagaacgttttatagatgttaattggcgagtggtatagagcagcctcactctttctccttctggttctaggcatcactttttgcagtaagcaaaagtatcctcactgttgatcggactagtgagacaaactggacagccatgtcacagaggactcaggctcacacatatttctctgcttgcttcttcatttccaaaagtcagtagcaagcattattgtcacagttcctagtcacaggttctccatagaaactacaggggctgaggaatatatctggggagaagagacaatctgtgacatggacttaaatatagcattgaaaggagtgttgagggaaaggctcgtgtattgcagaatgatggttagttatgagagagagctagagacaggcctcagggctttttttctgtctgttccctttcctaaaatgtattattttccaaccacaaagaagactttttatctcccagtgaagtcactccctgtgacttatcattcttagttttggctgaagagtccattttgcctagaggttacaggggtgtttttattagcacctttttaaaaacatgagtaaaacattctttatagagaagttaggaaataaaaataagcaaaaatttgaaaccacgaaccatctgtaatcctgccactatttgttaacagataactaatgttaacatttcagtctgaatggcgtaagcatcccctcaaataccaaaaattacgtgacacggattatgtgttctttaaatagcaatgcattctatttgatattttctttgggtagctttaaggattatgctgaaattataagttctatttctataaacttccaatattaaagaatatataagcaactgctttctctgtagctctctggcagctagtcaaagccatgttgttgtaggcaatattctatgtagaactttccataggaaaatggtattgcttctcagaaaatgtcatgacctgcactttccttgtggtcatcgtgggtgggggatgttccgtgtgactcatagaccagactcaaggatgagtttagcaaaggcccgctcccactccctcttgccaatggcacttgaaggaagtctatcatggttttagtttggctatagtatgatattatatttattacaccttaaaagaatgtctaagctcagtatggtggctcatgcctgtaatttcagcactttgagaaactgaggtgagaggatcacttgagcctagaagttcgagatcagcctgggcaacatcttgagactgtgtctctaccaaaaaaaatttaaaaattagctgagcatggtggcgcacacctgtaatccgagctactgggaatgctgagttgggaggatcacttgagcccaggagtttgaggctgcaatgagccatgatctcgccactccactccagcttggatgacagagcgagactctatctcttaaaaaaaaaaaaaaggtctgcttcattgatgctgtatatactggggcaatatatgacctaaataacagttctgtttatctattttttttcctgtttaggcagcaataaggaaagaactaaatgaatttaaaagcacagaaatggaagttcatgaagagagtcgacagtttacaaggtaggtgacaaaatgcagcttagaaattgaaaatgcttaagatgtgatcccatgttgagttggttaaaaaaagaaattgcttacaatggtaaattttatgataggtatatttcatcacaattaaaaaatgtttttaaacagtttagcttaaaaccatcttatgaacatttccgcttctctcacattcatccttgttggcttttaagaacctaatagtcaatgtgacagttttaaagatatgactagataagattgtaaatttctagaatttcataataaactcagctatctccttcaagaacactaaaactaatcatgctgaataagaatttctaaaattaaatcttttctttcaaggaagtctgaatcattccatggggctacattttggttcctttcttcgtttttttctgggtctgaagacatcatttattctgctcttgaacagacttagttgaagttgtatgcccagaatagatgctggcgagagtcagtgtgggcacatacataacactttggtttcacaatagacataacacaggattgaagctgacttttcagaagatgtaactttaggatgggaatcctgattttactggtgacgaaggagatcgctatcatcttaccatttttccctcagtccctttcggtttctttcacaggttacctaacccggtaacaaatattgatcccctaagctacagccatacatcctggtgccactgttcctgcagtcccggtgatgatggtactgtgtgctgggagcatgtcacaatataaaggaagttgctgtataacctccaactttaacagcaaacttccctgaaattgatgggggaggagtgaggtttgttatcatagacttgctccacagcttttcttcctatcttactgtcttgtgtgccagagaaactcccctttctttcagggttacagttggccttccatatctatgggttccccatctgtggagtcaactgaccacaatccaaaattttttttttttttttttttgagacagagtcttgctctgtcacccaggctggggtgcagtgatgcaatctcagcttactgcaacctccacctcccgggttcaagcgattctcctgtgtcagcctccaagtagctgggattacaggcatgtgccaccatacctggctaatttttgtattaatagcagagacagggtttcaccatgttggtccagctggtctcaaactcctaacctagagtgatccgcccacctcagcctctcagaatgctgggattacaggcataagccaccacacccagcccaaaatattttttaaaacaaatataaaataacaccacaacaataaaaataacacagagcataaaacgatactgtataatagctatttatacagcatttacattgtattaggtagtataagtaatctaaagattatttaaagtatacaagaggatgggtgtaggttgtatgtaaattctacaccattttctatcagggacttgaggaatccatggattttggtatctgaaggggtcctggaatgaatcccctgcagacaccaagagctgaatgtacttcttctttatttttttatttcctcctatatcatttgtttttatatacatgtagagcgttccaacatcctgaatggatttttatctatttgagggctttattctatcataatctactctgagaccaacaacatgtccctatcaagccagacatttttgtccccctcttttctcccttccacttctagggtcgggaaaaatgtatgctaaaatgtgacacctgtagttgctcttctgaagtaaagttgattattaaaaggtggaatattttgagtgacatcatgctggctggggcctccgggcaactgggaagatagagtgcttggtgcagttgggtcctgatccctgagctgcagtgactgcactcaacccatacattatcattcgggatagttttgcttctgcatagttttcctagaagttggagtatctgatagccttatcttcatttgatagcatgatataaagaacaaattacagtcaaaaggaatcaaattttaaaagtacatttttatggaagttctcattttatgaaaaataaatatttatactaaaagaggttctttctgttctgttgtactctatatgaagaagcacaataaaattggagtacagggagaagtaagggtcattttgtttttgtgggggtattttttgtttttttgtttgtttgtttgtttgtttttttagtagagatgaggtcttgctatgttgcccaggctggtcttgaagtcctgagctcaagcgatcctcccagctcagtctaccaaagtgttgtgattaaaggcatgagccactgcacctggcttcttttttatatatgtatttgtatgtacaaaaataatatattctaattaagcattcaagcaatacaaaattctattaagtataaatgaaaaaccttcactcctttcccaacctcatttctgttctcacaggtatccactagtaaaagcttgatgtagatccttttagatgtttttccatgcatttataaatgtgtgtatgtgtgtatatatatatatatattaaatatgtgtatgtacatgtatgcatttatatgtaccctctctcacacataaacacagcatctaagaaatctttctataataatatatatctcattcagctggatgcagtggctcaggcctgtaatcccggcacttggggaggccgaggtgggcagatcttttgagctcaggagttcgagaccagcctggacaacatagcaaaccctgtctctactaaaaatacaaaaattagctgagcgtagtggctcacagctgtagtcccagctacttggtaggctgaggtgggaggatcacttgatcccaggaggcagaggtggcagtgagcccagatcacaccactgcactccagcctaggcaacagaaagaaatcctgtctcgaaaaaaaaattatgtatatatttgtgtatatatatatttcatttgaatgactgacatttcatagataatatgccaaaaagttattgaacaattacactattgatggatgtttatggagttttcagtttttcattattaaaacaatgttgccttgactttctttatgcatatatctttgtgcacacatgccagtatttctgtggtagtcccataagtggatttgctaggtttctgggcatatacattttgcattttggaataaactattccattatcctccaaaaagagcacttagtttacagatctacagtttaagagcatgcctagtctactcactactcatgtggtcgagaggtttatattctaaaggatgaacaataataccccatttcattgatttctattagattgggcatcttaacatacctttattgatcacttattttttattatttgatttgactatccaaaacttctgaccagctgaggcaggaggattgcttagcccaggagttctctaccagcctggtcaacatagtgagaccccatctctagaaaaaaattttaaaaattagcttagcatggtggcacttgcatgtagtctcagctacttgggtggctgaggtgagagaatcgcctgagcccaggaaatggaggctgcagtgaggcatggctacaccactgcactccagcctgggtgacaaagtgagaccctgtctcaaaaaaaaaaaaaattatgtgatcaattttttgggtagttgtttgtcttttatatggattggtaacatcttcttagatatcatggatatcagccctttattgcctatgttgcaatattttttccaatttattgttaacttttaaactttttaatggtattttgtttaaatttttgtatattcaaatctatctgtattgttatgttttacttcattgttttgtgtcttatggacggaggccaagagtataaaactattatttttacctgttatctatgctttggagaggtgcatttatttgtgtgtatgattcagaaagtaaactaactttacttttttctaaatcagtagttgattctctcaatgccacttttttccctgtggatgtgaaattctcttttaatatacacatcggtcaatttctggattgcttattatgttctaatgagctgtttgtctatccatgtctatatcctactgtttaatttggatagatttgtagtgtacttttatatttgatggggcattttttcaccctcaaaattctattggctattttttttatttactcatctagagaaatttagtatatgcttcttgtatttcataaaagtctattgatatttttattgcttatgtaaatataaacagatgcaaatatataagctttcagggagagtaacagctaatatcaagggtaaattttaaaagttctccaaaacataaattgattaacactctttaatacctttccagataaggaaaaattaaatattcatatcaccaaaataaatatgccttgcttaagtattcttaaaccttggcagtaaagcaaatgttactgctatttttccattaacttatgacatcattcgagatatattccagtagggatatagtttgtctccaagacataaaaataatgcttatgattttcaagctgttttcagtaattcttttaaggggaaaaagttctggtaatcactactctttctaataaaaataatacaaaaacatgatccagttttacatttagcaaattgttcataaaaaaggtggtggtactcttagtaccagcctctcttggggaaaataaacaccttatgaatcattaccttgccctttcaatgcaacctagatacacagcagctctcctttcctcttattagcatgagacattgtctccttataccaagtaaggcttcccttcaaaacctcaatctgtgaactccttgcagatttggggtggttaataaatgggctgactcctcttctcgggcacctctttatctagaggccatttccaacccagtgatgtactggtgtacaatggaaggacccacttctgtatatagcttcctttgcttctctatctccggagagagacacaagctggtggccaagggcaggcatgggagggagacttctcacaactcacccttttgaaccttttgaatttttgaaacattatgaatgtattacctagtcaaaaacaaacatttaaaagaaaaaataaagaatccattctctaagtccttgtttctgtaaatgaagattacgtcgtggtggcttttcttgactaatgtgttggcactaatattaattgtgacacttccacgtcttgtgcactgagggggtacctctgatacttctgtcatggaatacattccatgacatatttggtctgtagtgatgaagaactgtggtgctctactctttcatctaattctcccagtttctcccagtattttccagatggtgccctggaattggaatggatgctagggcaagaaaggtagggacaaatggtccccacaagaagtcatcccgtggccctataggtaccaagccctaacctcagttgcttagaccttgctgcttgtctggccacattctgcattttctacccctcaacagtgcccactcagcccactgttcaaaaccaaaaagtccatttgagggtgatagatcattagatagtatcattgcattctcgaaggagaccaacatggcaaacaaaagccacttccttttccatagtaaatggaatttctacaatataaaataactctctaaattctaaagataaattgcatgaaaggtcaaattttacttaagttctaaactgtaaagtagttacagctgagcagtaagattttgagtaattttaattttcctttggatatttattctctgttttcccaacagagaaagtgttaacatgtatcagatttgttatcaagagagaatatcgctttttaaaaataaacttctcattttgtaaatgatgacatttttggagtatacaaagtagtttcatatttgtatcagcttgtaaattatttacttcttatattaaggagtcttactgaagactcatagaatcattgaattgaggctcttagagttaaaatgagccgcaagagatcattggcataatgtcaagtgggaaagtcaggatattgactaactgtagcagcagtatattttatttaaaattcagatgcagccgggtgcggtggctcacgcctgtaatcccagcactttgggaggctgaggtcggtggatcacgaggtcaggagattgagatcatcctggctaacacggtgaaaccccatctctactaaaaatacaaaaaattagctggcgtggtggtgggcgcctgtagtgccagctactccagaggctgaggcgggagaatgccgtgaacccgggaggcggagcttgcagtgagccgagatcgcgccactgcactccagcctgggcaacagagcgagactccgcctcaaaaaaaaaaaaaaaaaaaaaaaattcagatgcctggaaataaagattaggaaataacttcaaaaattcttagtgctttattatagagtggggttatagtaatctttttttcttttatctacttttcaaattttcttaatggtaagaagtttttcttcatgttgagaagtttcttaatgttgagaagttttctcatgttgagactgagatattcacatacagtgacccttgaacaacctgggtgttaggggcactgatccccactcacagtcaaaaatacacgtataacttttgattctcccaaaacgtaactactaaaacctactggtgactggaatccttactgataacatagtcaatcaacacatattttgtatgttacatgtgttatgtactatgttcttaccagtaaagtaggctacaggaaagaaaatgttactttaaaaatcataaggaggccaggcacagtggctcatgcctgtaatcccagtactttggggggccgtggccagaggatcacatgaggtcaggagttcgagacgagcttggccaacatggagaatccctgtctctactaacaatacaaaaattagctgggtgtggtggtacacatctgtaatcccagctacttggtaggctgaggcacaagaattgcttgaacctggaaggtggaggttgaagtaagctgagatcgcctgggcaacagagtgagaatctgtctcgaaaatagtaataataataaatcataaggaagagaaaacatatttactattcattaggtggaattggataatcataaaggtcttcatcctcatcgtcttcatgttgaataggctgaggagaaggagggggttggtcttgctgtttcaggggtggcagaggtgaaagaacgtccaattataagtggactcatgcagttcaaacccatgttattcagaggtcaactgtatatacgtatggacacatagacatacacactttttttttttttttttttttttttaagacggagtctcgctctgtcgcccaggctggagtgcagtggcgccatctctgctcactgcaagctccgcctcctcggttcacgccattctcctgcctcagcctcccaaatagctgggactacaggcgcccaccactacgcctggctaattttttgtatttttagtagagacggggtttcaccgtgttagccaggatggtcccaatctgctgacctcgtgatccgcccgcctcggcctcccaaagtgctgggattacaggcgtgagccaccgccgccggcccatataagtattttttaaagcaatgatctcattctatactttcttgaggtgttactatcctatgtgggtttacggttaaagtaaaccactcttttcagcttctagatatgcttatcaaaatatgacatcacaggaactatacttgaaactgcaatgaaaattaataaggggtcctccaccgaggaatggaaaggctgcttttgtagtggcactgcctttcatggatactccatttacttgctacctggacagaaattaaaagagttgcaaaatgctgctttaactactaccagagttgaaagcaaggctcagtattgggaatgataagagcccagccagtgtgtggtctagcctctcaggtagaacaaggagctgtaatttaagagagcctcttcctttgtttaacataagtatatgtacaggaggatcccctgagccccagagttccaggcagcagtgagctatgatccggccactgcactccagccgtatgacaaagccaaaccctgtctctttaaaataaataaataaataaataaaatttaaaaataataagtataggtggcgtgacaatgaaactcttttaaagaaaaggggaatgaattatttaggagttttatatctatcaagtagggaagtacaagaaagtaatattttacctttgtgagtaattatatattttatgttatgtgaataaatttacaggaagggctgggcgcagtggctcatgcctgtaatcccagcactttgggaggccgaggtaggtggatcacctgaggtcaggggttcaagaccagccttgccaacatggtgaaccctgtctctactaaaaatacaaaaattagccgggcatggtggtgcatgcctgtattcccagctactctggaggctaaggcaggagaatcacttgaacccgggaggtggaggctgcagtgaatcaagattgcaccactgcacactagcctaggcaaaagagcaagactctgtctcaagaaaaaaaaaaaaaaaagaatttataggaagatgaataattttttaaaattaaattataaaggaaccgcctttattgaaatcattatctttatctgaattccataacttaaaaatagcttttcccccattccctccctctcaacagtatgaaaataagaaaaaatgtattgcagttttaaaagaaagaagaaaatatgtatgactttagattggagtctcaggaaagttctgaaaagagggtggacaaaaggcttcagtatccttagggcacagtaaatctatttattcctccaccaacttgaagcctaaagccaaaactgtcatgctgtcacatagacaaacttctcaagacgtaaagctgaacttctcctaccttaaaatgaatgcaaactaccgagaaatagcaaaataccgagaaataacaaactgaagagtattttgcattttcagtacctctaaccacagcgttttagagctgaatttgaagataagctgagtaatttaaacaggataaaagtgtcattttcagattggatagagcaggaaaatatatggcttttgttttccttctggttgttactttttaccgaatctgggcaatctatctaaagaggggtcatagttctgacctctggctttgtgagcatattattgcacgcacggtatcaattggtcaccttcttttcctagccagcccttgaagctgtgttggtggcctgtgaccttccaatgcaatctagactgtggaactcactgtgtactgcgatccatgggcaaatggtgtgtgcaggaaaaaaaaaaaaatcttacactgtcctcagttatttttgaaaattaaatacagaatactttccaggataatattgggctttcaaagattatctcttctggctgggtgcggtggctcatgcctgtaatcccagcactttgggaggctgaggcgggaggatcgcttgaggccaggagttcaagaccagcctggtcaacatggcacaatgctgtctctacaaaaaatacaaaaattagccaagtgtggtggcgagtgcctgtattcccagctacttgggaggctgaggcaggagaatctcttgaatccaggaggcagggtttgcagtgagccgagatcatgccactgcactccagactgtgtgacagagtgagacggtgtcccccccaccccccaaaaaagaagattatctcttctggtccattgactactccctttgttatccaacccaaaatttcatttaccttcttcatcccacagacattaccaatggagagagaaaacatcaggtttccttatccttgccccttgaattcaagattagatgaacatctgaagattaggacactgtggaatgtttggtacgcaaagcccagcagatttggcgagggctaaataattgctaagttagatgagcttttaactaatttttagaaaagctgaaccttagaaagataggcctttggtagctcatggtgtgagggtcctggaggtacaatgcactgtgttgtcagggctccctgggttgctgctccctttctggagtatggacaatgctggtgtgccctgctcagagggagatgctgctgctagtttggggtatcactggatgggctcttcaagtcattgtgaaaagtttaagaatagactgtagcaatcaaagtgtgacctgagagggtggaacaggatttttctctggtcaaaattgatcagaacttgaatggataatgaaattgtggtatacatacacaatggaatactactcagccacaagaaagaatgaaattctgtcatttacaccagcatggatgaacctggaggatattatgttatgtgaaataaggcaggcacagaaagataaacaccacacattctcacttacacatagaagctaaaaagttgatctcattgaagtagagagtagactagtggttattagaagataaagagggtaggggaaaggagatagggtgcagttggttaacagatacagctagatgggtggaataagttctagtgttctatagcactgtagggggactatagttaataatttattgcatatgttcaaaaagctagaagagagaattttgaatgttcctgacacaaagaaatgataaatgtgtaggatgattgatttgctagtttgatcattacacattttatgccatcaaaatatcactctgtaccccataaatatgaacaattatgtgtcaattaaaaatataataaaataatcaataaaaaatttaaataaaatttgattaaaatggacagaggtagaaattcagatgatcaccttttctattccatgctacccagagaacaccagaaaatcaccccttcaaatagaagtacagatgaagacatgttttgatctcatactgaaatgtaggttaggaagacagtctggagcatagcgcgtccacttaccagctgtctctctctgccttgggcaaatgagttagcatccccatgcctcagtttccacatctgtacaaagatgatataggagtactttcatcgtaagattgttttggggattaaatgaggaaatagatgcatagcacttggacttgtaagctctggtaagtattatattaggattgttattattatctgtgtattagtccattctcatgctgttataaggacatacccgagactgggtaatttataaaggaaagagatttaattgactcacagttccatgtggctggggaggtctcaggaaacctgcaatcctggcagaaggcacctcttcacagggcagcaggagagagaatgagtgccgagtgcagggagaagcccaatcagatctcgtgagtactcactgtcacgagaacagcatgggggaaaccactcgcctgattcaattacctcccaccaggtccctcccacaacatgtggggattatgagattacaattcaaggtgaggtttcggagggaacacagccaaaccatatcaatttgcctttcacattgtatataaaatatttgatttaagaggttttcagttactctttgaaatatttttatagaacttccatattttgcttcaggttgtggttgactcttcctagaaaacattttggaatgtcctgtcaggtgggttattgtatattagtatacatttacttgtaattaagtttaggggcttctgattggactcctcagtcatatagaattatttatagagctaacaaataacttcctagatacccctgtgtatatgtgttcagtgacttatgcattcaacaaatagttattgagcacatccctagtgagccagattgtgttctggaccctgagagtttaggacctgtctcataaggtcctcaggtggttatgttccagtagagaagcaaactattaccaagtcaacaataaatacacatgagcatttcagatagtgctaaggactgtgaagaaaaggtaataggacaggggtgggtatagatccgatggccaagaaaggggtctgtatctgtctgagttctccagagaaacaaaaccaataagatatatgtatatagatatatgagaggggatttattagggcaattggctcacatgataatggatgctgagaagtcccagaacaggctgtcggcaacctggagaccctgagatgctggtagcctggctcagtccaaggctggaggcctgagagctcgaggcagtggggagtactggtgtaagttctggagtacaaagggtggggagcctggagttgttgttcaaggacaagagaggaagagcatgtatcccagctccagtagatagattgacatagtctccttttctctgtttttgtcctctctggctctctggcagattggctgtggccaccgacactgagggaagatcttccctacctagtccactcagactcacaagccagtccctgaaaacaccctcacagactgtattaggccattcttgactgctataaagaaatacctgagactaggtaatttataagaaaacaggtttaattggctcacagttctgcaggctgtacaggaagcatagcagcatctgcttctggggaggcctcagaaagcctccaatcacggcagaaagcgaagggggagcaggcacatcacatggcaagaatgggagaaagagtggaggagaagtgccccacacttttaaaccagacctcgtgagaagtcactcaccatcacaaagacagtaccaagccatagggatccacccccaggacccaaacacctcccagccccacctccagcattggggattatattccaacatgagatttggcagggacaaatatccaaactgtatcattttgaccctggctgctcccaaatctcatgtccttctcacatttcaaaatgctttcccaaaagtcccccaaagtcttaattcattccagcattaactcaaaagttcaaaatctcatctgaaaaaaggcaaatcctttccacctatgatcctgtaaaataaaaaacaagtaagttatttccaagatatggtggagatctatactgggtaaacattcccgttcccaaagggagaaatcagacaaaagaaggtggctacaggccccatgcaagttcaaaacccaacaaggcagttgttaaatcataaagctccaaaataatctcctctgactccatgtcccatgtcctgggtactctggtgtaagtgggcagctctacccctgtggatttgcaaggtgcagcccccaggctgatctcacaggctggcgttgaatgtctgtggcttttccaggcacagggtgcaagctgccagtggatctaccattctggggtctggaggacagtgacttccttttcacagttccactaggcaatgccccagcagagaccctttgtggaatccccaactcctcatttcccttccacactgccctagtagaggttctctgtgggggctgtgcccttccagtaggcttctgcctggacacccaggcttttccatgtatcccctgaaatctaggtggagtgtctgaagcttccatcacttttgcattctgtgcatctgcaggcttaacatcatgtagaagctgtcaaggctttcagcttgcaccctctgaagcagaagcctgagctgtatctggggccctttgcgccaaggctggagccaaagtggctgggatgcagggaacaatgtcctgaggctgcacgaggcagcagggcccttgacctggccctcgaaaaagtgaaagagtgatgttgcctctgtgtatcaaatgcaggcatggcggtcctcacatctgcccaaggttacagtcagggatagactaagaacagaactcaaagtggacacattcctgctttagtaataaattgcctaccagttttgtaaagcttggtatatcttatttttcttttgacttttgtcaaacacagaagtaatataagtccctcgtatccaactagcagctcctcagttatcaattcgtggcccatctcatttcacctgctcttattttttagtttttcattttgtaatgcttgtattcaacacagtgacgtttagtaagtactatcacgtgccggagattgtattcaatgagtatgtaaaaatggataagaaagtttccttcctcagcttctcatgatccaatagcaaaggcacatgtatccaaagattatataatgtaagcaataactggcataagccaaaggttatgggaacacaggaaagagagcaattagtgcttccctgagcagtggagaaaagagtttggagaactcacagagtgagactgcataaagcgcagatggtaagagagataaaggtagaagaaagagtaggccaggtgtggtggatcaaacctgtaatcgcagcacgctgggaggccgaggacagattgcttgagtgcaggagtttgagaacagcctgagcaacatagcaaaaccccatttctactaaaaatacaaatattagctgggcatggtggtgcatgcttgtagtttcagctacttggatgctgaggtgggagaatcacctgagcccaggaggttgaagctgcagtgagctgagatcgcaccactgcactccagcctgggcaataggagtgaaaccctgtccccctctggagctccccccaacccaccctgcaaaaagtaggtagaggaaagggcattagcgcaaaagcctttttggggcaagtgattgaaatggagagtatttggaagcagtgatagagatatagctagaaccatgagttgggccactttctgaaaagccttacttgctactccaggaactttaaattttattttgttggctttcttattttaattttgttaagggacagggtcttactatgtgcccagacttgtcttgaactcctggactcaaggctgtcctcccacctcaacctcccaagcagctgggattacaggtgtatgctaccatgcccagcttaaattttattttgtaggtaatggggaacaatacgatccttttgagaaagaactgggttgggcgcagtggctcgtacctgtaatcacagcactgtggaaggcaaaggtgggcaaatcgcttgagaccaggagttcaagaccagcctaggtaacatagcgagacccccatatctaattaaaaataaaaaaagattttaaaaaccccaagaactgaaatgatggaaccagtatttttaaggatagtgtgagcaacagtgaggagcatagatttgatggagagagcctgggacagggaaaccaattaggagactggctgaccagagcagatgagcattcgactgtagaagacagagtgaaatgctaggcagagttgcataaatgtggaattgcagaagtaggctgaagagcttgatcacttaaggctttatggagaagataacttttgaccttgatcttgaaaatgaaaacatagataggaaatgaagggaaggaattgcagtattagtgaacagcatgttcaaaagcaccgggctacaaaaatgcaaggaatgttcaggaactcacaaggagggaaaggaagccagctggctggctaacaagcataccgtaaaagtagtgccagcaaaagatggaactttaatgattccaagacaggcagttgaggcaggacttggtgactaataggaaatgctggatgagggagagaaatgaattgctaatctgaggtttctagaccaaaaatatttttaaagatagaatattaaataagacaaagtgcaaaggcaggttaacaaggaaagctttgtatagttgtggacatgcttagtatatacctgtggaacatctggggggaagcgccctgtgggcttttggaaattcaagtgtagaaagtagatttggagtcgtcagcaggagatgatgagaggctgaagctaatgaaaaagtgtctatttgttactgtgcttttataatacagacgaggtgtaccaaaatccctttgtgaaacatctccctctgcttgataaaggttagagcacgatgctcaagaatagtgatgttttctgtcttggttgctgtgtaacttgaatactataaccagcatcttttatataaggtttccttatatgcttatatgtaaacatatatataaggaaagcgtttatatatgctttccttaataatatttgtaacagtattttgttatgacagaaatttgtaaacagtaattcagttgggggatatctggggtaccttttcattgtaaacatgaccacgccttattcagctcactgcatgcagaatgtgctcctaggccacaggcttatagtttctatttcttactccaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtaaaaaaaaaaaaaaattagccactgctagtctactgtttaggtaatcggaatcaccaattattttattagaatgatggcttgagtaaaaagctgtggaaagaattaaaggattatgagctaagctgtattttgcagaatatggttctattttagtagagcagagatgagacatatccccaccggccacccagccagaggtctcctacctgggggccctaaagggatgcagaggtctggcccaccctccgtgcataggcacctctgtccaccaccagcgtttcagcaatccaaccagtaagcatatgctgtataggaaaaataaaagtgtgtgggaattggatttcttttgttgtaacacaattccaggtttttggctatttaaagtttgacattaggctgacatcgaggaagtaagtgggttttcctgagttcccaagatatgattaaggaagaaaacaaacccatctccaggaagatcccaggcaggaaagaactagacagatgtagaaaccaaagtgaccattttagtttttttattggagaataaaacattaatattagggtattaagaagatgctcagcaagcttgatcagaatcttcatggtcattaccaatcagtctgacaaaatagttctctggtagtcagcattcatttaaggcagcttgcctgataatttcctgtgttatgtgaagtgtcttgcactttcacatgttagctataattccttaaattacttaactgaaatctgtaatagagaaccattttggcatttgaacagctattttacatggagaaaaagcaaacacatctgtttgctttacccagaaaaactgactttctggtttcatcttcatattgtttagtagcataatgagagtagtcctttatctttctctaatgttagtaaatatattctgttagtaggaagttctgaaattgaagggaaaatatatttaaggaaataaaggaattcaatacacccttcaaaagtcaccaaatactgaaaataagagatgagtccttaaaacctgagtcaaaaaaggtccagttttacagcctgcaattaattcagggctgcgttggcattaaaaaagaaaatatatatatatatatatatatatatatatatatatatatatatgtatattatatatacagtagcttacacttaaaagaggaaaaatttgcattaacattgcatattctgatatgtaccatattaacacataacaggcattttatttatgcttcatagaatcagacagacacaactttcaaaaatcttactgtattcacaatagaaaagggtagtcttgtctaccacagaggagtatgtccacacttaataatgaaaactttcttcctttcctgcccaaaaatttcttcagtctgttattatttttaagtgccccttgctgcaaatttcaaacagagcaagaaatcttcctcagagtaggtggtatgaaattaaactagtacaatatatatgaattcatgtcatttacccctgagtatggtagaattgttaaagcattcttaaattccaattatatgaagcctatcattactaggaaaagtatattctttgggataagaattaatttcttcacactattagagcatgttgtgagtagtaaggaactacttagatgcaatttatttacagaattgtcccttgacctcttgaaatggctagatctttcactactgtgtaggtagtctctacttactggtaggatagattacattgctttactggacaaagcagaatgaacttatataactaaaatatgtcctatattggctgggtgcggtggcttacacctgtaataccagcactttgggaggccaaggtgggtggatcagttgaggtcaggagttcgagaccagcctggccaacatggtgaaaccctgtctctactgaaaatacaaaaaaaaaaaagtatctgggcatggtggcttgtgcctgtaatcccagctacttgggaggctgaggcagggaaatcgcttaaacccgggaggtggaggttgcagtgggcccagatcgtgccactccactccagcctgggagacagagcaagactccatctcaaaataataataatagtaataatgaataaaataaaataaaatatgtcctccagggaaaagcaatgacagagtaatcaccaaattaataggaacatctttctagagaaagtacatgcccagttagttcaaacccaggtttcaaagaagtagcactgggctctactgtaaaggcaggcagtgaccaagaggtggtggggagagaggtagagtaccctcaaatcattcccattttcacttccaatttcccttttgtaatcattaagcttaagctatgtatggaaatgcaaagcaccattagcatttctagaaagcagctggaaccttacccaccaatgcttttttgaagacagtatcatcccaaatttaaaaatcctattgtatatgttgtaaaatttctggcaaagaaatggaggatcctgtggcagctattcccacctaaagccaaccctataaggatgggtcattttttagccatgctaggatttactgcacacacaaaaaatgtcatttagcttgtcacattgctagcacagctgcacatatgagcaaagcactgttggtctgtgtttctcagtgggggtactcttggcatttggagctggataggtctttgctgtacagaatcatcccatgcattgccagatgtttaatatcccaggcccctgctgactaaatgtcagtagcattctcagtcattgtaaacaccaagaataaaaagcattcccccaggttcaaatgccctccctgggaggttggtatcacctcccctgaatgccactgtctactgcattttgaggacacagggagaaaaagtgcctatcctcaaacattgtctctgctgccttgcatttctttgggccctgaatggtttttctcccttcatttttcgagcctttctctcagtgcagctgttcttcagggaggaggttactgggcagccttggccattcagtgggcatggggacttggcctagtccctatatatatatacttaaagtccctatatatacttaaaggagagatcatacatgaagaaagcttttttttttttttttttttttgccttacaacttttctttagaaccacattattggtcataatccttgttactgtcatgaggattgttgcatgggttaaacacaaacacagactagcaatgcacttgaacaaacctggtggtctttggaaataaatcaccattagatttcacctggttatgctgcatcccataagttccaaatgaatcacctgcttatcctattaacgaagcatttaattcacacacaaatgcttgaatttcccctgtataaatgtagtcatgcgattcaacttttctaataagatttgtgaatgctgcatcatgatgaaaatgtggattaactgtgggttgcatgcctgttgttcatacttcagtgatggtcacacacaaaacaagatgagttttacttaggtgaaacattattaaactgtactaacaatacagaaacatattctctttgtcgctttttatcaccaaaactgaatggcaaatatgtcttgacattacttggatgaactgtggctagcaaaatggaattaacttagccactataattttttaaaacattaaagtttctaaattgtttttggggccgagtaacgcagagtcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttcttttttttttttttttttctgtgtaacagggatttttaaataacggactatatgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatccccagttttagtttgttccagtttctcttatatttggatagtgctcagcctttttaaatgaaaaaagaaaaaagagtaagacaacttccctaattgcctgttatttcagcttcacctaagtttttaacacctctttgtatgtaaggtcttgagacatgtaaggcctggtactttttatttaaaatgtctgtctaaagaattactgctcttaaaagaaacttccagtattttttttaacttgctatctttttatgtctgaggtatttgatattgatgtttttattgccattattatatgtaaacataaaagatagtccatttagagtttataatatagaaaataaacagacttcctcatta

SEQ ID NO: 2416 - DNA, 223007 bp, Homo sapiens; identical to SEQ ID NO: 2415

SEQ ID NO: 2417 - DNA, 87056 bp, Homo sapiens
agctgcataaggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaagtgagtggcgcgcggcgggcgctgcagcccgcgccccagagttccggggaacccgccagcccgcgccccctgcctccacgtgtctctgcggggcgctcgggggatgctcgccgggaaggaggagcgggccgagaagtggcttctgccttttcgggtcccgggaacgtgcctggagcttgtgcgtgtaggcgagggaaggcggaggaagggcggggaggctgagggccggcttctgccttccgcgccagatggcctctgcagctccgcctcgggctgccgcctgcggggagcagccccggagccagcaggcgtccccgggccactcccccaggtttccccttcgcgtccccgctgggtcgacggtcgggttcgcgcgcctgtccttcctgttagtcagcttactcatctgtggcccccagagtggcttgggtcaacgtgtaatagctaggggtggccgggtgacctgacctcccctcttcctggcccgggcgacctggtggagtgggggtccaagggcaccgtgggcctcgccaccataggctctcactaaatctccgttgcgggactcagggttgtgcgttttctgtaaagctaggttttttggtgcccagatgttttgcaaacaagctcctatgctaaatactagccagcgacagctaaccttttcgccggtttcttccttttttggaggcagcatgccgtgggaagcacgagttgggaaaagatgggaagggaacttgtgccagtttcgccagctgtagccgtgttttttgggaggccttcccgaaacggggcacgtcggctggactgaggagcccggtgctagagcccgcggcctcctggcactaggagccgcaccaggggagccgggccaacccggccacgctcacatcagattacagaagattgtaatggcacaaatttgttgcttttagaaaacaggcgttcgccaaacatttctattaataccggactgagacctagagactagaagcaagaagaatcgttcaggggccggatgataacttcttttggtggatgtgggagggtgcaatctgtcagggtggtcttgccagacctcttaagtttagccactttctgaagtaaaattctttctaaaattcggaagttctagtcttttcaggctcttaagtcccaaaccaggaggaggagaggagacggtgaagggtaagctgaagtcaagtgcccttattcagtaaccgcagttaatctcaagtcccggtgccatagttgtccgtcttgtattgtttctaaggcttaaggccccactatttacgagtcactttgagtgggatctcttactttcagcagagtgtgttctgagagcatgagattgctgtgaagtttggaagttggaaacgccctctcctcccccatgcccaccctccctgggttgtagaaaaattgcatttgcttatgctttttccatttttgctttctctttcttggcctctctcttccccttctccgttttgcattttctcctttcatttatgttgctttcaccacttgacatgaaaaggaactcatggtagtttgaagtttattccagaggtgtctgctaatctcctgaaaactggctggttcttggattctccaggggtgagatgccacaagggccaaactattcaggtttgaattgtatgagaatcctttagtgctttaaagagtaaagacatcagtttttttctaggtttatatgcatttagcgtttctttttttttttttttttttgagatggagtctcactgtgttacccaggctggagtgcagtcgtgtgatctcactgcaacctcagcttccctggttcaagcgattcccttgcctcagcttcccgagtagctgagattacaggcatgcaccaccacatctggctcatttttgtatttttagtagagatgggatttaaccatgttggccaggctggtctcgaactcctggcctcaggtaatctgcccgccttggcctcccaaagtgcagggattacagatgtgagccaccgcccccggcacatttattgtttctatgttgtatgcaatcatttatgtatcatctagcatatatattatactcagggtagtattatttagcatttagaattagtctaacattaatatgtattttgaaatatcgtgttggaaatcaggacaggaagacatagttcgtggttgaagagcttcatatgtgtatttgaagctttattgcctgcatatttttcccttctaacataacacatgtaaggtgctgagttgtagaagttatttgccaggcagagaaagtgttctaaactacgaattttagtgagcattgtggtttatttaaagaagtgatatgaatgttttaaattcctggtaagattggtgaattagggaagtaaaacatcataaatataaagcaaaacactcttaatgtagaatgttccttttatctaacgttagataagcctttttcttcattttcatgctgatgattataagaataagataagcacttctgacatacatcatagtagtgaaatttatcctttctctagagagatggaaagagaggtattgctagaaggatctattagagatacagtgattttttttttttttggatgctgtaccacctggtggaaaagtgagaaaaatgaggtttctagatttcttgaaaatatccggagaaaacaagatgtttgtggtaaatgcagaatggggagaaaggggtgagggagcgggtggactggaaatttctttcttctcttgccaggcaagggaacatagtgcaacttctttctatccccaacagtaacaaaaaccttataaagaaaatgttttcattttttttcttactttaaaccccattcttaacaacaagaacaacaacaaaaatggaaaagggttaaaaaacctgtctaggccacgtgtggtagctcatgcctgtaattccagcactttgggaggctgagatgggaggattgcttgagcccaggagtttgagaccagcctggacaacatggtgaaaccctgtctctacaaaaaaaatgcaaaaattagtcaggcatggtggtgctcgcctgtagtcccagctactcgggagactgaggtgggagcattgcttaaggccgggaggcagaggttgcagtgagctgtgatcgcaccactgcactccagcctgggcaacagagcgagaccctgtctcaaaaacaaaactgtctaaaagatataaagggaacgaacatatgacgttttgtggcagtttgaatgtcatgtttattgtatccgcagggtctcgatcagtacctgatatacagtagttgctcagtgaatgcaagctgaatgaatgaatgttttcctgatttgatagtaactgggtctttaccatttctttttttttttttttttgagatggagtttcactcttgttgcccaggctggagtgcaatggcgtgatctcggctcactgcaacctccgtctcccgcgtgcaaacgattctcctgcctcagcctcccgagtagctgggatcacaggcacctgccaccatatccagctaaattttgtagtagagacggggtctcaccatgttggccaggctggtcttgaattcctgacctcaggtgatctgcccgcctcggcctcccaaagtgctgggattacaggcgtgagccaccgcacctggcccctgatctttaccattttcaaatgtactgtatcttatggtgctcccaaaaactgtatgaaacattaacttaatgaaagggggaggtattatttagtgattgtataaggcccacacctagatagcaagaaggctggaactcaggttttcagactcaaattacactctctattttgttactttttagctataaaaataattttatggctccatattccctttgcaaataaggacacctaaaatttaagagtttcttaaaatttcttttcttttcttttttttttttttttgagatagattcttactgtgtcacccagactggagtgcagtggcaggatcttggctcactgcaacctccatctcccaggatcaattgattctcatacctcagcctcctgagtagttgggattacaggcacccgctgccaggcctggcttttttttttgtattttagtctagatggggttttgccatgttggccaggctggtcttgaacttctgaccttaagtgatctgccctccttggcctcccaaagtgctgggattataggcatgagccaccgcgcctggctgtttcttaaaatttcaactccctgacctgcatatagtcatgacagtgtttataatttgtatttgtggattcacgtatttgtggattcgctgtgtttcaaaggatccacctaatcattgttttcagcaaaaccaaaaatgtggacagttgtgtaatttattatttgccttcttgatttcccaccaaaatcaaactacctgtaaatacaggacacattcagatttccaaagaatagaaatggtctaaagttataatctgtcagagtgtgtcttacctcttagctaagctacctctcctcctgagcctttggtagttcatgggaataaggaaatgagacagtatttttgctttagaagtagggtagtcaagaagtcttgagaaacgtgaaattgtcttctgaacaacccacactttaaaaaaaattgcgctgaagaattttacttcagtaagtaagtctattagactccccatagcaggcctcaacttcaccctttcggttttctctttcttattcaaatatttttgtgcctcaattatttggttgtgtcttattgctagaatcaacagtaatgagctgcactcttttattagtgtttccattagaagtttagagctagatcactggggtaaaagaatagtggtttatgacataataggtattttgactctactagcctttttctttttttttttttgagacggagtttcgcttttgtcacccaggctggagtgcagtggtgtgatctcggctctgcaacatctgcctcctgggttcaaatgattctcctgcctcagcctcccgagtagctgggattacaggctcccgccacagtgcctggctaattttttgtatttttagtagagacgggctttcaccatgttgggcaaactggtctcaaactcctgacctcaggtgatccacccacctcggcctcccacagtgctaggattacaggtgtgagccaccactcctggcctatactagctttttaaatgctgatttttaattcccgtattatggggcataaacattttcaccagacattttgcctagggcaaggtgatttacacatcttttctgcatgtctgatatgttctgttcttacacgatattaatccattggaattttgtgtttgtgtgagcaagattcacaaaggcatattcctttaaatgaatttcagaagaaaaagtttccagtcctataaagcctcatatttgagtagtatactccttatcccatttcttcttctggccaactcacaagatttggaattatttggaaagcagtgacacaaaacatttttgaaaagaaaggctaaaaatatccaataatgtggttattctttttagacttcctttggcagtcagtgcatgtcatacggttaacattctttttctgggagaaaaaaaaactgagtctgaccaaatactttctagtgtggcctgatcaccaactcttagccctgggcattagccctcgcattttccacccccaagtctccaagcataagtagctgtctttcaataaaggccccagtttgaaacgtgtatttcactcctaatttggccaaaggccattggctagcagtccctcttcagaggggatggtgaaaagacagtaggatatatgataaatgcatgcaaaggagcttctcttctatatgacaagtcttggctaacttagcctctttgcatcttcctctgtttgaagagctacacacatttgccttgtaggaagtttttattctcatggcaagcaggcattacctctattacaaggccccgcttattgttcaccctgtgatgtaagagcttttaggactccaacaatattagccttctctttaattcctttcaggccccatcgccatctcagaaccatggcctggagttgccgccctccattctccttaacatgtcgactcagaaaagtcttaaagcccgctgttctttcccttcatagcaaaaattataatttatcattatattttgtttaatgaggacagagactagcattttttacctactacataatataaatgcttggcacttaaggtgcttgaacaaatgaaagcctgctcattttggatggatgtcccagtatttggtactgttagttttcctttatacacaaatgtacacaatgtctccccctttccaaactagaccataagccttcacagtatcttacaggtagtagtgatttaaaatgggatgatattggtaatatctgtgattactggttaagcataactcactttatatactttccccttgttttaagaaaactcatcatttattcattaatatatttagttgacaatttattgtgtgcctcctatgtgccagatactgttctaacctctggggttagggtggtgaacaatacacagtccctggcctcttttggcaatgtttttaaaaagcttacccaataggcaaatgaaaatatctctctaatttttccctaaagagcttgctcctttagtgtatttgaggaaactttgaaatgtagtttttcaggaacacacctattttgtagtgtggtaaagctatacattgattgattgattggttgagacggagtcttgctctgtcacccaggctggagtacaatgatgcgatctccactcaccgcaacctctgcctcctgggttcaagcaattcccctgcctcagcctccccagtagctgggattacaggtgcgtgccaccacatggggctaattttttatatttttagtagggatggggtttcaccatattggccaggctggtcttgaactcctgaccttgtgatctgcccgcctcggcctcccaaagtgctgggattacaggaatgagctaccgtgcccggccctatacatctgtttagatgggaatgttgacgtggaagtgtatcacttcctgttttacgtccctgtgtaaaacaatcacatttccttattgatgactgtcttccaacagaaacgtaatcatcttcaaggttagaaaatgttttttaaataacttcaaccagcgttaaccaaactggttaattcaccaaaatgttaaccaaaattaaccaaatcaaatttggtttattttccaggtctcttttttcttttcttttttcatttttaaagagatgggatcttgctatgttgcccaagctaaaatgcaattgttattcacaggcatgataatagtgccctatagcctcgaactcctgggcccacatgatcctcctgccttagcctcctgagtattccaggtttttcttaatagtttaaacaggtagttctggtttggctatcagtagtgttgtcaaatagcttttgtttgcttaattttatttttattttttttgagacaagtcttgatctgttgcccaggctggagtgcagtggcgtgatctcggctcactgcaacctccacctcctgggttcaagcaattctcctgcctcagcctcccaagtagctgggattacaggggcatgccaccatccccggctaatttttgtatttttaaagtagagacggggttataccatgttggccagactggtctcaaactcctgacctcatgatctgccctccttggcctcccaaagtgctgggattacaggcgtgagccaccacgcccggccttttgtttttgtttttgttttttttaaatggagagggccagataatgctctaggaaggatgtcagaacccataaaaaatgatgagtatttgaaatatatgtaaaaacttaagtaacaaatcagaaaatatattctgagatagaagtgaccattctaaaactgtgctgtacaatacagtagtcactagctacatgtagtttttaagcaatcgaaacgtggctagtctgattgagattgctgtgaaaaatacacactggattttgaagattagaaatgtaccctaaaacttaaagtataataataaaaaaaaagaaagaatgtaaaatatgataattaaaaaattgcaattacatgttgaaatgataatattcgataatatttgagttaagtaaatttaatgttacttattttttagcatggctatggaaaacttaaaattatgcatgtggctcgcatgatatttttgttgaacaatgctgtttgctgaagcagggctggcagcccttgccagaggtttgaatctccattgtcttggtggctgcagatggatggatgtgggggtaccagcctggtgtgttgggaagatttttctttgtgaaggggaacttgccctttactgttggggatagtttcttctcagcctatccagggacacacataccagcattttggggttgtgaaacttttgtgtggggaacttcccttttttttttccacatgagccaataagataaaactgacctaatggcattctcggtgcaactctgccttcagtttaaggacagaagagggctcatgtttcatagagtattaaaggagcaagcttaatattttgcattttgtggactgtaattgctaactgctgctacatgattcagtcagctaagaataatttactaattatatattgcctcacttggttctttttccagatgctaaacaaggtgagataattagaggaggaaaaagggtgagtttgggaattggagaccagaaggatggatttagaagatcttggagttaacggacttagaatatagtcagcaaagagttcacttaaaattagtgcaggttgccaggcgtggtggctcacgcctgtaatcccagcacattgggaggccaaggcgggcggatcacgaggtcgggagttcaagactaacctggccaatatagtgaaaccccgtctctactaaaaatacaaaaattaggcaggcatggtggtgcatgcctgtactcccagctactcggtaggctgagacaggagaatcgcttgaacctgggaggtggaggttgtggtgagccgagattgcgccactgcactccagcttgggcaacagagtgagactttatatcaaaaaaaaaaaaaaaagaaattagtgcaggttgactgtgtgtgtgtgtgtgtgtgtgtagttttctgaattcatttttcaagtattgaatattcacaatgatgctagactaagtgctagagatttggtggtgaacgaaacagattgaaacctgccttcatggggggcgtatataggttcgtctgactagtctagataagtgaatttgtgtagtaattgtttttttgtaactggcttagtttacttagcttgatgtcatcaagatttattcatgttggagtatgtgtcagaatttccttccttttaaaggctgaataatatatccattgtatgtatatatcactttttgtttatccattgattcttccatagacattaggattgcttccaccttttggctcatgtgaataatgatgctgtgaacaggggtgtacaaatatctcttaaagacccctcttaaaactttttgcgatatatacccataagtaacagttgctatagaatcatatggtaattctgtttttaattttttgaggaatactatactgacaaatttgaatccttatttaaacccaggattatggaatactgctgcttgatttcagctgtcattttgttgtctacattgtattttattgaattggcgttattcccaaatattggaaaatgtggaggtttctaatttttgctactgtaaatagcactaataaataccttgagcatgaaaccttttccattatggattaattttataggatagttgtacaaaaatggaattttactaattatgagggtgtgactttttatgattctagttatatattgccaatttatgtctatttttaagtttcattacacccttacttccattggatatagtcattaaaatagagaaaaaaaacttcaataactaaaggcaccttattgctatttaatttacattcctttattattattttttaaattattattttttgaggtggagttttactcgtcacccaggctggagtgtaatggcgcgatcttggcttactgcaacctccgcctcccaggttcaagagattctcctgcctcagcctcccaagtagctgggattacaggcgcctgccactacgccctgctaatttttgtatttttagtagagatggggtttcaccatgttggccaggctggtctcaaactcctgacctcaggtggtccacccacctcggcctcccaaagtgctgagattacagacgtgaggcactgcgcctggcacattcctttaattaactgtgaatttaatactttttaaatacttctgagtaaatctcccttgtgtgagaattgtccatgcatgacctttgcccatttgtctattaggtaggcaaaatcttgagagagcactgcttgagtctgtgcatttttagcttggtagatggttctgcttttttgaggtcagctgaacttcagggttttttttgacttacactgtttgtaccaaaaggatattacatattcaggctttcatttttttaagatggagtttcggtcatgttgcccaggctggagagcaatggtgcgaacttggctcactgcaacctccgcctcccaggttcaagtgattctcctgcttcatcctcccaagtagctgggattatgggcatgcgccactatgcgcggctaatttttgtatttttagtagagacaggattgatcaggctggatggtctcgaactcctgatctccggtaatctacccgcctgggcctcccaaagtgctgggattataggcgtgagccaccgtgcccggcccaggcattttgaaatacttcagaatgtgtttcaggctgacatcactgaaactcagaaaaatacttattactcctgtagttacaacatgggaaaggcattgctaagaaagcatcaccataaataaacccgtgggattcagaaggtggggagttgggtgatgtgttttctactaaccatgtgttttaaaaaaaagggtgactagaagttcctgtttatctttgaatttcaataaatttagggcttgttttccaaccactctggtagaatttagaagaacctaacttatttatttttatctttttgacagtcttgctctgtcaccaggctggagtgcagtggcgcgatcttggctcactgcaatctctgcctcccagattcaagctattttcctgcctcagcctcctgagtagttgggattacaggcatgcaccaccatgtccagctatttttttttttttttttgtatttttagtagagtcagggtttcaccatgttggtcaggctggtgtcaaactcctgagctcgttatccgcctgccttggcctcccaaagtgttgggattacaggtgtgagccaccgtgcctggccagtcctaacttattttgtaagtatactaggtattgaaaaaaggatggtaggacaaactgctggaaaccttacccaccaaagataatttatactgtttacttataggcttactgtcttttgttgaaaaattgcgatgagaaaggaatcggcattggcatctattaggttggtgcaaaagtaattgcggtttttgccattactttcagtagcaaaaatctcaattacttttgcaccaacttaatactttcaggcttgttgaagcctaagtagaaaattgttgcttaatctcttttattctgattaactcctactttaaattttttctttcagaatctttttatcaagtgaatcttttaaaaagatgtgaagagttacttctgactttatgattgatagattatgagccctccttaatccccaatttcttaattcaaacaagcttactgtgaaaattttcttttttctttctttttttttttgagatggagtcttgctctgttgcccaggctgtagtacagtggcacgatcttggctcactgcaacctccatctcctgagttcaagtgattcttcagtctcagcctccccagtagctgggaatacaggcgcataccaccatgcccagctaatttttgtatttttagtagagacggggtttcaccatgttggtcaggctggtctcgaacccctgacctcaggtgatccgcctgcctcggcctccctgagtgctgagattataagcatgagccaccgcgcccggccaccgtgaaaattttctacaaatgcttgtttcgaggaatcttttttgatattttgccagcaaagtcataggagcaaaatttttttaaatgaaaatagaaaacaacatagttaaatatatcacgtaggaggaaaagtaccagtaccaaaattaactttagcatttcttagtgttttacagttaacagggcattccaagggaattaaaattcagttgattttattggactttaatttcagaggaactctgagatgagaaatttaactagcacgtttatccgtttaggccttaagcagatgcaggtttcatgacatgccagaggtaaatttaggggtacttgactgtagtgagtaatttcccagctatgggaaaatgtaaatattatgtagatggtataaagaaacaatattacgtttgtccatttaaggtctgtttctgtttgttcagacaggcttgtggattgcttttcttgccagtgttcctttaggtggaaggtacagccctttcagatatttcagaattttattttcttttatttttttgagatggagtctcactctgtcacccaggctggagtgcagtggcacgatctcggctcactgcagcttctgcttcccaggttcaagaaattctcatgcctcagcttcccgagtagctgggattgccagcacccgccaccatgcctggctaatttttatttttatttttttagtagagagagagtttcaccgtgttggccagactggcctcaaacttctggcctcaaccgatctgcccgcctctgcctcccaaagtgttgggattacaggggtgagccaccatgtccggccatatttctgttttagaattgctttcttgcttttcctctgaccagatttggtcacgtgaaactgtcaattagcatgaatgaggtgctgctgccatgcaggggtttgatccttggctgtcatgttgatggtctctgtatccaaattagtatttgtgaaatttgggggaagagaatttgggcttattgtgtagcggaacgagtacgtttcataaaggcaaacctagcaccgatatcaacaaatccacttacaatccattcctaaaggaggaagctctgttacagttttaaaattaacattacaatgcatcttgcttgtttgaggtgagggcttaaaactcagtaatgaaaaagagggagaactataggctaaaagggtgtgtgttcttaattgattaattgcaagcagctatgtagggcaccctgtgtttaaatcagtgctagctgtattatcttgagcaagtcattgtacctctttgtttttttaatttatttttattttttacatttttaagagacagggtctcactatgttgctcagtttggtcttgaactcctgggctcaagtgatcctcctgccttggcctcccaaagcgctggtattacaggtatgggccatcacgcctggcaaatcgttgtacctctttgagcctcagtttcctcatttgtaaactagtaggatgcctggaagttcataagcattaataaatgttagcaatagttattatttcttgagacggagtcttgctctgttgcccaggctggagtgcagtggcgcgatctaggctcactgcaagctctgcctcctgggttatgccattctcctgcctcagcatcccgagtagctggaactacaggcgcctaccaccacccccgggtaatttttttttttttttgtatttttagtagagatggggtttgactgtgttagccaggatggtctcgatctcctgacttcgcgatctgcccgcctcggcctcccaaagtgctgggattacaggcgtgagccaccgcgcctggccagcaatagttatttttaaaagatcctcctacatgtgattatatgccccttttcatttgagggtagtagaccatatggagaactgacagtggttgagagatttgaagggaactaatagtccagccaaagagcgaaaaatggcaggaaattggaaattaggtctgtctcattggctttattaaccaaaatgaattgggaatctcaatgtaattgatcaggaaggagctccagtcattcctggaggattaatttattattattattattattttttagctgcataccatatcactgtggtgcctttgtttttggaatggagctgttgcctgctgaccacgcctgggggcacctaatcacaagtctttcccaacttctttttcctttaaagcaagccactccagttgaaagagaatgattagacatatgaaagtgtggttttgtttgcccaagagtttatgtataagttaacacattgtacacttttttttttttttaaacttcctctttctctcttatctgcctctgatcacgggatcctggttagttttgctcagggcagctcgcttgacctggtgacaaattccgcttcttcctggggctttcctttttcctccagaaagtcttgtgctcatggtttaggaacttagtcactgtcgtctttctggttttcatgagatcaaatcaaataaggtaatacgtgcaaactgtataacgtgctgcaaaggcagactctgctgctgtccttagagtccagttccctggccgtggctgggttcccagccctctgttctctctccacagagtgactgtctcggctctgagggtttcagcgatactggatgcttccacatttaggaaataggcctgcttatgctccagtgcaggcattaaagctcaatgagtcatgtgatctgcttggccgactcttcagagttcgtttgtactcagtaaaattagtatgagtcttggaacccggtgggaaacctcttcctagtcctacaggccggatgcgccttctgagttttcatattatctctccacccccaacctccccctcctttggttgtatgtttctcacaatgaattggttgttggaaactggctttgtaataattccaaatgccactgtgaagatttttaatagcctttaaaatttttaattggctgagctgtagtgttattgatatatttttgtataaatgttattattaacaagttaattcatataaagggcttggaactatacctggcatataagtacatgtttaataaagattaacttatttctgccgggtgtggtggctcacgcctgtaatcccaacactttgggaggccgaggtgggcagatcacttgaggtcaggagtttgagaccaacctgggccaacatggtgaaaccctgtctttactaaaaatacaaaaattagcctgatgtgcttgcttgaacttaggaggcggaggttgcagtgagccgacatcatgccactgcactccagcctgggcaacagagtgagactcttgtctcaaaaaaaaaaaaaaaaagaaaaaaaaagaaaaagattaacagtatttctaatggtattagaattgttttattttattttttgtttttgagacagggtctcgctgtgtcacccaggctggagtgcagtggtgggatcatgcctcactgtagctagccttgaactcctggactcaagtgatcctcccacctcaacctcctgagtagctgggactagaggtgcattctaccatgcctggctaattttaaaaaatgtttttgtagaaatggggtcttgctgtgttgcccaggctggtctggaactcctgggctcaagtgatcctcctgccttggcctcccaaagtgttaggattacaggtgtatgccaccatgctcatccagcattcttaattaaaataatttggtaggagattttatgaaggcagtatgttcagtagaaaggtttggggatccagaattgggagactattttaattttggatctgttatttactagctctgggagcttgagcaggttccttacttaagttccttgagtaacagtttcttgatctttaaaacattatagaggggttaaatcagataatgtatgtggaatgtattcctagattatagattattacataattgtaagtgtggtagcaatcacaggtgtgtttagagactactaaaaaatggttttctcttttaatcttgtctgatgtaaattaatgacacattctcagtcgactgtagtattgacacttgataaacagtttttgaaaatgaatttattctccatctcttctatgtctgcttttatctgcaaagtcgtgatttgtgtttggggacttgaacaattgatagctaagcatcaactttaaattgctttatgaattgatgattgtgtttatgaagcactggtgatttgggggaagatgacattttagcttactgttggatgcatcagggaacttgagttaatttagctttaagccttccagattatcctgcctatgagcttcacaagggcagaccacatctctagttttcaccatgatattttcagtgctatcttggtgcctggcacagaggacagagggagtcccaattatatttgttaattgaccacctggttttcatctgatcagacttgtgtcagaattataatcaaggaaaagttgggcaaaggcactaaaatgagtttcttttggtttcagagggagtaataataaaacaacagtaatagcttatgtattcatgtggaaataggacatttaggtgaaaagtacgttgggccaggggtatggagatctagctcctaggactggtcctttattaaatagcagagataactttgggagagttacttaaccatttttggcttcagtttcttcctcaaaggccctgtccagctgtgtggcaaatggttagtttattctggagcagaattactgattggagggaaagtaacagcaataggatttgagagggcttcacaaatgttttgagatgccaaatgaattagtttagaaacagctatattaggtcatatctgcttggatagggagaacccaagtgagttgagtcatgggtgtttgagaaatgaatagaatatgtagaattatttcttttccaaaagagggaatgtcttgggaaagaaatcaaagggaacctgggtgatatctttgattcatcccctatctagtgccaacaagaacaagtttctttctttcttttcctttttctaagaatggatttcatgtaagccaaaagaacacttgattgttctgaacttgtatatattgcaggagttataaatataatatcaagaactatttaataagagcccaccagcagttccacgttcctcaaaaccaggacaggatgaatgtatgagaatcatcttcttactgagaatggtaggacagaagggatagtttagccactatacttcctggaagaatcagtacttgagggttgctgcagctttttgggattgaaggagtatgttcatttcctttggaagattaattttttccttttttttgacatggagtctctctctgtcgcccaggctggagtgcagtggcacgatcttggctcactgcaaccccacctcccaggttcaagcaattctgcctgcctcagcctcccgagtagctgggattacaggcatgcaccaccacacttgcctaatttttgtattattagtaaagatggggttctgccatgttggccatgctggtcttgaactcgtgacctaaggtgatctgcctgccttggcctcccaaagtgctgggattacaggtgtgagccactacacccggcctgattaatttcttttacttgcttcaagtgtctcctttattccagcctacacatagaggtaaatattcctaggaaactttcagcaagttaaatcctattataaaatgccagagtcagttgtctaatttttattttattttattattattatttttttgagacagggtcttgctttgtcacccaggctggagtgcagtggcgtgaacacagctcaccacagccttcacctcccaggctcaagtgatcgttccagttcagcctccttagtagctgggatcacaggtgcagaccaccacacccgactaattttcttttttttttttttaagacaaggtctcactctgtcgtccaggctggagtacagtggcgtgactttggctcactgcaacctctgcctatgggttcaagcaatcctcccacctcagcctcccgagtagctaggactacaggtacgtgccaccacacccagctaatttttcgtatttttttttttgtagagatggggtttcacagcattgcccaggctggtctcaaacacctgggctcaagccgtctgtctgccttgacctcccaaagtgctgggattataggcatgagccactgcgcccgtcccactgctattcttccagctagaaggactatacttaaatgcataattatacaaccttttgatatgttatgaaaatcataaaaaattatttttctagcaactcctgcccttttcattaaacagatcctagtagtcctgaaattctgtggtggatttttatatgtaatgtgataatatgaagaaatagctgattttggtagctgctcacatattatgtttgttttaattggaaaagttggcctatgaaaatgagtgttgtataaaaatggtttatgtggaccaggcgcggtggctcatgcctgtaatcccagcactttgggaggccgaggtgggtggatcacctgaggtcaggagtttgagaccagcctggccaacgtgatgaaaccccatctctactaaaaatacaaaaattagctgggcatggtgtgtgcgcctgtaatcccagctactcgggaggctgaggcaggagaatcacttgaacctgggaggtggaggttgcagtgagctgagattgtgccactactccagcctgggtgacagagcaagactccatctcaaaaaaaaaaaaaaaagaaaaagaaaaaaagaacaagaaagaaaaatggtttatgtgaactaaaaggttgtttgcattttgtggcaaataacagcaccaaattcccagatcctaaatgtttcagttatgaaatatttgaagtacctctgaatttacacataggcattccactcatgtaagcactcattgattttaagatttttcattcatcaaaagggaaaatgtgggctgccatatgtataatttttgtcatccaaaaaagagatataaagttaaaaattagcaaggccatggtgggtcatgcctgtaatcccagcactttgggaggctgaggcaggaggattgtttaagcccaggagtttgagaccagactgggcaacagagcgagacattgtctttactgaaaaaagagaaattatccaaatatggtggtttgtgcctgtagtcccagctatttgggaggctgaggcaagaggtttgcttgagcttagcagtttgaggctgcagtgagctatggtcacaccactgcactgtagcctgaatgacagagacagaccctatctcaaaaacaaaacgaaatttaaaaaaagggtgcttagaaatcctgaactgttctttttactcccaggacatgtgatcatatgcctactcaggaatgagttatagctagttctcagtagatgtttagttattaaaatggaatgaaggcatgaatgtggggatgaagtagaggaggggctgggttggagatactggttaattgggaggcattagtaacactgaatgtgggcagagaggtggtgagaaagaggagtcaaggaagagttgtaggtttctggtttgggagccttggaagatggtgctagcaagcagccactcaccaagaaatcaagtaagaagaaagatcaggtttaggagggaagacacattcaggcaatcaatatatggcatacaccaggcagtcaataaattttgagtgagtaaatctgggcatgtgtgttttgagatgtctgtgggctatcaaagtttctggagtttcttatcaagaaggtagacctggtctgcagagagagcttcaggattcgttgaagtcatgggcttagatgaactatgtgtgtaaagcaaaaaaggtgtctttagacagaagcatggaggataccacagaagcatgggggcaccagcaggtaagaagtgggcagagaagggcatgtccatggaggaaccaaggagtggtcagagaagctggagaaaaagaaaagggtggttgtcctgggatcggaggttgggaccacctcaagaacaagggcttggccatgggacaagtgcttcagaaaagccaagaaggcctggggtggaactgtgtggcagtctctggagaccttgaggagagccactccagtgaactggaggcgtacagtcacactgcagtgggtggtgagtgaatagtgcagaggaagcaggagagtgagtagaggtgctcttccgtgaggcttgtctggcaaggagaggatggtgtagtaaaatgaggagcctacaagggcgagggaagtggtaagggtgttgtcatcgtatgtaatgtatgtatgtatgtatgtatgtatgtatgtatgtatgtatgtatgtatgttgagacatagtcttgctctgtcgcccaggctggagtgcagtggtgcaatctctgctcactgcaacctctgtctcccgggttcaagattctcctgcctcagcctcccaagtagctgggattacaggcacctgctaccacacccagttaatttttgtatttttagtagagatggagttttgccatgttggccaggctggtctcgtctcaacctcctgacctcaggttatccgcccacctcggcctcccaaagtgctgggattacaggggagagccaccatacccggcctgttttttatttatttttagatgagaggacttcaatggaaagaagactgagtgtcaggggagtgaggatcattgaaagagatgcctcccttcgcactggaagggatgatatttggattctaagtagaaggctgcttagaaagaagacgtctctcccatcgttgagtggaggagaagttcaatctagaaatgtgtatataatacaagagggggtgactaggcctttcagttggtggcaggtggatattgatggaggaggtgggtatgcacatgtgggagtggtgcatgaagagaagcccacacaggcaggcaccgggccagaagaggggagtgctggggtatttgggaccaagtggtggtatggctgcagcaaaggttgccacgccaaaggtgtggtgaaaaactacgctggaaaggagggagggttggcaggctctgaaaggccgtgcttgccagcctgaggattgaatattttgtgagtaaggaggagccacttagggagaaataaagtggtcagacctatgattttaaaactgacagcagagtttagagggcaagaggggtagggatattgtttggaaggtgattgcggtaacctgggtgaaggtaattagggctagaaataggatagttgcagtgggagagagaaggactccagaaattgagttgtcacattggcacctgatcgaccagggtgaggggaggcaaggaaggagacgagagaaaagaaggaggtatggaaggtggctgggtgggaggatggccatgccactgtggaatggggagcacgggaggaagaggaacaggtttagtgaggtaggggaacaactcggttttagggcctatacgcaacatttgtgtagcatccagctgcagccagaattaagggtctgaagctcaggacagacctcagatctcatggaagcatgagatcatcatccttgaattggaagtggttgagatttatttgaaataacaagagaaaaataaatcttgatgtggatatggactggaagagtaaacttcacagaccatttgagtgtatttttaactttcttagaaaaaaagtctttgaagaccagaatgtggtggtgctccacaaatagctcaaaattagcacatctagaataagctagaaaataaatctaagcagtttcaatagaaatgctgttatcttgatctggctctatttgttttttttcctatcaggttaaaatctgtttcttcaatcattttgtttattccttttgataagagacttcagaggactgacagggactagctggttatgtttttgaaaagtctttgaagatgaaacatatgttttgagtgtggtgacactgcattaattattctctggttttgacaccagtggatactgatacggtttggatgtgtgttgccttcaaatcttatgttgaaacgtgatccacaatgttggagttggggcctagtgggaggtattggattatggggatggatccctcatgaatggcttagtaccacctccttggtgatatgtgagttcttactctgttcacgtgagagctggttgtttaaaaagagcctggcacctcctcctctctctcttgttccctctcctgccatgtgaccacctgcttccccttttcctttcacctcctgaggtcctcctgaggtcctcaccaggagcagatgttggtgccatgtttcctgtgcagccaacagaactgtgagccaaaataaacctcttttctttataaattacctagcctcagatactcttttatagcaatgaagaaaagacaaacacagaaaattggtaccaggagaggggcatcgcaataaagatacctgaaaatgtggaactggctttggcactgggtaataggcagagattagaagagtttggaggggtcagaagaagacaggaagacaagggaaagttttggaacttcttagagactgattaaatttgaccaaaatgctgatagaaatatggaccaagtggggtggctcacgcctatagtcagcactttgggaggctgaggtgggaggattgcttgagctcaggagtttgagaccaccctggacaaagtggcaaaactgtatctctacaaaaaatacaaaaattagctgggcatggtgacatgtccctgtagtcccagctactggggaggctgaggtgggaagatggcttgagcctgggaggcagagtttgcagtgagccagtatgagtcactgcactccagcctgggtgacagccagaccctgtatcaagcaaacaaacaagaattgtgtgagctgaactagttgagatgtctatggtgttggctgttgtttctgctgttaatcattagttctcttaaactaggagatgaacaaggttaacctttttcttgcaaattgacacagagggtctgctgctgtgagctttatcttcaacatcatcttgtcctttttttttttttcctactttgaaaaaaaaattcattttttcatagaaatgagttcttactatgttatccaggctggtcttgaactcctgagctcaagtgatcctcctcagcctcccaactgggattacatgtgtgagccactgcacccggcacttcttgaagggttatccacttgaaaactgctgatttttggggggcattgtccccacaaacttttcaaaaagcaacagtgatttcaccattctgcccaagcttcaccataaatttgatgtttgtttttgcttcaattttagcagaattctagccctgcgtggtgacaggcacctgtattctcggctactccggaggctgaagcatgagaatcgcttgaatttggcaggcaaagtttacagtgagccgagatggcaccattgcactccagcctgcacgacacagcgagacaccatctcataaaaaaaaaaaaaaaaaaaaaaaaaaaattagcagaatttatgttgctctgataggggctcttttcaaactgatgtttatccttcttagtgcctcaaactaggttttgctcagacatgttatgacaagttagtacaagtttattttggtgcaaaaaatttttcaaatccatgcatagtttcttctttttcttttcttttcttttcttttttttttttttttgagacaagatctatctctgtcatccaggctgaaatacagtggtgcagtcttggctcactgcaacctctgtcacccttttcccacctcagcctcctgagtagctaggactacaggtacataccactacacctggctaatttttgtattttttggagagatagggttttgacatgtttccaaggctggtctcaagctcctgagttcaagcaatccatctgcttcagcctcccaaaatgctgggattacaggcatgagccaccatgcctggccgtagttttttcataatattcattttccttgaaatttttgatgacccctcgtatctgtattcctgttttatagtatcacacatttattacgtgcctgtctaatacccattgctgtggttttctctgggaattcaaagaggagtaagctagtagctctgccttctagcacatgggctagtggaaagtcataaagagccatttaatgaccactgtcaatgtctgtgtaagggcagtgaagagcacgctgctgttgataaggatggctcacatttatggtacacttgcaataccttttacccatactgattcatctcattctcacaccaactctgtgatgtggtacagttattagaagaggcacagagaggttaaatagtagctggtaattagattaaccaacgttagaaactgggtggtctggtgtgagagcacaggcttttaaaaagcggtaagaagaggggaagctgcagcctagttagggtgactgttgtgttattgaagatgaggggatgaggactttgtgcatgtgtgtggagcctgggctgtgagggtcaagggacaatgggaagggacattaaaaggttatggttaaagtaagcctagacggactagtttgaagtcaaatagtagaaggtgaggatagagagggggatgggaaccagattatgaaaataggcagtatctcttttttatgtcaagtgttaccctgaaattccgaaactatatttcttatgaacatactgattacattcattgttatttaaaaatatgcatgtacaatatgggtggaaatgataatgattgtaatgagagtggctcacaattccaaagaagttgggggtttctgtgggtttattataacttacggttttttttttttctgatatggagtctcactctgttgcccaggttagagtgcagtggtgcgatctctgcttacttcaacccccgcttgccaggttcaagcaatcctccccgctcagcctcccaaggctcccattgcaagcatgcaccaccacgcctggctaatttttatatttttattagagacagggttttgccatgttgccaggctggtcttggattcccgacctcaggctatctgtccaccttggcctcccaaattgctgggattacaggcatgagccactgcacctggccagtttattataatttaaaaagcagtctgttattagtaggcttcggaaatttgtttcagggagtggtaaggaaggagttctagaaagtggttgtatattgctgcatgcttgttttcctctcagatcacaaagaaaatgtaaaggacctgggtgagttccaaaaattaaagtagccgggcgcggtggctcacgcctgtaatcccagcactttgggaggccgaggtgggtggatcacctgaggtcaggggttcgaaaccatcctggccaacatggcgaaacccctgtctctactaaaaatacaaaattagccgggcatggtggtgcatgcctgtaatcccagccacttgggagggtgaggcaggagaatcatttgaacctgggaggtggaggttgcagtgagcgaaatcgcgccattgcactccagcctgggcaacaagagcaaaactccgtctcaaaaaaaaaaaaaaaaaaagtaagttacacacacccttactggcacactgggattccttaaatgcttgcagtattattgagtatggacaatgcacagaactttgtactagatacagttaggttattccatgagagtcttgcttcctccctacatatattcccaagtttatatggggagaccaatataatatgatgcaatttgcaaacagtaacagctgtgtaaatgagtataaagcaatccagaggaggttaaaataaatacatttaaggaagcccacagtgataccttgatttattcttttgtgcaactgttgttgagcagcaggcgccttgggggctgaatagaaaagggcatacctcctgaaggtaggagaagcttggatttgggttttgaaaggatagaagttcaaactgactgagtgggtgtcttttatttttctgtagaaaaagcattggtgtgtgtttgaaaagtttagattgtctcaaaagcataatgagttttatagacttctagggattgtctccagagataggtgggtagtatgagtagtttctttcttttttttttttttttttgagacagattcttgctctgttgcccaggcccaggctggagtgcagtggcgtgatctcggctcactgcaacctctgactgctgggttccagcaattctcatgcctcagcctcccgagtagctgggatggcaggcgtgtgccaccatgcctggctagtttttatatttttagtagagacagggtttcaccatgttggccaggctggtcttgagctgctggcctcaagcgatccacccacctcagcctcccaaagtgctgggattacagacatgagccaccatgcccagccccttgagtagttcctttctagaaacactccaaagtgtgtgtatgtgactgggctggttctaaaattaggatgttgctttgtgccctttttctatagttatcagattttttttttttttttaaagacagagtcttgctctgtcgccaggctggagtgcagtggcacaatcttggctgactgcaacctccgcctcctgggttcaagtgattctcctgcctcagcctccggagtagctgggattacaggcatgtgccaccacgcccagctaatttttgtatttttagtagagatggggtttcaccatgttggccaggatggtctccatctcttgacctcgtgatctgcccacctcagctgcccaaagtgttgggattataggcatgagcctacgcccccggcctagttatcatatatctctactgaagaatgcaagattataatagaaaggaattatttttgaactattatgttgtaaatattaatttattgaagtaggtcaaatgctaggaaaggattctttttactattaaagtaattcaggcatacggtaattctataaaagtagtatgggccgggcgccgtggctcatgcctgtaatcccagcacttcgggaggccgaggcgggcggatcacaaggtcaggagatcgagaccatcctggctaatacggtgaaaccctgtctctactaaaaatacaaacaattagctgggcgtggtggcgggcgcctgtagtcccagctactcgggaggctgaggcaggagaatggcgtgaacccaggaggcggagcttgcggtgagccgagatcgcgccactgcactgcagcctgggcgacagagtgagactccgtctcaaaaaaaaaaaaaaaaagtaatatgaataccttttagtcaccatccagtttaaaagaaaacattgcatcatagttgaagcccttgggtctcaattgctggccccatttgttcttctccctgtcgtttcccccagttcattttgatcattgccatccatctactttatacttttattaaggatgtgtggtgtcatattgtgtgttttcttctataggttgtttctgttgttgaaccttgattttgagattgacttttgttctagttccttcttctgagctgctgaacacgccatagtgtgcccattttactgttgatggacatttaattgttctttcctcccatttttctctattatgaatgatactgcaataaacatctttatggatctccttttgcatgtgtgagagacattgtgtagttataatccaaggcctggaactgcttagtcatagggaaggggctgtgtcttcatgttcataggctactgccatacgcagattcttcagttctctctttgaaatgggaagctctgaggattaagaaattatttttttaaacctgtatgctgattttttttgaagctgtaatggcgctttgcatacttgtggtttagggggtaaatggaatatacacaataagaaatatttactgtgttaatggttcataacttgtgacttatgtaaagttccatctaatttaaataataaataataatactggctgcatagtaatacctaggaccacaatgagagactccgtaaaaaagaaattcctaaactgtattttttttttttgtatatctgtgcccacctgtaatttgacttacagtgaatgtggcttatttgggcaggggagacttttgaacaggtgataacatttttgcgtggccttaaaatttctataatttatttgaaactctttttaaaccatcatgtctcaaagtgatcaagtagaaaggatcaggtgccttaattacgaagaatggcataaatcatgacaaggtctttttgaagtcacctggaatgctccctttgggtgaaagaaggttctgttctcttatcatattcttcctgctcaagttgcccaggtgtagtttgtggtttccaagatacctgttggactggctttaggctgataatattggttccttcatatttttttcacattgtttttagaaattttatgtaactgcattcttcaataaggctctaaaacaattttcctattatggtatagttgcttctccaaacacttaactacctactgggaggaatcaataagagagccacttctggtggatcttggccacaaggtctgtgatgtgtcgttatattgcagagatcttttgaggaaatgcaacgtgaaagatctccttgacattctatgatgaagaaattaaaggtaaactgcatttatgcagatttaatgtaggtagataactgacctgtttaattcatgtgaggcctcagagggtcttttatattctctgctttccagctagtttgacctaagtcaaaccttttctccccagtggaccatgttacttttattttaatcagttgatttttttaaggctttattgagtataattgatataccagaaacctgtacatatttaatatatacagtttgatgagtttggacatatgtacacaccagtgataccaccacactcaaggtcataaacatctgttgcctccaaattttcctgtgtcacttttttttgtggtaagaacacttaacatgagattgaccctctcaacacaaaagtgtacagtaccgtatcattaactataggcattatgttgtacacagatctcgagggcttattcatcttgtgtaactataactttattcccattgaacaacttctcatttccctctctacctataccctggcaactacctttctattttcagcttttataagttggattattttagataaaccacataaaagtggaattatgcagtatttgtccttctgtgactgattttatttcacttagaatattgtcctcaaggttcatccatgttgttgcaaatggtaggatttccttttcattttattttattttttgagacagggtctcactctgttacccatgctggagtgcagtggtgcagtcatggctcactgcagcctcaacctcccgggcccaagtgatcctcccacctcagcctcctgaatagctgggactagaggcatgtgccactattcccagctaattattattatttgtagagacagggtcctcactatgttgctcaggctggtctcgaactcctgggttcaagcagtcctccctcctcgacctcccaaagtgctgggaggtctcactcccagcctaggatgagcctcactccctcactcagcctaggattttctttttaaaggtgaaataatattctaatgtatatatacattgcatttttaatagtcttatttcatgacattaaataagatatacttatttaacgtcaatcatcgtttggatcgtttccatgtgacttagagctttaaaacaggtgatgttaaagttgaaaataaaggcctgtaatcccagcactttgggaggctgagggaggcagatcccttgagctcaggagttggagaccagcctgggcaacatgatgaaaccctgtctccactaaatatacaaaaactagctgggcgtggtggtgtgtgcctgtaatcccagcaactcaggaggctgaggtgggaggatctcttgagcccaagaggtggaggttgcagtgagccgagaccgtaccactgccttccagcctgggtgacagagtgagaccctgtctcacaggcgcacacacacacacgcgcgcgcgcgcgttgaaaacaaatgagaaaccctatggacgtgggggactagacctgtacagttgtcaagcctggttttgagaaagtaactgactccagctgggggtggtggctcatgcctgtaatcccagcactttgggaggccaaggccaggaggattacttgagctcaggagtttgagaccagccaggcaatatggtgagaccccatctctctctctctttttttttttttttttaagttactgactcctagggggcatttaagcggttgaatatcagcatttctttagctatttagcacctcccttgtgactttaaagtacctagtgattttttttttttggatggagtttcgcccttgttgcccaggctagagtgcagtagtgtgatctcggctcactgcaacctctgcctcccgggttcaagcgattcttctgcctcagcctcccgagtagctgggataacaggcatgtgccaccacgcccggctaattttgtatctttagtagagacggggtttctccatgttggtcaggctggtctcgaactcccgacctcaggtgatccgcctatcttggcctcccaaagtgctgagattacaggcgtgagccaccgtgctcggcctgtgattctgatttctatatatggagccatctaattataattatttgttgcaaattatcttttctactgcattaagtttccttatgggctgattaaaatgttctggttgacagctcacctggttatttaaattgtttgctttatcttctggcttagcaattgtacttctaaaaaactatcttaaggaaaaaagtcaaggatatatgaaaatatttcttatgagaaggttcatcaagggccgggcccggtttctcatgcctgtaatcccagcactttgggaggccgaggcaggcagatcacctaaggtcaggagttcaagacaagcctggccaaaatggtgaaaccctgtctctactaaaaatacaaaaattagctgggcatggtggcgggtgcctgtagtctcagctactcaggaggctgaggcaggagaatcgcttgaatcctggaagcagaggttgcagtaagccaagatcatgccactgcactccagcctgggcgacagaacgagactccatctcaaaaaaaaaaaaaaaaaaaaaaaaaaaaagattcatcaaaactttgtaattaatacaaagttttgtaattaattaatacaaagttaattaatacaaattaatacaaagttttgtaattaatacaaagttttgtaatacaaaactttgtaatagtgagaagtttggaaacagtagatattcaattatttaaaattatttgtagagtgcagtggtttaaaagtatagcttctggattcagactaagtgaattctgatagttgtgctgccacttagaactttatgactttgggcaagtttctttctttctttttttttttttttcttgagatggagtctcactctgttgcccaagctggaatgcagtggtacgatctcagctcactgcaacctccgcctctggggttcaagtgattctcgtgcctcagcctcagctgggactacaggcacatggcaccacacctggctaatgtattttagtagagacagggcttcaccatgttgcccagggtggtcttgaactcctgagctcaggtgattccgcccctccccacccgcctcaccctcccaaagtgctgggatcaccggtgtgagccatcacgcctggcccgggcaagtttcttaatgcaattgttaattgtagcttaacagctgtccttggattatttgagtatgaaagaagttattaataccttgtaaaatgcttagaacatgtctggtccatagtaaagctccataaagatttagctattgttactgttaaagtgttagatgcacagatactcacaacatttttcaaatggaaaagaattttaaaacagcatgtatagaagccggtgaggtggcaagcacctgtagtccagctgcatgggagactaaggcagaacgaccgcttgagccgaggaaggagtttggggctgtagtatgggatgattgttcttgtgaatagccactgcattccagcctgggcaacctagtgagaccccgtctcttaaaaaaaaaataaaaccccaaaacaaaaataaaccaaaaaccccaacaaaacagcatgtataatgtatcattaaatataagaataggaaaaaaaaaccggaatgatctactctgggtgataggacaatctcttttggcttctgtgttttttctgtcctacaactcttctgttttataactgaaaaaaatgttttgcatgtgaattttagactggggtctttgggtaaaagcacctagagattactggcaggttaattctaaaaagggcaatttgttttttcactttatctcagagtttcatttgtttcccagtgattgactaattattttaacaaagtaaagcttcattgttgtgtgtatgcaattgaatcgaaaatatacttttcatacaaagacaacttcctaaaggtaagtgtaaacttgtatgtagtttgttaatcttattgtggtattttgtttttcttaaacacagtttcctgttcttttgcttttgcatgtcaacattgctgaaaataaatattttgctctgcagggatagtaagccagatggagtggtatttataatttgaggaaatagcttaaactttgtcatcagtttaaattgcattaaaaaacctgaagcacattgattagagttgtttaaggtagagaaccagaaatattctaaatatcctatgcctaacctgtcaaaactgttcctgaaatatatagagagggaaagagtacctgaggagctcaggaagagtgatggcctagagcgtagcttgaattgagcagcagaggtttctctggagtgtcctgtattatcttaggcaaatttgtagtcttcttaatagtatctgtttacatatcaatatgttttctgtccaggcaaggtggctcatgtctataatcccagaactttaggaggccgagatgggcagatcacttaagcccaggagttggagaccagcctgggcaacatggagaaaccccatctccgcaaaaaaatacaaaaattagctgggcgtggttgcacatgcctgtagttccagctacccgggaggctaaggtgggaagatcacctgagcccaggaggttgaggctgcagtgagctgtgtttgcatcactacactccagcctgggcagcagagaccctgtctccaaccaaaaacaaacaaacaaacaaaaatatatataatgtatatgtatatgtgtggttttcctgtcaatttttaagtagaatgtcctcagatacatatgccatgtttatcctgttacttccaggatacctgggaatacccagaggtttgtgtctatgttagtgtgagaagccctaacacatttttgtgtagagacagcaaaacctgtctctacaaaataaaaaataaaaaaattagcttagcatggtgccgtgtgccagtagtcccagctactgtggagaatcacttgagcctgggaggttgaggctgcagtgagccatgatcacgccactgcactccagccttggtgacagcctgaggactttcttatggattaaggtgggaattatttatggtttgcatgctgagagagattttctgaattttttcaacaaatattgaacacctgccaggttgtgaatttttgtggagtggatcaaaaggactgaaggaaatgaacaaataattttggcaaaccattattaagtaatgaatatgtattgtattcattaattaatgtattaagtgatgaatatgtattgaatatgtgtatcatcacagtaactctatgagggaggttctattatcaccctcatttataggataaagtacatgagagatgaatttatccttaagaaatattttcactttggtgaggcatggcagctcatattttcactttggcgaggcatgacactttgggaggctgaggtgggaggatggtttgaagccatgagtttgagaccagcctgggcaacatagtgagaccctgtctctatctttttaaattataaaattttaaaaataaagaaatttttttttattttgagaagtttgtgtgctttaggtgtgtattctgtttcattaagccaaagtttgtattactagccttctatcctgtcttcccatccttaccaaaaaaagagaaaaagaaaaatagttttactcctgaggttaagaatggggcatgttgtatcaatgtttatttgtgtagatattcttttgaatttttaaaaattggggtatcacttatatacaataaaatgcacaaatcttaattgtacaatctaatgagtctctatgtttaactaccacccagatgtagaaatgcagtacatttctgttacccaggaaggttcctatgtgactgttcacaatcagtaatctccccagcccttggctagaaccactagtctgacttttatcaccctgagttaatgttgccgcatcttgaacttcatataagtaaaatcatgcagtatgcactcttgcagctgacatcttttgcccaagtcagtgccacacattgagattcatccatgttattgcatatatcagtaattcttcattgttgtaaaatattacattgtttgaatatatcattatttatccattctcttgatgaacatttggattgtcaatcagctgctttgatcattcttgtagaacgtgtcctttggtggacataacccttcatttttcttggctatatatatacctaagagtggaattactgcattgtagagtaggtgtatcattggctttagtagatattaccagttttctaactgtgttagactgacgtacatgcccactagcaatggatgagagttctgttttctccacatccttgctaacagtctctttagttgttccatttttaattgtgtcttcaagtaggaagcaccctcacttacaggagaaaggaactcccaaggaagtttctgattagtgcaagttgggtgggatgaagatgaataaccaatacatagcctaaagctttgctcagcatcttattcagatgtagtatttatttcaatgacaaccaaaaataatttctgaatggaccctccctacccatcaactgtaagttaacattgtccaaattctagtctaattatgcttatgttcttcttctcccctcttatattcatgctgaaatattaaaaaatcactgcaaattcctatggaaaacctcatacttcaaaagggatcagtgtttggtttctctctccattttttttttttttctgttgaaatagagtgaaagacccaggaataatatgcctgtgtgtacattttgcagatctggtaataataacaactgtagcggttactgagggcctcctctgggtcaggctctgtgagaagtgatttgtattccttagttcatttactttctatcatgacccaataaagtatatgtatctttgctatccccattttatagatgaagaagctaaagctttgagaggttaagtaatttgcccaagtttatctagctagtaagtgcagaagctagaattttaatctaggtctgtctaactacaaaggatggaattaggcccctttcttatgattattaataaaaatgatctctatgtagttaggatttactaacccaatttcttttatcttttaaactgagaatccctccacctcctggcaccccagttctggtaaaagataaatgaaacccatagttgtttttctcagcaagggttttatttatttatttatttattttattttttttaagacagagcctcactctgtcaccaagactggagtgccgtggcacgatcatggctcactgcaggctcagcctcccaggctcaagtgatcttcctgagcagctgggattgcaggcacacaccaccatgctcggctaatttttttttctttttttttttttggtgagacggggtcttgcactgttgcccaggctggagtgcaatggcatgatcttggctcactgcaacctccgcctcccgatttcaagtgattctcctgtctcagtctccagagtagctgggattacaggcatccaccaccacgcccggctaattttttgtattttttagtagagacggggtttcaccatgttggccaggctggtctcgaattcctgacctcatgatttgcccacctcggcctcccaaagtgctgggattacaggcatgaaccaccgcgcccggccccggccttgtatttttttttatagagacagggttttgccctgttgcccaggatggtctccaactcctgggctcaagcagtcctcccatctcagcctcccaaagtgctggggttacaggcatgagccactgtccccagcctcccaaggttgtttttaggccctttgaggcttataaaatagaataaatgagaaataggtccaaccttcaagagcactgtgtatagcacccaagattagaaatgcatatgttcagccatgacatctatggaaagtacagaggacaggtcctgaggaagtgctggggctgttggtggtaccagcctttgtgtagcagaagatgtttgagctgtgctttgcaaagtggctggatcatagacatgtgaacactaggagttgggccagtgggtggagatagaatttgtgcctcaaattgcagatacttctgtttggtgggtacatgtgtgacaggcataaacttagtgagtaggtggccccagatttggaccaggtcagggagactcttgaatgtcaggccttgtggccttttgaggcatttcccgctggacgattagttgggcagtggtgtggcagcatgtggaggtggagaggctgatggagaacttgcagtaggatgtccatcatgtgggactgaaggctagctgggaggtatatctgggctggagaaaatggacatgggactcacaaaactggttgtaggagctatgggaatagacagaggctcccggctagagctctagggcatagtgggttaaccagcggtgggtgtggtgtcagaatcactcataaagctttttttttttttgagatggagcacgttcctggctcactgcaacctccacctcctggattcaagcgattatcctgcctcagcctcccaagtagctgggactacaggcatgcgccacaacacccagctaatttttgtatttttagtagagacggggtttcatcatgttagccaggatggtctcgatctcttgaccttgtgatccgcctgcctcgacctcccaaagtgctgggattacaaggatgagccaccaagcccggccaagcttcttgtttttacattgattttttttttttttttttttagagataggggctcgatctgttacccaggctggagtgcagtagtacagtgttggcttactgtaacctccaacttctggactcaggtgatcctcacccctcagcctaccgagtagctaggactataggtgtgtgccaccatgcccggctaatgatttaaaaaatgttttgtagagacagggtctcattatgttgcccagctggtctcaaactcatggcctcaagcgatcctcctgccttggcctctcagggtgctgggattaaagtaaaggaatgagtccagctactcatacagctcttgaaaaccctctggcttggtctgaccctggagcttctaattggtgttcttggggtctcagcagccatctgggtttttttttttctttttttgggatggagtctcgctctgtcgcccaggctggagtgcagtggcgcgatctcggctcactgcaagctccgcctcccgggttcactccattctcctgcctcagcctctggagtagctgggactacaggcacccgccaccacacccggctaatttttcgtatttttagtagagacagggtttcaccgtgttagccaggatggtctcaatctcctgaccttgtgatccgtctgccttggcctccgaaagtgttgggattacaggcatgagccactgcgcctggccagccatctggatttttaaaagcaccttggcttctagtgcatattctctgcccactctgcaggtaagaagcagtgaggaaaatggtcctagggtacccggttaggacatagtcatatctctgagttctcagggaactcaggaaaaatcatgccgtctcgatagccaagttatcagtgtcaaatgtctcgaaaagatcttgtttccaaagtcgtcatgcttaacacttccaaaacaaagagtgtgccaacttctttgggcaagccatttgtgggcaattttgaggatcagaaaagctctttggtgaaataaactaaacggtctccctgaatagctttcacagtgtgggccttgcagggagcacaaggccagcccaccctatacatgatattctttacgattataaagacactttttactgtttctcccagttttcctttttcccacactaacatccccagtatgctcttgtgtagttttcagagcctttgttatgattccctctgaactgttgctctttgccagtattgcttttcaaataaggcaaccccaaatttacgcaccagcattgtttagtgggaccatttatttgtctcttgtcatgtagatgatacacgcatgtatttgcaggggcagggacaggggatccccagtataaactttaaatgtgcctttaattctatcttggattcaccctgtttgagcctgtgatctggcttaccctcccagatgtcattggccaatttgataaacaaattcgattatctccatgccaaagaggaagcagtgcctcaaggcaagcctgaagcagcgctgccatgacaggaccttgacaggtccttgataggacctttgtgctgtgctcagtgatgacctcagtgatagttgtcctcagccaggaggtgtttctttttttttccttttttttttttttttttttttttgagacagagtcttgcactgttacctgggctggagtgcaatggtgcaagtctgggttcactgcaacctctgcctcccaggttcacgggattcttctgcctcagccttctaagtagctgggattacaggtgcgcgccaccacacccagctaattttttgtatttttagtagagacggggtttcactatgttggccagactggtctcgaactcctgaccttgtgatctgcccgccttggacttccaaagtgctgggattacaggcgtgagccaccgcgcctggccgagttgtttatttctaaaggatttttaggagtcttaaaaaaagtcttttcctgtaccttaaacaatggtttcactaaagggaattgctgtcttagatgtttcgtgttgaatcttacacatttttgcctaagctgtatcatcctcattggaaaacccttgcaccgagtatttacttttagtcacactttgctataaactttatgacttgtgcatgcgcgattgtatggctggctctttgccttttgcctctactgtgaccaacactgatttcttacaggcttgtaaagtggtttccaagatctgtttgctgtgtgtgcttggctgcatttgatataaatagatttgagattagtgtttgaaagtgccatatgaccatatacagagctgacttactaaggatatgttactgcatttcagacacatctagtaatagaaaaatcagtgtcttaatgggctgtgcctctctcgtgtcccctcttttaaaaaaaaatttagttacaactaaatgtcaggaaattttgtagcttacctagtttaagtcccaagatatgtggagagacaataaaaatgataatgacaatggtgcctggagatgcgtatgttaacatatgttaagaagttatttttaaggttgcccacttaatgtttttgtttttatttttgagatgaagtctcactctgttgcccagactggagtgcagtggcttgatactggctcactgcaacctccaacctcccgggttcaagtgattctcttgcctcagcctcccatgtagctgggattacaggcgcctgccaccacacccgggtgatttttgaatttttagtagaggcagtgtttcaccatgttggccaggctggtcttgaactcctgacctcaagtgattcaccctcctcggcctcccagagtgctgggattacaggcataagccaccatgcctggctggttgttgttgtttttgtttgttgagacatggtctcactgttacccaggatggagtgcaggggtgcagtcacagctcactgcaacctcgacttcccaggctcaggtgatccttcaccctcaatctcctgagtagctgggaccacatgtgcacgccaccacacctggctaattcttgcatttttctgtagacatggggtttcaccatgttgcccaggctgttctcagactgggctcaagcaatcctcctgccttggcctcccaaagtgctgggataacagacatgagccacctcgcccagctccatttaatgtttaattgtaggcttggtgactcttatgtattaattactagatattcttatttggaattattagacgtgctaaggcaataattttgaaatttacaacagactagttggtgttaaggtgttataatagattaccatattttgcaatatattggttatttccttgttgaatagagatgaggaaggatggtattttggctctaaattagagggctgaggttctaatggcaaaattaacattgtagttttacattgcttgaataatgtaatcttcttaatagatattatacttaattttgctttaaagacaatgttcattgataaactttctgtatctttcagtgtgttctgtagcacagtgctttcttcatggccatcgcaggtgtttgggctttttttttaaacacgtctgaggactgcaaaggtgtttttttctccccctccccctccccccctcctctttcttacttagactgttgttgtccaggctgacctcaaactccagagagcctcatgcctcagcctcctgagtagcttggaccaggcttggctcgaggactgtgattttatagacattgtttccatcctgtagaggaaacagatgggttaatttaattgttcagctggtgcttgagcacactctgggagtgtccaatccagagatgaatgaggattcttgctcttaattcagtgttgttttttgcttcatcttgcttctaagagagttccttgaatatatgatggaattatgtagtggttactgcagtaatcacactcttattattttctaattatgtggaacttgggaaatgttgattttgtttcagtatatgatttgcagtataattctatttacatgtaaaatcttgtctgtgttagtttgccttgacaaagcaccacaaacaaggcagcttaaacaacagaaatgtgttgtctcacagctctgggggctataagttctggattaagatgttggcagggtggcttccttctgagggttaggagggaaggatctgtcccaggcctctctcattggtttatacatgattgtcttcacccagtatctttacgtcatcttctctctgtacatgtctgtgtccgaatttccccttctcttttgagatagggtctcactgtgtcacccaggttggagtacagtggtgtgatcatgaatcgttgcagccttgatcttccaggctcaactgatcttcctgcctcagcctcctgaggtagctgggactataggcatgtgccaccaggccttgctaatttttttatgttttaaaatttttgtggagatggggatctcactgtattgccctggctggtctcaaattcctgacctcaagtaatcctcccacttcagcctcccaaaatgctgggattacaggcatgactgacccatcacacctggcctaatatccccttttcttagggacatcagttatattgcattaggaaccatgctgatagccttaacattttaacttgatgacctctataaagaccctgtctccagagaagatcacattctgagttattgggagttaggacttcaacatatgatttttgggaggacacaaatcaatattcagcagtatctttttttttttttgagactgagtcttgccttgttacccaggctggagtgcattggcgcaaacatggctcattggagcagccttcacctcctgggcccaagtgatcctcctgcctcagcttccctagtagctggcactcccatgtcaattaaaattttctgtagagatggaatcttaccgtgttgcttaggctggtcttgaattcttgggccttagcaattctcctgccttggcctcccaaagtgctgggattacagcgtgggccactgcgctcagcccttaacggtgtctttaacagctctccagtagtgtatctagagagcactgcctgcgggatggtggccatgggacccagcttggaggctggccctcaagaatcaccgggttggtggtgggctgttagtggatccccttctccatggggcacaggcaagtctggtttggaaaaggatgatgttgcttcagtgtcagtttgccagtttttcctctgttctccccactctgattctgactagaattaatttggtagcactgagaagagtcatttctactttggcacagtaatcttgcccataatctgactaatttttatttttatttttttgagacagagtcttgctctgtcacccaggctggaatgcagtggtgcaatctcggctcactgcaacctctgtctcctaggttcaagagattcttctgcctcagcctcctgagtagctgggattacaggcatgcaccaccacgcccagctaattttttttttcttttgctatttttagtacagatggggttttgccatgttgtccaggctggtctcgaactcctgacctcaagtgatccgcccgccttggcctcccaaagtgctaggtttaaaggcatgaaccactgccccggccccataatctgccaaattttagttaaaactctgtattccacttagaactaattcaccgtggctgggcacggtggcttctgcctgcaatctcagcattttgggaggctgaggtgggtggatcgcttgaacccaggggtttgagaccagcttgggcaatatagtgagaccgtgtttctttgcgggggggggggggtggggggaagccagcctggccaacatggtgaaacctcatctctactaaaaatacaaaaattagccacgtgtggtggcacacacctgtaatcccagctactcaggaggccttggcatgaggatcccttgaacctgggaggcggaagttgcagtgagccgagatcatgccactgcactccagcctgggttgacggaacgagactctgtcaaaataaaataaataaaataaaatacaatgtaaaataaaataaaatagaatgaattcactgataaagttgacttctctcatctccaagtaaatgatttcattttctcctttgttccttgcatgtatgctgtgatttactgactatcaagaactcattacaccagtacgtatcccaagacaaatcagctccaaagtggagtgagtgcaaggggagagctttaattcaaaactgctttatggaggaagtacaggttttcctctaagctgcactgttatagatctgtagaagttttaaatccatgtaatgctcatcagtttttagtttagtatttagctgtctgtgatgataagtaaataatttacctttttgaaggcctgtgatatactgtgtcttcattgcttcatttaagaggatgcaacatcaggattttcaaaaatacacataacgaagtgttgtgtaatcgtctgtacatggtttctttgataagagagaggcaggaatctgcgtaaagcaggtgtacagacatagtttgcccatgagacagcaagaagagccctgatgtcctaaaggagagccctctcctgaaatgcataacatacatatatatttttttttcctttttttcaaaaaatagagacagggtctcagtatgttgcccaggctgtctcaaactcctggccttaagtgatcctcctgcctcggcctcccaaattattgggattacaggtgtgaaccaccatgcctggtcttgaaatgcatatcttagtcactgttacttcttttaaattgttttaattgtataagataaaaaccaaaacaaacaaaaaaaatgctaccatttcaggagcatacatctagtcttaaaaatatcataaatttgggccgggtgcagtagctcacgcctgtaattccagcactttgggaggccgaggcgggcggatcacgtgaggtcaggagttcgagaccagcctggctaacatggtgaaaccctgtctctactaaaaatatgaaaattagccgggcgtgattgtgggtgcctgtaatcctggctacttgggaggctaaggcaggaaaattgcttaaacccaggagatggaggttgcagtgagctgacacagtgccactgtactccagcttgggcaacagagtgagactttgtctcagaaaaaaaaaaaaaaaaaattataaatcctttttattcccctaacttggatctcaggttaattgggatatgcctaataacaaaatttctgaacatgaggtttactagaaagaattattttttagattatttgtgatatatgtatatatgcatttgatagtagtggatgtgtttattggactcttaagtacttgctatgtactgtgggacatgtaggagtatatgaatatttgtcagctagattataaagcttaaaaacatattattgggcaggagtgggctatggggctgtgactactagtgggcctggggtttctttgtgggttgatgaaaatagagatggttgtgcaactttgtgaatatagtaaaaccatttaattgtatacttatgggtgaattttatgttatgtgagttatatctcagtgatgcttaaaaaatgctgttaatgaatttgcagtgctgaaaagattccaaagttgtgattctctacctttttctgttctccagatctcccaaagcagttgcagtgaaagataaagaacatcaaacactcttatcttctggtggtggggaaatgctgagtggccctgactttgtgcagtgaaagttgtttacacaagcctgagtctataaactcagagataaaaaaaatcacaccaggctgaagccccatcaggcaaaaacctaccagagaaatgggcctgcccgtctgatggaatatctgggatttcctgatgttggtcccttaatttgtggaccattttaggctgtcattaaagtagcagtctaaagtaagagaaaaattctgacatggaataatgtggatgaatcttgaggacattacatgaaataagccagtcactaaaaggacaaatactgtatgattacaattgcatgaagtgcctagagtagccacattcatagagacaaagtagaatggtagtcacagggaaatagggagtcagtgtttaatagtatagtttcttttttttttttttttcagacagagtcttactctgtcgcccaggctggagtgcaatggtgctatcttggctcactacagcctccatcaaccaggttcaagcgattttctcctgcctcaacctcccttgtagctgggactacaggcccacgccaccacgtctggctaatttttgtatttttagtagagttggggtttcgccacgtgggccaggatggtctcgaactcctgacctcaagtgatctgcccacccgcaaagtgctgggattacaggggtgagccaccacgctgggcgatacagagtttcagctggggaaggtgaaaaagttctggagatggatggtagtgatggttccacaatattgtgaatgaactcagtgtcaaataactatatactgaaaaatgattcaaatggtaaattttatgttgtgtttaatcacaataaagtaaatttttaaaaagtaagagtagtaaaatcactttgatgaaaagaaagggtgggaccagggtatttggattgtctaccaggccaggcacccttttcagtggtcttgcctctgtgcctgccttctgagtgtgaggaggatgatgaggatgcccagggcaggtctctgcctgctcccttcgttctggtccttccaccagtcacccatggagcatctcttgtgtttcagaaatgccagtgccttggcacaggagcaggataaaactgtgcccccaaggcacttttaatccagaggaaggttggcaaagatacatttgcttgaaaaatattgtcagggccaggtgtgttggttcacacctataatcctagcacttcccagtactttgggaggctgaggcaggaggatcacttgagctcaaggagttcaagaccagcctgggcgagacctcatctctacaaaacttcaaaaaaaattagccagacatggtggtgcaggctgaggtgggaggatcattttagcccaggaagttgaggctgcagtgagcgttgattgtgccactgcactccagcctgggtgacagagcgagaccctgtctctaaaaaataaataaattgtcaggttgcgttatgctcccctgtggtagaagtgtgggtggtgttatttaggtagtacttggagagtgcccgtcagatgtctggaaacctaatttaaagtagtaaaatcaacacgtgggtgagacttgatacccacagacatatttttttttaaagctagagtgtctctaaaagaatgagacttgtttatagcctaaaaattctccatggaatgaagatcctcctggtgccaaaggaactgtgtgcttttggtgaggagcccatcagcatgaggttttccactgactacggtttcccaaggcaacttaagagacatagtcaaggccttaaggaattgatgggccagccatggaggagactcaaatacaaacacaatgtttttgcgctttgtaagcatggttatggagcactgtctaaactagtgaaagtaaatttaataagaaggaattacggcaggcacagtggctcatgcctgtaaccccagcactttggaaggctgaggcgggcggatcgcttgaggctgagagttcaagaccagcctggacaacatagtgaaaccctgtctctactaaaaatacaaaattatccaagtatggtggcatacacctgtagccctagccacttgggaggctgaggcatgagaattgcttgaacccaggaagtggaggttgcagtgaactgaaagtgaaactctatctcaaaaagaagaatgaattatgctgggcatgatggctcacgcctgtaatcccaacactttgggaggctgaggcaggaggatcacttgagctcaaggaatttaagaccagcttgggcaacatagcgagacccctgtctctacagaaaataaaaaattagccaggtgtggtgatgtacacctgtagtcccagctactcaggaagcagaggcaggaggatatcttgagcccaagagtttattaaggctgcagtgaaccatgattgtgccactgcactccagcctgagcaacagaaaaaagaacaaattgtggaagagacatgttaaagtccagtgggtcagtgaccaagagcccagagactctagtttcaaacatacacattccatggtcctgcctgtgtttttagacagatcattctcagaggcagccttcatctgttaaataaattctttacttggtgggaggaggtgagagagaggtggagtcagaggtgaagtgtggggataaggatgtgatatttttagcacagtttgagatataaagtaatttcctgataagattattcttctcctaaatggaacctgtactgtcctcattctcttactaatgacaaggtcagagcaaaccgacaaacatggaagaacagggttcctagccctggtggtgaattccgaggcggtctgagcatactccaaaaagttggctttaggatacagaggggtccatttttgtggactgctttattttggttcaagggttgtctgtgaattttacaataaatcagagtctttgttttcctattgctgagggaggggagggagaggtttgcaacagtctattaatagaatatagcataatttgaaaggaaatgtagaaaaatcaaatgctaataataataatattgctgggcatggtggctcatgcctgtaatcccagcactttgggaggctgaggtgggcagatctcttgagatcaggagtttgagaccatcctggccaacatggtgaaaccccatctctactaataatacaaaaattagctggatgtggtggtgcatgcctgtaatcccagctagtcgggaggctgaggcaggagaatcactcgaacctgggaagcggaggttgcagtgagctgagatggcgccactacactccagcctgggtgacaaagcgagacttcatctaatacgtgtgtgtgtgtgtgtgtgtgtgtgtgtgtgtatgtatgtgtatatgtgtgcgtgtatatatatgtgtgtgtgtgtatgtgtatatatatgtgtgtgtatgtatatatatatgtgtgtgtgtatgtatatatatatacacatacacgcacacatatggcacgcactatgttgcccaggctgatctcaaactcatgggctcaagtgatccgcccgcctctgcctcaaaaagtgctaggattacaagtgtgagctactgtgcccatcctgaaatgctaataattattaacctaatgttgctggaaacaaattctttgttttttcaagaagagaaaaagtagataataatggtactgaaagtggtatttctttttactttctcacaattccatcatcattaaccatttacattcaggagccactatactaggcactctaaaggcacctttaaagagctgtctcattgtatgtaagggtgtgtacactgagaagtctgtattgcccagtatttatgagaaagctgctgcttgcacctggcttggtgctatgagggacaaatacaactttgtgtttcataaggaagattaatactttgacataattctaatttcttggcctttaaggagaaggtcacaaaatctttctttaaaaaaaggtagtgactatcatttgctttttctctgtaaaagcagggacatttctttttaacgtattttttcccagtggctaaaataatgtatactcaatgcagaagacttggaaattggaaaaaatggaggagcttttgaaaaaaaatttctttcaggatgactgttggttttgctttgagtcagaagcaagctttgttctgctgacttgtctcgtgcttagtagtcctttcctgcctcctcttgtgatcccttgaatttggaggatttggcggggagtcacatggccctctctccccatcaacttcccatcttcccactggagcacacgagctttcctccgaatctgtgagacttgagctcagtggttcatgttaatataatagaacacccctttcttgtgaacgtgtgctctcagggtttgtttccaagttgaggcttgacatgtcagaaggtgttttgtggaaggaaagagccctagtgctggaggcattgggttcagatcctggcctcactcaaatggtagccgtagccgtgagtaagttaaactcggcttgctcgtatgtaagtggtaataacaatgcttagatacaatgatctgatttacctggtacatagcaggttcttgggctgggcatggtggctgatgcctgtaatcccagcactttgggaggccaaggcgggaggatcacttgagcccaaaagtttgagaccaggctgtctctacaaaaaattaaaaaactagctgggcacagtgtggcgcctgtagtcctagctattcaggaggctgagatgggaggatcacttgagcccaggaatttgaggcagctgtaagctgtgattgccactgcactccagcttgggcgacaaagtgagaccctgtctctaaaaaaaaggggcgcagggggttctttccatgaatgtgatgctcacacaaccctgtttgttcctttcattcaaaaatgtatattgaagtcctagctagctgcttgggaggctgagatgggaggatcatttgaacccaggtgtttaagtgcagcctgggtaacataacaagaccccatctctctttttctttttctttttttttttttttttttttttgagacagggtctcatgtgttgctcaggctggagtgcagtggcttgatcttggcctactgcagcctccacctcctgggttcaaacaattttcctgcctcagcctcctgagttgctgggattacaggtgccaccaccacgcctggctaatttttatatttttagtagagatagggcttcaccctgttggccaggcggttctcgaactcttgacttaaggtgatctgcccacctcggcctcccaaagtactggaattacaggcatgagccactatgcccagcccccatctcttaaaaaaaaaaaaaaagtgtattaagcaccagctgtgtgccaagccttgctctagatgctggagacaaaaatggagagagagagaaaaaaaaatccctgcctttgtggagctcagattcttgttggggaagtaggtaataagataaatgctgggtgtggtggctaacacctgtaatcctggcactttgggaggcagaggcaggtggatttcttgagtctaggaatttgagaccagcctggtcaacatggtgaaaccccgtatctacaaaaaaaaaaaaaaaattagccaggcctggtggcgcttgcctgtagtcccagctactcaggaggctaaggtgggaggatcatttgagcctaagaggttgaggctgctgtgagctgtgattgtaccactgcactccagcctgggtgacagattgagaccctgtctcaaacaaagaaacaaaaacaagataaatgcctagatatctgttagattagtggtcagttgcaagaagtaaataaaagaggttgaggctgctgtgagctgtgattgtaccactgcactccagcctgggtgacagattgagaccctgtctcaaacaaagaaacaaaaacaagataaatgcctagatatatgttagattagtggtcagttgcaagaagtaaataaagcttccatggtctctgcgtgtgtatatgtgtgttgagaaggaatattgggaataatgagtgattgtagctgcatcttgtttccgtgtgaaatgtgtctttaagctcctgctggggtccagaccccatcccgtgttgaaatgggactccctggttgtttctggggcatggtgtctgtggaagaaggtggattctggatcttgcctggctgggaatgagggctccagcagcaaggcttagggtttgaaggggaaatagtgtgtgtgttttaaggggctcagggggagatgtctttggatatacatgaagagtgcttagaatagtgctaagcactcaataaattttagctattaacatatataatgtactgtgccttttgttataaaacgcagacctttaaatagaaactagaagggccacgttcttggaaaaaatgttcagtgttagaagcagtaattatgtattaataattatgtaagtgccaaatttggagcatgcacataatgttgatctctctctacccctcaccctttcattcccttaggccattttggaggaatacattttaaggcgggaacctcggatgtgttacgtaacaaaggccttcttgtgttactgtctagtggatcagtaggcaaaaggaagaaacacattctcaaagcatggtcagattccttaaaatgtacttagataagggggaaaagggtaagaaatctagtaaaggtgtggtgcatgctaattgatggggaagacaaaaaaagaatataatgatttccgaaactctgaccatatctaggttagtgacaaaatttgagtttgggaaaaatatacatatcagggatgcaagcttattctatgcagtttacacctgcaattgttattgttatttttttttttttgagatgaagtcttgctctgtcacccaggctggagtgcagtggtgtaatctccgcttcccaggttccagtgatcctcccacctcaacctcccgagtagctgggactacaggcacatgccaccatgcccggctaatttttgtatttttactagagatggggtttcaccatgttagccaggctggccttgaactcctgacctcaggtgatctgcccacctcggcctctcaaagtgctgggattacaggtgtgagccaccacccccggccatcctgcaatttctttaccacgttttagccttgccttttttttttttttttttttttgcctcaacagagaattctttattatgtccaaaagagcacaacaaaaacatcccaacaatacataaacctatatataaaatatagaatatctccaaatttttactttctatggcagcacgccaatatatacaagagaacatattgatggggcaaagggaaaactgatttgggcaatgacttaattagtcaggcattaacattcagagacctggtaaacagcaactttagtcagaaaagcaatatgagaagagttcctgtgaagctgggatttacatacttcattctccgttcctggtcatttcatccacaacttgactgttgtcaatcatggttctttgcctttggagtggtactatgaaggtacagagaatagagaatgcccatctcagtaccaaaatttcaccatgaaaaatcataatagaaataacaaagcttaaaaaaatgctgcatttcagaagtatttaccctaataatttttaagaaagcttaccataaatacttctaggttagtgacaaaatttgagtttgggaaaaatatacatatcagggatgcaagcttattctgtgcagtttacacctgcataggccacccatctcggcctccctaagtgctgggattacaggcgtgagccaccacgcctggccctggtatatgttttaagtcaaccagttctccttaagtacttgtttcaacatcatgttattgtgtactacagaagcaatctctcagttatgaaaaataaaatcagtttcagggctcacaaagtaaaaagggaaattctttcccaatctccccttcccccaccacctggctttttttgtttaaaaaattaaattcaaatgtataagaccaagcaccggcactttccaaaaaacaaaaatgaagccaaatcacaaaattactcaatagttatagaagacagctctgattttggggggtcatctctggttgcctcagtacaagcattgatctttggctgctagccttgctttttagtttaaggaatatggatcctattattggtattaaaaattatacttctaaaactattgaaggctattactaattatttcagttctctatatagtattcgtacctcagtttaatagtgcttactaagtcatttaaataataggtctctgttgaaaaatattagaattgtacccttccacctctaaaaagtcagagttcaggatgaaaaggtatgaagtcctctgttggtcatagtattttgtgggctaaatcattgtctaaaatcagaaagacagcgcagtggaaggttctaggagttgcatggatctgggttagaatctcagtgcctctcgcaaccaattgtttaaaatgtgggcagattagtccctccatttccattttctcttttgtgaaataattattattttgcaaggctcatgtgacaaagtggattagtatgtgtgtctagcataatgtagatgctaaaattaaatgattgacttggcaccagtcagagtttattcacttttaatattgattttgaaagtctccagtcagattgcttaattgatacacattaatttttactgttagatttttaacttattattaaacaccaagtttgataataaatactattagtgaggtaggaggtggaacttgactccagaccagattgaagactggctgaaacagggaagaggtgaaagcacctctccataagacacgcccaccagtgccatgtcagtttaccattgccatggtaacacctggaaattaccacccctttccatggcaacaacctggaagttaccaccctttttctagaggtttctgattaacctgccctcttaatttgcatgtaattaaaaatgggcataaatatgactgcagaactgcccttgagctgctgttatggagcagtcacagagcttaacactgccacgtcagtaaagcagtttccttctaccgcagggtcgctcttcagctctttcctaagtgcagttgagaatcttcctgggctgagccccagtttgggagcttgcctgcccttcatcaatagcagtagtaatagtaatgatgatggtagccagccagatatagtgaagtgttctatgtgttctcagttactctgaacaagggccctcaaagggcaggtatttttatgttctttttgctgacaagaaactgaggcttagtgagactgagatttagaaagtaatgaaaggaaaaagttatgttaaatgatcacttttttatggagccatgcttttttgtgcttaatttattgcctattgctcatatgtgttttacattgttcagtgttttctcaagataagcaatgagaagtaacagctgtagtcaactttcttccccaagtactaagtaaataaggtggttaggtgtagaatggaattagctatggaatgctgattgtttattttctatgtaggatgaaagaaattaggcatgaagaaggaagataattttctacttgctatagatttgaaatagttttctttcttttgctttttttttgtttgacctactgaggagttcagagtggttaactgaaacagactctaaaaataccctttggtagcgtgctcactgaagtattttctgtttgtctaaaattagcagatttgagcagatttgagcagtgtactctggttttccaaagccttccattaggtgacttcttattctggtgtactttgttatctttctggataacacgtttgatgggtgttaaaaggtaaagccaggaatggctttactttctaacagaatactttacaaagcagtttccagcttagatacttcctcctacagggaaccttcccaaggtgtttccttggcagtgctcccttccttatcccgccactgtcccacatgtcccacctaggccttgaagggcagaacctgtgctctgttcactgttgtattccagtgcctgacacaactatttgcacagtatttaggtgctgaacaaatatttattgaatgccaaaattggttcatttactaagcagaaagaaaggaaaatattttttgttggcagtgtctgcaaagagatttgtcttttcccatgaaaattgagaagtggggacagaaaagcaagaaagtgggagcaaaagtaattgagatccacagtggctcaggagtgttgaccggtgcagggtgtggtagaagcccgttaatgggtaggggagccagatacggaggctcagctgggctgggggcaggtctgcaagaaatgggggggtgtggagaaggttaccagccgttaccagagttttcctctgcattgggaatttctaaggtgtgtttttgtttttaaaacaatatctgtactttcaaaaatatggtttctttgctgcaaggggaacacatttattttgtgaaagtaagtgtacctagttaacagtttccatttattaatttctggaatagtgttttggttacttggaatgtgtgtgtgtattttctttctttctttctttttgagacagagtctcgctctgtcacccaggctggagtgcagtggcgccatctcggcttactgtagcctctgcctcccaggttcaagcgattctcccgcctcagcctcccaaagtactgggattacaggtgtgagccactgcgcccggcctattttctttctattacaagtcccttgcgggaaagatggtcgtagctcctattctaaatgaacagaagttctgtcttagaaattttcccattttacaagtgttcaaagaggaccaaatttcatcctctttccctgcctgtgtcctggaatcagctgagaagaaagacaggagtaaggtggtcttcaattcagccagtcttcaattgttggagaccaaaatttacctttatgctgatcagggttagagctgctatgcagaacatggcttatctctgcgggcaagtggccttcctgaggctcatctccagagctgtgcagcagaatgttgccctcaaaagaggacagagggcaggactggctatgcatgcatgctcactcccttcttccagattcactgagcctgttttccttctgaattaagaggtaagaaagtaacacctggaaagatgtactttcccaaggtcacgcagatagctggcaacaggtttttctcctgggctctagaggcctttggtctgagtagaaagggcatggttatggggttggccaggccttgtgttcaccacattctgcttctgtgctcttagctttcatttctgcatctataccatggggttaaaatttctaccctcgggattcctgggagggttacctaaggtgtaactgttgaatgacctgaaccagtgctttgcactcagaatcagcaatgtaaatatcactcagccagcctggggcactttcctctatcaaaccttaccaatccttttcttcttcttcttctttttttttttttctcttcaattgaaacagggtctcactgtcttgcccaggctgaggtggaatgtggcacaatctccgttcactgtagcttccacttcacaggctcaatcaattctccagccttagcctccaagtagctataggcacgtgccatcacacctggctagtttttgtattttttgtagagatgggttttcaccatgttgcctaggctggtctcaaactcctgagctcaaagcgatctgcctgacttaggcttcgaaaatgctgggattacaggtgtgagccaccatgtccagcctcgttgttctttcttttaatcaccctggcttggcacctcagaaaacatggtgattggagtttagctttcagcagggtgggacttggatgttgactgttttaattttgatttttttttttttttttttgaaacggagtctcactctgtcgcccaggctggagtgcagtggcgcgatctcggctcactgcaagctctgccttccgggttcacgccattctcctgcctcagcgttgtgagtagctgggactacaggcgcctgccaccgcacccagctaattttttgtatttttagtagagatggggtttcaccgtggtctcgatctcctgacctcgtgatctgcccgcctcggcctcccaaagtgctgggattacaggtgtgagctaccgcacccagcccaattttgattttttaggaggaaaaaaaattgttcctaaggaagtcaagtcctaaattgaaagactttcatatattacacaaaccctagaaaaacttgggttacacctgggattgattttgaagtagggcgttgaactatgtgtcctgtttaacctcgaggagcaaatggctttccattctaaacattctcatttcttctctgggacattctttaggtgcttgtttgagtttctgttttgttaggcacattagaggactctatatgaacaagttcctaggggaggaaattggtgacttagatgaaagggtgaaaaaggtgaaaccttcacattattgtgtaagggattgtcccagaatgtgtgaaatttgatgtagtccttcttggcttcgttttttcctcagatgttctggatgaaacagttccccctgtcacacgtggagataaggatgtggctctaggcagggcatatcctgtgtttaagactgtgttgactcttcttttacagtgtctgccacttgtttcctgcctaggtctttagttttgagtgaagtacagctgtgaagtcctagacttgtaatgctaaggcgttcattatgttaaattcagtttctctttttcttttctctgcttcacatcagccttgtactttagcacgtttccagtccagccttggtagctgggctgctgttctccttgacccgtccctttgcaagcagcagaccacggccagggttgggagtccggctgggccactgaccgcagtgctgaggaaaggtggagcgggaggccctttcctcccagcctcgggcttcctgtgcaagccactgaggaggaaaaggagctggagggtgtgtgaaccctcaggttatacaagcagcacttctatgcaacaaagaaaatgtaaattgctgtaaattaccaaaaaaaaaaaaaaaaaaaaaattgctggcaatctgctttccagggcagatggagggtagcttttatttatacattggtcagctgattgagtaatgtttaaaaaccacctttacttctggcacttcttggcagtatcagttttttttttttaatggatagagaagcttttttattttacagataataactgcatatctttacctgagggagctcaggttcgctctatctagcagcttccacgtgtcatctctgtatgtgcagttggtgcctgcattaaggaggacggacagccttgtggcgttggtgcctctgttttgtgtctaaagctatttatttgggggtggctgccccaggagcagcacatcaaagtggtgttcagttatgctggccaagtgctgaattgcattgtgtttatttttatttccaaggttattttattttttacacatgaaagcctttttccctcctagattttactgtttttttttttttcctgattaacaaagatgtacagactgaggagaagtttttgaaaattttgtaaaaatgttgaaatttttatgcagaaagagaaacaaagtgggggcccatcccaaatctcaccaatcaggcagaaactatttgtcatactggatacggtttctctctctctctttttttttttttttttgtgggggggatcttttcattaaaaaactcttctgtaggtatcttaacagcacttgcatggtccttaggagatgaaggtgtttcgccatttctggagtgctgcacatgtagttttcttctttttaaattgtcagtggccctggccagattactaattccctactaagttgccagttgtgctagtaccccaccctccaaaatccatattgaccttctgtatcaaaatggctaagtcgtcagaaaccagcagtgggcaaacgttagggtctcagctttcctcctttctttcacttgcttggcttcattggctttgaatcggatagacccgggtaggaacctcacctagcccctccactaactttgtgtcctccggcaaaataaatctccctaagcctctatttcctatatgcaaaatagggatgatagtattacccaattccagggttattgtaagaattcagaggcaagttgtgaagggtgtggcatggtgtctggaatgggtgatgatacagttccctaaggggagctgctgccacctctgtgctggggactctccctttgccccatcccaagaatttgggttggctaatcctgccctgtctggttttggatgagggaccaggaaagaaagggaggcaggataggggaggtgtttttgagaaaaaccttctttttccctctgcaagtatttgtttcaggcagtacgtgaaccctcgaagactgatcggggctggtcctgggtcaccccagcagggttcagtgaagtgggccaggggcactggaccctcggctttctccctgcagggggatctgcctccctggcctcgcctcttgtgatcttctatgcatgttcactccttactcactctgagccttctgactctgaccagcctgtgttcctggcattcttttgatgatgtaagtgtttcacaccctatctgcaaccaagcaggaggacggagaggacttctgcagcaaagagtacctctagaaattgcttttgtgaggttctttgaggtgctaatcacctaacttttatttgaattgctctgacttatcatttaataactccggaggactttttacttccttggcaggaggaggaaggtgattcctcagataaaaccaaaacctagagctgcacttctgaaggaaattgctgctcaggtagggctggatgtgtaggtgttctccatgggcccatgccgtgcctgtaccagcgtcctgaattgacggcagcagaggggtatctttcttcattcttcattatttattgcctgaggcagaatgaatacttgtacacttgggatttcagccatgccttttaagggctgtgaacagacttatcaaagagccatcttgagtggcctgtagggcggaagggagaatacaggacaagaaagtggatggaattaatgggaacaagagtgacataaaatagtttaaccccctgtggccctcttcagacttttacatttgtctatttttatttatttaaaattttttaacttttgtgggtacgtaggtgtatatatttatggggtacataagattttttgatacaggcatataataatcatatcagagtaatatcaccccaagcatttatcatttgtattacaaacaatccatatatattcttttagttattttattttgttatcttatttatttatttattttgagacggagtcttgctctgtcacccgggctggagtgcagtggcacaatctcagctcactggaacccccgcctcctgagttcaagcgattctcctgcctcagcctcctgtgtagctgggattacaggccggtgccaccatgcccagctaattattgtatttttagtagaaatggggtttcaccatgttggccaggctgatcttgaactcctaacctcagatgttccacccacctcggcctcccaaagtgctgggattacaggtgtgagctatcgcacccagcctattatttatttttgagagataggatcttgctctgttgcccaggctgagtcatgctcactgtatactctaccttctgggctcaggcaatcctcccacctcagcttcccaagtagctggaaccacaggtgcacagccgccactcctggctaatatttttattttttgttcagacggtggggaggctcttgctgtgttgcccaagctgatcctgaactcctgggctcaagcgatcctcctccctccgccttccaaagtgctgagattacaggtatgaaccactatggctagcctggtctacagaaatgtctaattttcttcagactttgttctcccttcaaattaggtttcatctggcagagtggctactccatttgtttgcaagcctctgcccttgatgttcagattcctgctgctggtggagccggctgagtttcccagatgggctccacctgcctcctcctcggttgctgcagcattcattgcttcgtgcttcctgtctggctcgcctccaaatgagcctgttcatttcctttctccggaaactgtccttatcactgaggttcaaaagttccataaaggatatggcagtcttgagacttgacctccaaactttgaccttaataaaaactggttttttaaacccagccaacctgaatgagtggactatggcttttgattgctgttagctgaaggagatgtatggctgctgggtgacgccttgaacagtgagatgttatatataatcttgaatttggggtggtgcttgtgtcaccactcggaattatgttgtcagtctcacttccctcctggcttcttggcaatcgtctttattaatgttttcaattttcttactatccagtgaacttactttgtatttattgtttggggtagtgttgtagatggtattactatttgaaaacttactgttgaaagggaccgtagtccagtggcctcttttaataatcagggaaaactgagtccatgaagacacgcctgcctttgaaaacctaagaatccactgctttttctgttgagacagaccccacagagatctccgagaggacggctgcagcaagagtgctgactcccatgcagccgcattccttttctaattgtcaaagctgattagtggatttggatgtgcgtggctcggagtcctctaataatctttcctttcttacatagctcacctagaatttgaggaaaattaaaccagttgtgaaatatatcacgtttcagaaatgaacggcatcttaattgattccctttgagaacacatcagactgggatttctgagtgtaatctggtatgccttgaggtggggacctcatgctggggcactcagaggagactggtccacctccaagtttgttttctggctccaaacaaatgagtggctgtttgactgttggcacactacccagttttaaaagtacaaccatatagggtatggagggctggtaaccagggggtttaaaaagtgaggtcatggaaggcccagatgaagctcttttaatgtgtatcacaactgcaattaatcttattaacatgctgggcctgttcctgctttcgctgccccaggtgtgtgagagtatttagggggcatgctttgaaggattcttgttctttgatgatgcacatggataacagaagtacatcaaactttgtatctggcattaaaagggcttttgtttgcctctgtagattcattcagttttgagaagagagcaaaaagcttcatgccaattgataagatgtacaaaagagggtggattgcaaatgcagtcttgcagcagtgagctctatgaccagatcagaatcagctgaacaggaatggagccctcttctatatccaacactaaggtagttccagcacagtattctgggagtgaaagatgtaaaaaagcagccaggcacagtggcttatgcctgtaatcccaacactttgggaggccgaggtaggaggatcgcttgagcctgggaggcggaggttgcagtgagccgatgtggccccactgcacctcagcctgggcgacagagtgagaccctgtctcaaacaaacaaaagtgtaaaagcactgttgtgtatttgggaagcaaaagtatgcacaggaaacaacaaggcatagaaggtgttgtggatcctaaacctgaattgatgagggtagcatgggggttctgagggcagggaggtaactgagggctgttgtggttaggacggcttcctgggtggggtgggccttgaacgcaggtgaggagcaggatggggtgcaagtggtgctcttagcttgtgctgactgggtagggcagtacgtagtgagaggtaaagttgggggagtatagtagcagcgggtggtacacttcggttttctgtgtgcactctttctctcttgctctcttgtttttctttcttacaagtatgtttaaggaaggctagtatagtactccagccttgtaaggttgccgcttcattttattttttagactatgtgttagaagttgtctaaaatacccacctagccccccccccccccgccaccccggcttcttgcttaacaagtaacctcaaggaccaagaaagaggttaaagtttcaagttcaacagatggggattgcgtgtgctaataatcctctaatgaatagaatctgctcacttcaatgaaaaataagaaaaaagaaatatttgttcctttataatgtactcatttgctcatagttaatgaatatcacataagattaaaagtcgcttaaggttttcttgctatgtcctttaactggtttattttttaattttttaaattttaaatagagatggggtttcgcaatgttgcccaggttggtctcgaactcctgggctcaagtgatcctcccatctcggcctcccaaagtgctaggattacaggcatgagccactgtgcccggcctggtttcttaactgcaggatttcttagagtctttaactttctaaggaacactgggaatctctaagaggagtgaaggaggaggaagaacaggagggccttttctgtccacagcacattttggaggattggtgttccatggaacactctttggaaagcatggccccccgctgttctgcaaagctgtgtgccttgcccttgttcattccagttgccctctgtttttccacttacttttcctaccctgagataacagtgatgcatctattgctacaaggaggattaggggatggggagaggctgttaagtccctctctaaccttttcctgctgttcaaagcatgaacaaagtgaacatcttatatggctgcactaaaaaagttgcccgcttacaagctgaactcaggcaaaatgaactcctgaatcctcacataaacggaaatagagccccaccctgtatcctgccatttaaaaaaaaaaaaatcctctcatctggcagggggaaaaaaatcccagccctagagtggccaggatgaatcagcatgccagggccatacaccaagataagcattgagtctctagatgtggcaccatggcagattatcaacactggtgccgtgagaacactgcagcaagcagcacactgtacttttaaggacaagaacagcagcaccaaacaccccagaaacaactgttctgattctttccttcaggagtagaatttttttttttttttttttttttgagacggagtttcgctcttgttgcccaggctggagtgcagtggtgtaacctccacctccagggttcaagcgattctcctgcctcagcctcctgagtagcttacaggtctgagggactacaggcatgtgccaccacactgggctaattttttgtatttttagtagaaacagggtttctccatgttggtcaggctggtcttgaactcttgacctcaggtgatccacctgccttggcctcccaaagtgctgagattacaggtgtgagccactgtgcccagcttttttttttttttttttttttttgatggaatcttgctctgtcgcccaggcttgagtgcagtggcacaattttggctcactgcaacctctgcctcctgggttcaagtgattctcctgcctcagactcacaagtagctaggattacaggctcacgtcaccacacctggctaattttgtattttcaatagagatggggtttcaccatgttggccacgctggtctcaaactcctgactgcaggtgatctatccaccttgggctcccaaaatgctgggattacaggcgtgagccattgcacctggccactttttttttttttttagacagtgtcttgctgtgttgcccaggctggagtgcagtggcacgatcttggctcactgtaacctccatctcctgggctcaagtgatcctcctgcctcagcctcccaagtagctgtgactacaagcgcacaccacgatgcccagctaattttctatttttagtagagacgaggtctccctgtgttgcccaggctggtattgaactcctgggctcgaaggatccacctgccttggcctcctaaagtgctgggattacaggaatgagccactgtgcctggcctggagtattgctctagaacatcctgtttcacatcgttttatgtggggtttttccttcctcattcttcatttacacctctgtctattatagtctgtatttgcaatgtttactacagtaattagatggagcttaaaattcagttctcatttccagggctcagaagccacatgttgctcctggctgctctgatggacagcacggtcacaggacatttcctccactgcagaaaatactgctggatagccctgatgtatatcaacaatgctgatcattatttgagaaaacgttctgggctccctcaatacctctgcctactttattattttaaaacaattttttgtaggtgcataccatcatacccagctatttctatttttttgtttgtttttttagagacagggtgtgctgtgttgcccaggctggccttgaactcctgggctcaggtgacccttccgcctcagcttcccaaagtgctgggattataggcgtgagacaccatgcttggtgactctgcttactttaatatcttagaagttttggtactgaaagtgaagaacattggacagacatcaaacgtaaatacaaaactgtcccaggtggctcttctcatacatttcactagggttgagcaggacatgctccccacctggaagaccctcctagggctttgtaggtttagctctgtgtgacagttctctttgtattcatcacagggcggtctccactttgtatacctaaaagacttctgagaacagtatttttccctattagtcatactttaaaatctagtttaggagcatctaacttcacatgctgaaattttcttttgaaatttcctttgaaacccccacactgcttgctctgtagctcatggaaatcacttacttcataccatgcttcattgcaaacctgctttggtttgcttataagtccctccatgaattcagtggaaatgtctctcccagagaatgtttttctcttaaggtctggtccatggtactttatttgatgtccttattagaagacatctagaggagtcaagacctagactcagttcagtttgagctaggcttgaattccatttgcaacatgggatgggcccactgctccaataaatgtgatgttttacatgtgaaaggtgcttgatgttttgctctatgcaattcctaggctagaacctgttctgtctgttattgcactgggtattgcagtctgttggtcatcagcaggtgactgcctattgccaaaagagacgatgagatgaaaagtaggaattcatgatttcagaatctagcctcacttggagaaagcacctgttggcctgggaagttcacccttctctgctgacacaggctggaccccacacctgaccaggtgtcagagcacctgtgagagctctgggacctcctagtggcagtgtgatggtaccacttactgagtgtcatgccactggcatcaggcactgtgcatatattgtcccccactcaatcagagcatctgtgctattaatatttgctcttttttgtttgtttgtttgtttttggtaaaaggtctttattttttaaagagatccgtaataccaaaaaaaaaaaaaaaaaccaaacaaaaacccaaaaacctcttgtggggctggggtggggagtaaggtaaactaggctgtcagccaagcaaaggcagaaaggtggggtccacaactgtctctcacagctttaagtgcttggcaccaataggcactcaataaatagttgttgaataatggcttatattatatcttcataacagttgtgtagatattcttttgcacattttacagtaatgagaaaactgaggcccagagaggttaagtaacttgcctctggtcacgcagctagaatgtggcagagctgtgtgattttagacctaagtatgtctaaatcatagtccacaggccgtcactaagctaaagtagaggaaatgatagggccacattcaccttctctcttttgaacagtcactcgttttttgaagcgggggtggggacagagttgctgtgttgtccagactggagtgcaatggcacgatctcagctcactgcaacctctgcctcccaggttcaagtgattctcctgcctcagcctgctgagtagctaggattacaggtgtgccaccacacccagctaatttttgtattttttgtagagatggggtttcaccatgttggccaggttggtctcgaactcctgacctcgtgatccacccaccttggcctcccaaagtgttgggattacgggcgtgagccaccgctcccagcctgaacagtcactcttaattgcactatgtttatttgggcattttgttatgtttttatgtttttaattttgatataatttcacagttatagaaaaattaaccaaaagagtataaacaattctcagaccctttactgagatttgttgggacatattcttagaaagtctgagttgtgagcctgtgggattgggccgcacttcttgagtagagcctgggtcatgctacccgagaactcctgggtgcctgtgaggttgggtgtgtcccatctgagaaagttcgctactgaaaaacagtgacgtaaccccacccaggaactgaagtgagcctgagagcagctctccagggcttgctggctggaaacaatgagggaagagtctaggatttatgaaatatttttttgtggaagaactcttcctctgagaaactgctggagggtttggggaatacaaaacaaaactgacttatgaaaagatgacttgtaactcaccaagcagacgctctcaggcgtggcatgatgccctcactggctgccaagaacaataactgacacattatccacagacggctgcgccccatgccatttcctctcctgccatcacaatgaaagaccagggttgacacttggtattgtatctattccacgtccgctgcaccattttcttttaacccttctttcttgctctcacccctttacctgttggagctactatgcccctcctgggtttcgttttcttctcttcctttttcctgggcatacagctgcgttcctagaaattgtggttctgattcataatcattgtatgtggaggaaggggcaggattctactctgtgaggggacgggagggtcttttttaaaggggtaaacaattggaaagtttttagagttaagggtctttctctgatgctaaatgaaaccactgtcctctgttccaaggcctgagcttatatcttctttgctatgagacccagagaaacagtgcttgggggccattttggaagcagcttgtcctttgaccttccccactccacttgtgcagacaccacgccccgtgaggacgggcgtggtgtctgctgctgagcctgactgccccacacttaggcaggtacctggcacatggcagaagctcagcaaatatttgctgaatgatgaggccttggtgtatgattgctacatttttggcttaaaaagtacagcatcagggcccttggggttttacctgcttttctgggatatactttccagctgatctttgtttttttttgtttttgtttttgagacagagtctcgctctgtcgcccaggctggagtgcaatggcgtgatctcggcttactgcgatctccgcctcccggtttcaagcgattctcctacctcagcctcccaagtagctgggactacaggtgcttgccgccatgcccagctaatttttgtatttttaatagagacaaggccaccatgttggccaggctggtctcaaactcctgatctcaggtgatccgcccgcctcggcctcccaaagtgctgggattacaggtgtgagccaccgcgcccagccagtttccttagtttttaatctctgagaaggaaagataattgttacgtaaggatgtctcagttatctatgtgtggatgatccagggaaaatttctctttccagactggcttactctttggattttcctcaagcttctcggtctgcctgtgcgaaggggcctaaggctgggtgttaagtcccatagcatgagcaaaacctgtaatttagggttaaccagctttacttaactcccattaccccttttccttctcctcattcttagaattctcacgtgagtggtagtaagcccctaggatgtatgtatgctgctgtgtatgtgcttagccatttcctgtgtatttaatggtgaacctttggtgattcctcacatggaacccttttgcccttggtcacacttgtgaaagcacctccacatctttgcaatcagatcagcctaggccaggaagcaccttagaggaggtgattgactctagttccttgtttggtagagaatgagggaacaggctcagaaaggttaagcccaaggcacagggttagttggtgacagacccaggactggggcccaagtcttgcaggtgtggtgcactttctgcaacacccctttgccctgccaacttcccatcccacatccatgagattttaagtcccttattgtacactttttagtatatgctttgaagagtctttggacagttaaaactgaatgtacaagccaagactacctcattttcttcttcagctatgactggtacccagctaattgtggattggtaagagcaagacaatcagagatatgatacatgtttaaaacttcattggggctcagtgcagtggctcatacctgtaatctcagcactttaggagactaaggtgggaggactgcttgagcccaggagttcgagagcagcctgggcaacatagccagacgtcatctgtacaaaaaattagctaggcgcagtggtgcttgtctgtagtcccagctattcaggagactgaggtgggaggaatgtttgaactcaggaagtcaaggctgcagtgagccgtgatcacgcccctaaacactagcctgggtgataaagtgagaccctgtctcagacaaaacaaaacactttcttggaagtagtctctggagcttttgaaagtttattttaatccacagcttttcccccaccaaacactaataccaaaaataagattactttggggttttaccttggcaaataggatgctcccaagggactttgaagcctacccctgaagctagggaatgaacacattatcttgtgctggtatttatccagtattacccaatatactgacccattagacttcaccaggatggtgctgacattgaaaagtcacggagataggccgggcgccacgagataggtggctcacgcctgtaatcccagcactttgggaggccgaggcgggcggatcacaaggtcaggagatcgagaccatcctggctaatacggtgaaaccccgtctctactaaaaatacaattagccgggcgtggtggcgggcgcctgtagtcccagctactcgggaggctgaggcaggagaatggcgtgaacccaggaggcggaggttgcagtgagcccagatccggccactgcactccagcctgggtgacagagcaagactccgtctcaaaaaaaaaaaaaaaagaaaagtcaccgagataatttgtagtcagcacacccctcttagggtctaaagtcaaagatcttgaggcttcaatggatcaagagccttttcttactctacgtggtattgacgcaagttctgtagtagcccctcctgctgtatttacgacactagcttccagtgggcagatggaaaccagtgcctgcctggagactatccagctgtgagaatgatgtgatgtgtctggcagaaagaggcgtgtttacaaaggctttattttgcaggagtaaatcattggattttaactgttcttcctctctttgtgttgaatctgattatgcagcttttctgtaagtttttaaatgtttacccacaccagacctttggggactgattggatttagtgggagcaccctagaagacctggattaaagtggaacttggtctctcaactagttgggttgtccttggacaaactgcttgacctctgtaaatcttctgtccttatctgtaacgtaggggtgctaattagcattaattagctcattgttgggaggattaaatgagaacacccctgtggaattacttagagctcccagtaaaggttggagttagggaggattagcaggctttcatttgcttccacattttttttcagcagtttaatttactgaaactggcataataatgcctccttgattaggttgttgggagaagtaaaggcaatacaagtttggtgcctggtatacttcatcagggtgacaaaatgctgtcatttggtcatttgtgatcatgtctgctactgcataatgtcatgcactggtgggactctttagacagctaattattggtaaattcttcacagtgagaagaggatttaaccgatatttctccctctagagtgtggggaggtagagaagtgggtgagactggaagggtgggaaggagaagtctggctacttgtatcttggcctggggatttgtttggaagatgaattatcctctggtagttgtgtacagtttacaggtcagtgattagtatgagtccgtgaatagtgccagttaatactgattaactgctgtactttttgccaataaatattgtaaagctataaagacaacagagttaatacaagttgctaaagagaaacttgtggtaaatgtctttaaatgttgtttaaaatagaaatggccaatctagcaggcatgctgaggaaatgatgtttttgcagaagggaaatttagcaatgacagttttgcagaatatattggtaatgaagtgttacttgtagctgctgacaaattagttttcttaaaaaatatatcccctaggaagactgtagtatgaaagaatgagaaccgtaattggtggatgagcctggagagtttgaaggtaagagagaaagagaagcagcgagggagagaaggagagagagagagagagagagtgagtgtgtgtgtgtgtgtgtgtgtgtttcaaggtaacatgcaagaacaataaggttcttcttgtgtggttgtaatttttttttttttttttttgagacagggtcgcactctgtcacccaggctagagcatagtggcataattatggctcactacagcctcgacctctgggctgaggtgatgctcccacctcagcctcctaactagctgcgactacaggtgtgcaccactgtgcccagctaatttttgtattttttgtagagatagagtttcctcatgttgcccagcctggtcacaatctccagggcttaagctctgccgtccttggcctctcaaagtcctgggattgcaggcttccaccaccgtgcccggcccttgtgtggaatttttaaaaaatcctgacttatctgtttgtttgtttgtttgttttttttttttgagacagagttttgctcttgttgcccaggctggagtgcaatggcgtgatctcagcttaccacaacctctgcctctcacgttcaaagtgattctcctgcctcagcctcccaagtagctgggtttacaagcgtgcgccaccatgcccagctaatttcgtaattttagtagagacagggtttctccattttggtcagggtggtattgaactcccaacctcaggtgatccgcccacctcagcctcccaaagtgctgggattacaggcgtgagccactgcgcccggcctatccgcacttttttttatgattgctcacatgtgacatgtcttgtttttcttctaggatgttgagaaagagaaggaaacccacagttacctcagcaaagaggagatcaaagagaaagttcataaatacaacttagcagtcacagacaagttgaagatgaccttggtaagcactcaaaatactatttaggttgacacctgtcaaaagacaaatataaattgttggtactacaatctatagttctaaatatctgaatagcatttgtagaagtgtagtagtcaaggtatacagaacaggaaagtggaatatttctgtggctttccatttaaatctgtattgtgaagtagctttgtctcaaaaatcagttgctgggttaaccttaaaaaagtgaaacacttataattttattttaaaagattttgtgacccacccctccctcctcaaaggatttttagcatcattgcctaacatacagaaatggtgactcagattctaagaagacctcaggtaaggttttttgttttgttttgttttgaaacaaggttttgctctgtcacctgggctggagagcagtggcacgatcaccgctcactgcagcctcgacctccgggctcaagtaatcctcccacctcagcctcccgagtagctgggaccacaggtgcttgccaccatgcccagctaatttttgtattttttgtagagacggggttttgccatatcacccaggctcatctcaaattccttggctcaagggatctgcccagcttggcctcccaaagtgctgggattacaggtatcagaagcccctaagtttttgtcttgtacaaaataaatatggaagtgtcagggaaaggattttgagcccatggattggaatatagaggtatataataggatagttttctctgccggtcgttagtgtaagacaaggtacttaatactcagtttcttccacgtcgctgtcgcaggcttccacagcattgtgccacactgaagcatgcagggagtcggcgtacaggagggagaagcctcagggcctggggatagggaaacgagctgacagcggagctagagtattcatgttcctctaaacttagctggcatctaggtctcgcctacccattgggtggcccgccttcttcatggcacttgtcagcccttggcgccagtttccagggcacttggatccccgtctctcagtctgtttactgtgaactgacagagtttggtaaaggacaaggtgattggtttaaaacaggccctaccgaatcggtgattcttggggaggagctttcagatagaaacccttgtggtaaaggacccctccctggtagaactcctccaaaaagaggggagaggagcagagaatcccaagataactcttcatcattccagcagcaagatttctttttcaaacacattttttcatcaaaggagaaatccacttgctatgttttttttttttcctttcctgatagagactaaaacagatacaaattatccatgtcattttaaagataaaaattttaggctgggcacagtggctcacacctgtaatctcagcattttgggaggctgaggcgggtggatcacttgaagtcaagagttcgacggtggctcacgcctgtaatccagcactttgggaggccgaggtgggcagatcacgaggtcaggagatcgagaccatcctggctaacacagtgaaaccctgtctctactaaaaatacaaaaattagccaggcgtggtggcgggcgcctgtagtcccagctacgcgggaggctgaggcagaagaatggcgtgaacccaggaggcagagcttgcagtgaggcaagatcgtgccactgcactccagcctaggcgacagagcaagactccatctcaaaaaaaagagttcaaggccagcctagtcaacatggcaaaaccccatctctcctaaaaatagaaaaattagccaggcatggtggcgggtgcctgcagtcccagctactcaggaggctgaggcaggaggatcacttgaactcaggaagttgaggctgcagtgagctgtgttcgtgccactgcactccagcctgggtgagagagtgagaccctgtctcaaaaaagaacaaactagagaattaggattgaaaattgatcttgtgggaaggaagaaaaataacacaccataaagatagttttaaatgttctactttaactgtggcatttatatgtaacacttgacagtttaataaaacagtacaataaatcttttctaaatatactgtttttgtttgtttttgagatgcagtctctgtcgcccaggctgaagtgtaatggcgtaatctcgtaatctcggctcactgcaacctccacctctgggttcaagagattctcctgcctcagcctcccgagtagctgggattataggcacctgccaccacacccagctaatttttttttatttttatttttagtagagacgggatttcaccctgttggccaggctggtctcgaactcctgacctccagtggtctgctcgcctcggcctcccaaagtgctgagattacagacatgagccactgcgcctggccccaaatatactgaatacaaaaataaaaataaaaagtgaagaccaaactgttattactgtttttggcaactaagaaatagtaattctaccatcagtgaaggtagttgtttttaagatctgtactgtgaagtatagtggtttgaatttgtttttttttgttttgttttgtttttgttttttgtttttttttttgagacagaatcttgctctgtcgcccaggctggagtgcaatggcgtgatcttggctcattgcaacctccaccttctggtttcaagcgattgaatttttttttaaaatgctgcttaagagacccgaaatgcattctatgctgtatggcatatatgctgcattaaaaagtttaagcagagttagtaattcagtgcatatgaatatagccactaggaatgaaaatagcctgttttcttactgtccccttgttgttgacttcagtatttcagagccctaattgtgaccttccttttgtgtataatagtcaccagttgaggatgttgtttcctttgagcctgtagcctagacatatcccccaagctttaataagttttgtggtttggctagcatctgctccgttggattgtaacctcgcaaatggaccctgaccttttgccagtagcttcagaggcatgagtctggggccggcagtcagccacagcatcaggaggcttcttcagtgtccacatctgccctgcagaccttgcctctggaagcactttgcctggtgtgttaaccgccctctgaggtcattcctttgggggcaatctttagtgaagttctgccacaaacctcaagagaagagaacaaaggagtgtttcaccttcccgttttgttttgatatgcttcttccctaaagtgccaccatccacccagctaagtgtgtgcttctctccctgcttcagaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaaggtacgctgccagcttaaaaggaaaatggtctgtgcttctacttgcatctgctgttctcattagcagagggaagactggtgggtctcatccatgtcagttgtgtcagagcctggagtccgatgctggaagccatggtgatcttagcatgcacttagtgcttcctggctgtccatatttttgagttggacagttgagggtctgaggagcttggaagcatccatatgtgattggcagttacgagtattttgtggtgttggtggggggatggggcgggggctgtttttggtggttgttaggagtggctttgattttagttttctttaggacacaaaagagtgcctctgtgtttgaagttttcaatagcacattccacatttgatgtgcatcagtacgtggagtggtttggtggatgtgtgctgagatcttgcgactggggaggcacatgtgcatcacagcacatttcagcgtactgatggaaacggcccagccctgggctctcctgttgccttagcttgtctcacttggtgttacgccgggacattttggtactctgtcccccagaggctcatcaaatgagtgaataacattttgatctagggtctgactaaaacttcatatccacattcaggggatagaaagagaacattaaatattaaattactgcgtgaaacagaatgagatattccaggtcaggcagtgaccagaaattgataacattggtggacagtagtgattcagtgactcactacatgcgatttgaaatcggggtgtgtgtgtgtgtgtgtgtgtgtgtacaataaactatttaagctttctttggtttttctcggtaaagcctaatgtagctatagaagaaaatatattaaccttgacatgatagtaatgttcttcagttacacaggatgaaacccagctcattgctgagtatgcatacatctttttaaaaacaaaccatggggctagaccctgtggaatacaaagatgaacaggccagggttcctaccttcagaggtcacaagcttagtattgtgggggcttatatctatagggaaattggcacctgcgatgcagtgcatctggaagtgccacaataatgtagagaagctcgatggcatttttatctgccagtttctttgcctgctcacctggactttagctgtacaatctgaaagtaatcgtgacttgttgaaatattacccccatggctggcaaatcctttaacatgattggcaatgtcactgtatgtgtgtgtctagcatgagacatatatagctgtgcttgaagctaccggagcttatattctgattgcttggtttgtagctgctaattcgctaattctttttttttttttgagacggagtctcgttctgtcacccaggctggaggtgcagtggcgcaatcttggctcactgcaagctccacctcccgggttcacgccattctcctgcctcagcctcccgagtagctgggacttacaggcgcccgccaccacgtctggctaatttttttgtgtttttagtagagacgggatttcactgtgttagctaggatggtctcgatctcctgaccttgtgatccgcccgcctcagcctcccaaagtgctgggattgcaggtgtgagccaccgcgcctggcctcgctaattcttaattaatctgtagagagatttgcttttagaactcttgtttttatgttctttggatggtatatacatttttttttaaatttgttttttgtttgtttgtttgagacggagtcttgctctgttgcccaggctggtgtgcagtggcacaatctcggctcactgcaacctccgcctcctgggttccagtgattctcctgcctcagcctcccaagtagctacaattacaagtgcccaccaccatgcccagctaacttttgtatttttagtagagacagagtttcaccatgttggtggccaggctggtctcaaactcctgaccccaggcaatctgcctgtctcggcctcccaaagtgctgggattacaggtatgagccaccacgcctggccttggtttttgagacagcgtcttactctgtcacctaggctggagtaccatggcatgatcatagctcattgtaaccttgaactcctgggctcaagtgatgctcttgcctcagcctcctaagtagctaggactataggcgggccccattatgcctggctagttagaaaaaaaaattttttttttttggagaccagggtcctgctatgttgccctggctggtctcgaactccaggcctcaagtgatcctcctgcctcagcctttaagtgttgggattacaggtgcgagccactatgcctggcctatttttattgtttttaaaggagtagtggacccttttttaggtttcttatcttgccttttttttttcatttaaaaaaaattttatttattttttgagacagagtttcactcttgttgcccaggcaggagcgcaatggcacgatctcggctcactccaacctccacctcccaggtttgagtgattctcctgcctcggcctcccaagtagctgggattacaggtgcccgccaccacgcccggctgattttttgtatttttagtagagacagggttttgccatgttggccaggctggtctcaaactgctggcctcaggtgacccgcccacctcggcctcccaaagtattgggattacaggcatgagccaccatgcctggctcttaccttgttttctaaaaggaagagcagagctaactataagcatattttgggactaatatctattaaaatttattcttgaaaataatttccttcttaatcaaggcacagtttatatttgaacagaaacagaatagattttattccactgtgggctactggtattaaataataagatgagccgactggcgacttagaggctggggtaacttggatggttaccttgatctggaggaggggatcacaatggggaagtggtctcaggaatggctgaatactctgtaacatgctgcttgtttctttacccagtctacgcctgcaagctctcagaccgggaacatccactctacctgcgtttggtagcagggcccagaacagacacacttagttttgttcttcgtgaacatgaaattggagaggtaagttattgttcactattgctttaaactatacagaacagctggccctattttattgcagtagcctagtgacttggctattgatgggggatgggaagagaagagagttggagggcagggggatgggaagagaagagagttggagggcagggagagggagagggattttgaattgtcagaaatgaacccaaagttagcctatgatgtcattctctcacaaccttatattattagtctgtcattttcagaggtgggagaaaataaagtttttttacttgatctccatccagagagtcattttcaccccttcccacctccaaaatactccagtccagctgaactttgaaagttgacactcaccatgtgtttgctactaacaaaagtctccaggctaattcccttctaaagggatataaaaggaaattcgatctctttaccatggaaggcatttagctttctagcatcttttttttcccccttgcccagtcaactgattaagaaattatgtttccatgtgcatcatttgccatgttgtctccagggaggattgtatttagccagttcagtagaagaaaaaaagcacttgagcctgccctctagatcaagtgtcagctttaaatgacacttgagcaaatcccaagctcctgtcccagtcttctgtctggaacaggaaatggtgtgaaatgtcctacatggtgcaattgagaatagggtttctaggttaaaagttaggaaacggctctgtttcctactgtttgttagattagtagcatgaccttggataagtcttctaatcttttagccctcagttttaaaatctgttaagtgggactaaacactttacaaggtgggctttgagtcacaattagaaatgtatacatgtaagtgaagggagttttaggaagacagtggttttacatgtttttgaagtttcttttgattctggtgttttgaagcttttcaagacattcagactcattttggggagaaggcagggtgcagaaatctgacttggctttgcagatggtgaccattccctctgccagcttaagccagacacattagcatagtctactcagtgttttatttttcttgtacttagtgttttaagtagcaactagaactacattgggcaagaattttattaacttggttattttattgtattttaattataattagagatagggtctcactacgttgcccaagctggtctcaaactcctgggctcaagcaatcctcccacctcagcctcccaaagtgctgggattacaggcatgagccactgcacctggccttaacttagttttgaaattgacttgacattgggttttattgttccagactgctgtactggacctctgtatggtgttcttatttctcagttatttaaggaaaactgaactgaggaagaaatttccatagctgttagggggtgggagggatatttatatgatgtctttattttggagacttcaacataggtgaaagataatctgttaaaattttaaaaattaacagaatattctaacgtagaagttttgctctcctactccatgttgctcttttttttttttttttttttaaataaccagcctaaactgttctccaggaattcttctaccactgagcccatttggtggatttacttatttttcactctttgtttgtatttggttatcttgaatcttttctctacaccatcagacagcagttctccaccaggatccagggccccctttgggagaggaggatgtgtttggaaaaaacctcgtagatgatgctagataccctccttgacattcactgcttctattttttaaaatctgttttaatttttttttttttctttttaaagagactaggtcttgcactgtcacccaggctggagtacagtggcgcaatcatggctcactgcagcctcaatctcccgggctcaagcaatcctcctacctcagcctcccaagtaactgggactacaggaatgtactgccacagccagataatttttaaattttttgtagcgacctggtgtcactattttgcccaggctggtctcgaacttctggtcttgaacttctgggctcaaatgatcctcctgcctaagcattccaaagtgctaggattataggcatgagccacaatgcccagcctaaaaacttattttgtgcctgctaaataagtactaggagctgttagggaaacaaggctcagagcctcaaggcaagagataaactccaaatagcgagaagtacggcagctgtggtgtaggtaaggtgcaggtgagatagatattaagcaaataattgtaatttaaaaatcttggttgtgatcaggggctctgtgaaggcttttgatacacttagccttgggtgggaagagaggagaggaagttgtggaaagctgcttagagaaagtggcatttaagctgagatggggaggatgagtagttcatagccaggcaaagtggaggaggggagaatgcgtgccacttgggcagagagtgaagctcggtgagagagagatggggccggagagtttagagtctttcagacagcatcagcaactaagggaagccattggatggttctaagcaggggagagtcttggccagatgagcattttacaaaggatgttctgtttggggaacagatgggggagcataagagccgagtgaggaggccaggtaggaagctgttccagcgatgcaggaatagatgatagtagctagcaccaaggggccgtaccgagggagaaaaggctgaatggagaactgtttgggggtgataagactgattatgcgaggtaagaaagtcagttacaatgaggactcgaggttaagatgaaaggactgtcgaattgtttttaatgctgttgggggtcaaatcaggtaaggaatgaaagtgtccaatagacttagggatatggaggtctctggcttttagggagatcgtcttgaacagtgggaggagagggtaggaaggtgattggtgtgagctgaggtgggagtgggagtggagggagcccttaggctggcaacaccccagctcttgcagaccacaccttctgcggcatggggctgggaggggagggcagccgcacctctgggagctcctggtcagcattcctaagtctaactgagtattaaacatctggcatttttctttctgtgtttcctgacagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaactctgaggaatttattgtgaaggattttgttagggggttgacagagaaagcaaagtgtaagtttggaagaaggcatgtgcggtggtggcgagtgctgcgggctatggaaggtgacttggcttttcagttaggggtagtggagaaaggggtagttgcttgtaaacgagttaaaagcattcagtgtggaggtgttaaacccattttaggatcgcttggtttcctggtgggtagaatatgggaacagagccagaggcaggagctaaaccaaaaggagggacccatgaactctgcagctgaccaatcagagaatcaggcaggtgtagcctactgacctgggcagaggtgggcctcacgcagctggatccgaccctttaattctgcccttttggagtggaaggtctgattggtgtagctgctctgcataggcaggacagtgacagttcactaactcttgttaagttacatagtgtatagctttccccccacaggtggttttcaaagttgagacggaatttgggtaggggcagctgtttttcccttgattgttagctaggatatttgtcaagtaaactttggtgacaatcactctcttcccttttattcctcctttccttttcctttcttcccttttttctttccttccctgctgtctcccaccctaccttgttcttttcctccctccctccctccctccctccctccctccctccttccctccctctctctccctctccctttcttttctacattgaaatctgttcttacataatagagaacagggctattgaataaagacccaatcctaccagatctttagttctaaagggcaacttgactgtgagtaggagggcccccaagaaagggaggaaagtccacacccagctaaccacacaacagggcttcattatggaaatattttaacaaaagtacatgttattaccaaccaaagagatgcatgtgcaatagaagccttccttaaaaacaggctaaataacctcattttatgcagcagtttaatctgagaacagagggaaaggtgtgcagtggttccagaggggccttatattctatttttagtctagatattttttgtttataaattcccaaggaattgttaacactttggtgacacctaatggattctttttgaaattccaaggtgcttcagttctttgcccaagtgaactgtgccttttattgcatttctgttcgtctcttggtggctcttctgactttttggagaatacccatcttgttggaggcagacttaagttgttatgctgtgccacacaatttactgagacaatcatatcttcctaagcatttaaggaaagttgaaaaaaatagaattagctataaaatatgtatggcacatcttgtttaattttgcatgtaacttctcttttgtacattgatgaggttttagtgacattgtcatccaacactttacctttattgttcagggaatgccttcgtgattttttgtactggttttattattcagactatggcctggatttgagtatattgttattaccacctggttttttaattattcatcccagtaaacttatattttgtgaagcatttgtttctcagattaagacactgttagaacctaaagtagtagctgatgggtatctgtgaattttttttttttttttttttttacttgaagtagattgtctgaataggcatcctcatctatatttacccaaaacctcgcttactgtcatgtgcactacaaattgcaatttggaaacctactgtattgaaattctgtcagtttatggttcttgaagactgatgtcctttcccaaacactggttactgcagcagcatttttaatgtgtaagtgaagaaaaaaggccactaaggccaaagattttttaagaatcattgtacaaatcattatgttaaactatctaagctttgctgtaatactgttttctcttcaatatgtgatggtacaggaaggatgttaaatgaaggggtggtattgcaggagagcattttaaatggcagaagtaaaaagttataatatttataattttgatgggtttaagtttatttttgtagggaagatttttctcccctaaaatagtttctagaatggcaaaattgtttccattattaaaaattgaagttattagtt

SEQ ID NO: 2418 - DNA, 87056 bp, Homo sapiens; identical to SEQ ID NO: 2417

SEQ ID NO: 2419 - DNA, 222222 bp, Homo sapiens
cggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggtgagtgccggtgtcgggctggggtagagcttggattgggacctgaggatctggggtggggaccctgatgtgagggtacctgactctggctcagagccgagggtgggactgggtgctgctcctactggcgggacttgggtgtcggaggttgggatttttagagtagtggctgagtgtgatatgcccagggcttcactgtagtaggtcgtggtagagtcctctttctgggggtggggcagtcagtggttgatggttttaaattgatgactcagttcccatcccgtttggactttctcttctgagttcgcaatttgcagaagtggttttgcttgctccaggaagataatgcagattaaaaagtgttaatttatgtattgtttggcttatgtaatataagttgttttttctcttgacctttatcaggtttgctgtgagaaagacagattcttgggacagatgtcagtgttaggccaccaacctaggaactgtggatccgggctttgtcaaacctttgagtttttcatgtttttcagtaggagacgtgaaaaaaatctgctgagggtggcttgtgtgagctaccatgagggcacattttaaagttgggaggctcctttacatcaactaactggtccaatttttagtacccactttatgtttcattgcttttgccttgagttttaaagagagtctgcatcttctaggaaagtaagaataaatcaaaattaaataagtatatatgtatgtgacgtatgtgtgcatgaatatatgtgtatagtaggcattttatgcacatcacccaatttaattctcattttaatgaggaagaaatagattaaagcaagtttagtaacttgcccaactttacattgcaaggcagtagcagatctgtctgggatctgaaaccagttttgcctaactccaagttatataaaatgttaataattaactttatcaatttttaaagaagagaggtacagattaagtaacagtagttcaatatacatttggaggatgtaaagcaggccttcagaataatttttttttttttgagacggagtttcgctcttgttgcccaggctggagtgcaatggcatgatctctgctcaccgcaacctctgcctcctgagttcaagcgattctcctacctcagcctcccgagtagctgggattacaggcatgtgctaccatgccctgataattttttgtatttttagtagagatggggtttctgcatgttgctcaggctcatttcgaagtcctgacctcagttgatccgcctgcctcggcctcccaaagtgctgggattacaggcatgagccaccacacccagcctgagaagaatcttaaaggttaaatagatcagtttggggcatgggagtggcacgtgatgtatggaaatggtgcacaattcagataaatgtgagaaggagggatagatgaacatgtctgtataaagataatgagaagacctgacctgctattgccgattgctgttcggagaatagagggatgtttgttgctccctgcttgcacttaaggttgttacatgggtggaatgttagtttcaggttgtgtaagaaattttgtgagagtgaggggcccttattataccactcttgaaacctttctagtcattgggccctttgaaaatctaggcttagtttcctaacacatagtgtatggaatcagaacagttttcaacatacgtaatgtttctctcacagcatcctacttatccgttaatttaacaggaaagttatattgtattaatttagttgcatgtctgtgtctcttagtggatttagagcagttctctatcattggcatttgtttctgcttatatcaaataatagataaaagaacatgcatgtgcatggcacacagtgcctgaaaaacattgttgaatgttttcctcttcattgtacggagcacacccaataaatgtttagatccaggcactaaatactgagggacataaggctgaataaagcagggatctttattcctttcaaggatactcatagtagaagagagtttagtatacttaagtgtgatataacacaggaagttccagcagacactacagaaaagggctgtgggaagacagattgcttctggatcaagagattggggaatatgtaccaatcaagatagttgaaagaggggaagaatccagaaaaggagagggtatgaaaaggtagacagttgaaggggtagagtccataaagacctggaggtatgaatgtgtgtggaactggaattggaagcactgagtataattatttgtattgttactttacaaaaggaaaggttaaccaaattcagaattttttttttttttttccaaggcgtagtctcgctctcttgcccaggctggagtgcagtggcgctatctcagcttacagtaacctcgcctcctgggttcaagtgattctcctgtctcagccactcaagtagctgggattacaggcgccctccaccatacccggctaatttgtctattttttgtagagacgaggtttcgccttgttgtccagtctggtctcgaactcctgacctcaggtgatccacccacctcagcctcccaaagtgctgggattacaggcgtgagccaccgcattggccaaattcagatcttaaatatctgaagctgtgacctatttactgagctaagttttgacaatataaactagaagataaagtagcacattgccttagaactaaccacatttatatatatgcatgttacatattgctctggttatttgaacttgaaaattgcacagactgccttttttcttcccgtaaatatttatgtcttcatttattgcttatgttacagattttgtttttaaaatgtaaggtctgagagtcaacgtggagacatacttttaaaataactgtgcttagtattataaaatatttcttgagagttaaggagaaaaacaccttttttcaggataattaaccaggtaaatagtgctctcctgagagaacttcatgagataaaaattaagaatgtcttctgtatattttctactactgatttacttctagcttcaaggaacaattttctatatttttgatccttgcagggttatttctgtaggagtagagttttaatcattggaagtaccaatgttaaattttggatagcaaaagagctttttcatcttcttaaatctcctttgtgcttttttgcagttctctgaaatctggcaaggttagatgattttgaggccagttgcaagcatactaacagattctgcagttaaactcagtgttatttcttaatttttatgtagaataagtacctctattcagaattggaaaattctttcataagttccctttgattctttagttgaaggagacacaagtgtaagagaaccatcagcagtgttttcagttatttcatcatgctaagtttacaaaattctcatattgtagtatagatttctcagcaacagtaggtgaatggcagttcttgcctgtattctttccatgagtataaaaggtatgtttttattctcaaaagacagtgctgtattataacttatttaatttacattgagtcataatttatatacagtaaaattcacccattgtaagtgtccaatttgatgagttttgacaaatgtatacagttgtgtaactacccatgttcatcactgcacaagttccctcatgttcctttgcagtcagtcactccccctcattccctatctctaggcaaccactggtttgctttctgtcactatagattgggttgtattttctagaattttgtatacaaggaatcatatagtatgcactttttttttttggtctggcttcttccactcagtatgattatttgagatttatccatgttgtcatgtgtttcattcccttttattgctgactcatattccattgtatggttatactgcattttatctgtatatactgcattttatctgatggatatttgggttgtttccagtttttggacattatgaatacagctattatgaacattcatatacaagtctttgtatggacatatggttttatttctcatgataccacatggctttgtttatgtagctttatactaagttttgaaatcaggtagtctaagtactctttctttctcaaaattgttctggctattctagattgtttgcatttgtgtataaaatttagaatcagcttgtctggtttctacaaaaatgcctgtccagattttgattgggattatattgagaatgtagatgaatttcagaagaattgatatcttaataatattgtctctgatccatgaacataatatatctcctcatttatttagctcttcagtatgagcagtgctttgtaattctcaggatacagtcttgcacatgtttatttttatttattgatctttttcagagatgggggtttcactgcatcacccaggctcgagtgcagtgacgcaatcatagcttactgcaggttgaactcttgggttcaagtgttactccctcctcagcctattgcctgggattgtgggcacaagctacctcattggctttgcacctatttaaagtagtttgggtttattttgaaaccaggagaatgtataaatcctagttttattatacgtagctagtgtttgttgagtaataacagcaaacacttacatggtgcttactgagtcaagcagtttatattaaattaacacatttgtcacaggggcccggtgagtaggtaccattatcatttccacattttcaatgaggaaattgaggcacagagacgtttagtaacttgtccagggtcatatagccagcaagtggtagagtctacatttgaacccaggtagactggtcccaatcacagtgcttttaatcccaatgctatgctgctgaatacctgtattataaaacatttttcattaggtgctgtgagtgtgcatatggggacacctatgtgtccccacaagggcattactatagtttggcaaaagtgatggatacgtgaataataagtaactgtgatgatgtgaacaaaggggagtgagggaattaatgggaagtactgagcttcacttaagtctgaaaaattaccatttccaaagcttcaaatcgaagcactatttatattgcttggagggaacctgtcctcatttcctgaccatattcttaagcagcctgcttgtgcctgggaatggaattatttgtagtttccaaattaggttagaacactacattcttccatatctctctgttagatgctattttctctgtctggaatactctttccttttgtcttggcaatctctgctcatctcaggtgtcagctataccctgtgttccgggaagcttttttttttttttttaggcgttgctctctatatgtcttgtatctcctccgttatcataatgtacttgtttgacacctcttctgatggcagactctattcttttttgagagtctcactctgtcacccaggctggagtgtagtggaacgatcacggctcactctagccttgactttgcaggctcaagcaatcctcccacctcagcctccctagtagctggaactacgggaacatgccaccctgcctgactaatttttgtattttttttaagagacggggtttcaccatgttgcccaggctgatcttgaactcctgagctcaagtgatccacccatctcagcctcccaaagtgctgggattacaggcgtgagccaccatgcccggctgactctgtctttttaactgtatattcttggtgcctagcacagagcttggactatagtagggatttcagggtaggctggaaggaggcagcgctttgcttttcaagtattgatttttaaattaacatacaatgaaattgacttattcttttgtataattctttgaatcttaacatgagtataaattcatttatctaccaccataatcaagaaacagaagtttcatcatcctaaaaaaactccacccttccccctactccttataccctggcaagcagcgatctatctatactactatacttttgtctttttgagaatgtcatataaatagaatcatatagtatttagccttttagactgataatttgcctatttttttctttgggttgtttgtttcttactcctgagttttgagagttctttatgttctgggtatcttttttttggggtttgatatgacatttgtaaatattttctcctgatctagagcatatcttttaattctctgaagtatcttttttttttttttttttttttttcctttgagacagagtctccctctgttgtccaggctggagtgcagtggcgtgatcatggctcactgtagccttgacctcctgagctcaagcaattctcccacctctcagcctcctgagtggctgggactacaggaatgtgccactgtgcccagctaatttttgtattttttaaatagagacccagtttcaccatgttgtccaggctggtctcaaactcctggtctcaagcaatctgcctgtcttggccttccaaagtgctgggattacagacgtgcgcctgaccttttttttttttttttttttttttttagagatggggtcttgctgtgttgccagggctggaatgcagtgcttattcgcaggtgtgatcatagtgtgctacagcctcgacctcctaggctgaagtgatacccacctcagccttccaagtagctaggactacaggtatgccactgcacccagacagtgtttttgcaaagcacaatttgtaattttggtgaagtccagtttatcagttctttattttatgaaccatgcttttagtgtcatacctaaaatctctgcctaacctcaggttacaaatatttttcccaatgttttcttctagataacttatttctttgcattttatattttgctctatgatccattttgaggtttttttttttgttttttgtttttttataaggtgtaaggtttgggtgaaggttctgtttttgcctctggttgtcccattgcaacaaaacaccatttgttcaagagactaacctttcttcgttgaattgcctttattcctttgccaaaagtcaattgactatatatgtgtaaagctgtttctggattctcttattttgttccataccatacaatcttgattattatagctttatactatatcttaaaattaggcaatattgtttctccaattttattctttttcaaaattattttgactaccctagttcctttgctttttcatatatattttagaatcagtttatctatagctacaaaaaatccttttgggatttgattaggagtgcattaaatctgtagatcactttagggaaaaatggacatcttttctatgttgaatcttcaaatctatgaacacagtatgtcttgcagtttatttgtgttctctgatctcttctatcagcattttgtggttttgagcaaattgcttctctgtatattttgttagatttattccccactatttcgtatttttgtagctattgtcaatagtatttttaaaaatcttggttttcagcttttctttgctaatatatagaaatttggttcatttttgtgttgtctttatatcacgtgactttttttaaattatactttaagttttagggtacatgtgcacaacgtgcaggttagttacatatgtatacatgtgccatgttggtgtatcatgtgacctttcaaactgacttattagttctaagactttttagtagaattcttggttttttcctgcatagacaatctgtgttgtctgccaaaaggcatagttttatttattctttccaaaatgtatgtcttttatttctttttcttgctttattacactggctatgacttgtagtccacagtcttgaataggagtggtgagagtagacttccttgccttgttcttgatgttaggaggaaagcattcagtcttttatcctctagtataattttcacggtagagtttttgtgtatgggaggctgcatgttttatttatttatatatatatattttgagacagagtctcacttgtcatccaggctggaatgcagtggtgcgatctcagctcactgcagcctccgccttccgggttcaagtgattctcctgcctcagcctcccgagtagctgggattacaggcatgtgctaccacaccggctaattttttttttttgagacgcatctcgctctgttgcccaggctggagtgcaatggcgtgatcttggctcactgcaacctctgcctcccgggttcaagcaattctcttgcctcagcctcctgagtaggtgagactacaggcacccgccaccgtgcccagctaatttttatgtgtttaatagagatggggtttcatcatgttgaccaggatggtctccatctattgacctcgtgatctgcctgcctcggcctcccaaagtgctgggattacaggcgtgagccactgcgcctggccacacccggctgatttttttgtatttttagttgagacggggttttgccatgttggccaggctggtctctaactcctggcctcaggtgatccgcccacctcagcctcccaaagtgctgggattgccggtgtgaaccaccgcgtccagctgcatgttttactttttagttttgttagcttttaaattttgaagtaatatgtagtcatacacatttcaagcaataatttgagtcactttaaaggaaaaaagaaagaacctactaaattttaaatccttaacctgttaggattattaacaaatgtctgatattaaggcagtgggagttgttagatttcagttgttaaatcagtagcttcttgaagatttcttgaataaatacttagttttggcttaatctggagatattttcaacaaacaaaataatcatagggatagggagggcaattagtttgttgtaaaatatatttatgcttaaaatttttgaaaaatggctctcaaggtgtcttgtgttttctagagtctagttttattctactgttcctttgtttttaacttgtaatattgtttagtagaaaactttctaatataccaaaaatttcagtaaatggaacttaaaaaatgtaaaccattcctgatttcatcttgtttgttgacaacttgtctcagatattaagattttatattaaactgcagactttctttaacattaaggattttgattttccttgaaccttgattggaaaatagtttagaatactgctataattggtaaaatttgaggtgagaaaaataactttagcaaacatatactgagtatctagagataacttgcagttttagcttctttactctccctgagattttgggattttaataatctagaaagccacaactccttactgtctttgtcagtttggatttttataacaagatattatagactagatggcttcaacaatagacatttctttcccacagttctgaaggctgcaggctgggaagtccaagaccaagaggccagcagatttaatacctgatgagggcccgcttcctgatttgcatacagctgccttcttgctgtatggtctcatggctgagagagatcattgtctttttcttgtaagcgcagtaatcccatcatgaagttcccaccctcatgacctgattacctctggaaggcctcacatccacatccatcacattggggatgagagtttcaacatgaaattcaatatgaattttaggagaaacacaaacattcagtctgtagtacttttgacataatgctttcgtgaaaacttgttagaaagttgaatgtctaaaatttgtcccattgacttatctatcttatatgggagttctttcactccagagaactaaaaattataaaatgtctaattatggtttgtgcaggtgttgcctcttgggtccagactgcctggctggtgggtgataaccagcccaaatattcttgccaaccagtgccacctgtggctctgcagggaagagcgggagagaagaactcaggtgcaggtggtcatgaaagggaggttgagttggtaaggtaacaattgcctatgtgagctgggtgctttgacctacttttcctgcaagacttgggtgtttttttttttttgtatgtatgaagtccagtttaaatatgtcagtatgttaacatgaaagtatggattttaaatatctgaaaatcaggaatgcatgcattatattgatgaatgtgccacttggtatacctaatcaccacaaggagaaatgttcagaatagtgtagccttccatttctgcatattattcctgtcccacattcagagattcatatctttgaaaaatgaaaagagtggacatgttttccatgtttgattatttgtaccttgacacttagtgtaattactagtattaattttgtcactttttcttcttagctctgctacccttaactagcagctgaacagtgatagtgaagtagccctcagaagacttgattacaatactttgcttataaaagtagcttcttaaattttatgtttaacttcttatcaatactagtttctaaaggggcttattttatctttttttttaacctaggaaatactataagtttgaataatttttgtagttttgttttctagtacaggttagcatccctattctgaaagtttgaaatccaaaatgctccaaaatctaaaactttttgagtgtcaaatgatgctacaggtataaaatttcacacttgacctcatgtgataggttgcagtcatgcacacaattattaaaaatactgtataaaattactttcaggctctgtatataaaggtatatatgaaacaaatgaattttgtgtttagtcttgggtcatgtccccaatatatttcatgtatgtgcaaatattccaaaatccaaaaaaaatacaaaatctgaaacacttcttgtctcatgcattttggaaaaaggatattccacctgtagctactctttgttaatcttaacaaaaaatacagctttttgtatatgtctgagttaacagagtgatttctaatcatcattatggtgataatcagataagagagtgcttttgaatctttttttttttggggcggagtctcgctctgtcaccaggctggagtacagtggtgcgatcttggctctctgcaacctctgcctcccgggttcaaggtattctcctgcctcagtctctcgagcagctgggactacaggcgagccccaccacacccagctaatttttgtatttttagtagagacagggtttcaccatgttggccaggatggtctcattcttgaccttgtgatccgccagcctcggcctcccaaggtgctgggattacaggcgtgagccatcgcatccgggcaagagagtgcttttgacctgacttttaaggaaacatggtaatatttattaagaagtagatagaataagttagcatactggaaaggatttcagggacccagtggcaatgtgacctgttgattattatggaactgacctaggccaagcctcacagtctgatctttgttttcagaataggcaagggggctgactttgggtcttttctttgtttttactttgttttagtactgagctggcagaaaaagcagttcatgggcagtgccaacaccattattcagaccccattctttttagttccaagccccttgtttattttctgcttttccaaagtggttcttcaatttctgtattttagttgacttgtaagacaaagggtttacctaactgtaatgcctataggcattttgtcagagatattttgtcaggaatattacctgaatacttggaattttaatcttgaagagagccaattggcttatgtcctggagagagcactttggagtcatggagttgtgagatctggtcctgcctctgttatttgattgagtctattttctaggtctttggttatctcatcttaccaagcatggttgtagtgattattgaatgaagtagagtatttaatttcttagcacaataagagatagttacttttgctgtgagacattgtttttctaaattcataatttgctgttcatgaacagaggcagatagactacagaaattgtggtagtatttctctagtgcttcagattttagtaggtgttgtactaaataaataatgaggatgataataataaataacataaaaataaaaaattgagtggctagatgtctttgggaaatactatgtatcttccttttggggatttactaggcatattaatgtattaaagggtttgaagaattctgctgtaaacaacattccttcttaaaaagaggtaaattgaattgattattaagcccttcctgtgagatcactgattttaaagaatactggtattccatgtaacatgttttgtgaagcactgctgtagggtaatacttttttttttgtatttttagtagagtgtaaggtaatactttttaagatgagttggtgataaatttctaaaaagcaagaagcatttcaagatatataggtagtactaactgaatcagtggcagttaatgcttgcagtggaaatttctgaactttatttttatttttatttattttttttgagacggagtttcacttggtcacccaggctggagtgcaatggcgtgatcttggctctctgcaacctccgcctctctggttcgaactgttttagtgcctcagcctcctgagtagttgggactacaggcacatgccaccacacccggctcatttttgtatttttggtagaggcggggtttcaccatgttggccaggttagtcttgaacttgtgacctcaggtgatccacctgccttggcctcccaaagtgttgggattataggcgtgagccactgggcccggccaaatttgtgaacttttttttttttttttgaggggttgtttcactcttgttgcccaggctggagtacaatggcgcaatctcagctcactgtaacctccacctcccgggttcaagcgattctcctgcctcagtctccctagtagctgggattataggtggatgccacaaagcctagctaatttttgtatttttagtagagatggggtttcaccatgttggtcaggctgttcttgaattcctgacctcaggtgatcctcctgcctgggcctcccaaagtgctgagattacaggtgtgagccactgcgcctggcctttgtgaactttttttttttttttttttgagatggagtcttgctctattgcccaggctggagtgcagtggcgtgatctcggctcactgcaggctctgcctcctgggttcatgccattctcctgcctcagcctcccgagtaactgggactacaggcacctgccaccacgcctggctaactttgtatttttaatagagacagggtttcaccgtgttagccaggatggtcttgatctcctgaccttgtgatccacccgcctcggcctcccaaagtgctgggattacaggcgtgagccaccgtgcccggccttttttttttttttttttttgagacagagtcttgctccgttgcccaggttggaatgcagtggcgcgatcttggctcactgcaacctctgcctcctgggttcaagtgattctcctgcctcagcctcccgagtagctgggattacagacgtctgctaccgtgcctggctaagttttgtatttttagtagagatgggatttcaccatcttggccaggctggtctcgaactcctgacctcgtgatccaccctcctcggcctcccaaagtgctgggattacaggcttgagccatcgtgtctggccctttgtgaacttttaatgaaaacagtcactgttttaaattccaacttttgtggaatttattggttgaactttgtgacaaactctcttgaaatttatccagagaaaaattactgagttgctagctcagttttatttattgtcagtatggttatattcttccctcagatttctgattgatactcttatttttcattaacttttcagtcacggaagataattacacagaaagaattgttactcatggatttttgcactcaattcacattatcctagccattttgtggttttcgtttccgttttgggggacacatttgtgaagtatttaaatgagatgacacattcgggaatactgaatccctaatagtggggtaccaagtggttgaagttggtaatgtatttgggaagtgattgtatttttataatgcagttgcgtaggaatcagacctagtatattctccattgtactgcagtacctggcagcagagtaggcactaatatgtgttgaatgagtaggtgaaataaacaaaaacctaatggcgatggaattttatggaaataagtaaacttcattattgctgaaaataccgcagataaatagagggaggcagtgtaatagagtggaaagagcagtagaccaggagtcagacagtcgaggatctcattctaaatttgaaggtgaatagccatgtggctttagacaggactctgaaccaccttgttttcttatctgtaaaaggggaagtcataatagctactcctgcctaactcataggttgttgagaaaatgaagtgattcattaatataaaattcttcgcaaatgtaaatgtacagagtcaaattttccctatgcctagcgcagtgccttgaacagtattagcacagatatagactgttaataataaaaaggaggctaaaaaacaagagtttaaaacaattcttggagtgttcacagaataccagggggcagaaggatgaagaataacctacaaaagagaagcaaaagcaccaaagaggaaagagaatcagggaagtataaccctgtgcttttaagacacagttttcactaagctttaggcttgtcaggtaatacctaagtagcttttgatttgattttccaaaccctgtctaaatttcctccttcactgtgaagtatttggtgggtacagagtagttccttttgtaagcctaaaattaaagaccttcacttaggtagtttaagtatacttcaactttgattttctgtatattgcataataatcatgagttactgttgttaccaaaacaccaggggttccgtctaggtcctgctgcttgtcacacagaaagcaatctctgagacaatgagtattgctaaggaagccggctttaatcaggtgttgcagtcaaggagatgtctcagatccatttccctgactgactaaaattaggagtttatatagcagggagaaaatgtgattatctatgggaaaacaggaactacagagggttaaggaagcaattgtgatggatgagaggtctggcatctcattgtttggatgcagtgatctggtgaatttcagtttatttaatattgtaaaaggaaaataaatcttgaggcccccaaataactaagctaaaggtgaaagtcaagttgggaactgcttagggccaacctgcctcccattctcttcaaagtcacccctcggctcactgagataaccattaatacataccagattgcctcatttggagaagcgaatcagaaactcaaaaggatacagccatttgtcttttaactacctgtgacctgaaagccccctccccacgtcgagttgtcccacctttctggactgaaccagtgtacatcttacacgtatttattcatgtcttatgtctccctaaaatgtataaaatcaagctgtgcccctaccaccttgggcacatgttgtcaggatctcctgaggctgtgttaccggtgcggatcctcaaccttagcaaaatgaactttctaaagtaactaagacctgtctcagatattcggggttcacaatattaatactttttgagaggcctgagggccctttcctgaagaaggaactctgataaaacaaatgttaagtttcaagctttaataccagaagggtcagtttccatgtttatccaaaaaaactgtccgtgggaccattgggtcagtttcacttttattatcatgaagacattaagagccttacatcactaaaccatgactggttgactgcttttgggatgccactttgctctgcacagtgaggattcagtgtcatgggaaggatctaggatgaagtgtttcccaatcttttgcttagcactctactgttatctgaggtatggaaatatgtttgggaaatacaccctccttcactctgcactcccctcccaccccaccactgtgtaccactagactatgagctccaggaggaaagggacttgctcaccattgtaatccagcacatagatgtatgtaaaccactaagaggacggctgagaaataataatcaaattggttatttctgataagatggttttaatattgtggctattgttaggggatggctaatgtgtttttgtttatgcagtacacatgtatttgatttccaggactggctcatctgaagaaaaccaaaatgtggtacttctaatatgtacaccaaactaagaaataagttattctgtctcaaaaagatcatttgcttatattaaggaagattatttaaaatacttaagatatctgaatatatttataaattcaggaaatgtattaagctgagaaaaacataaattgtgaaatttaaagtacatttgaatagaccttgctgtgagtgatcatgtgctatttttggggggtggattattagtggattggttatccatgacttttcttctcaatacatttcataaaaatgtaagaacggcggggcgcagtggctcacgcctgtaatcccagcactttgggaggctgagacgggcagatcacgaggtcaagagattgagaccatcctggccaacatggtgaaaccttgtctctactaaaaatacaaaaattcgctgggcatggtagcacatgcctgtagtcccaggtactcgggaggctgaggcaggagaatcacttgaacacaggaggtggaggttgcagtgagccaagatcgcgccactgcactccagcttgggtgacagagcaagactctgtctcaaaaaaaaaaaaaaaaaaaaaaaaaagaaacacttataagaagcaaaattagtcatactatgtgaaatactatacttttggaaaggtgtgtgaggggacaggctggtatttgaaagtaatagctaaaatcaaagatttgaataatgtatagttgttagttacctgttatagtctcttatactgaatctgtgttgtctaatttggtagccattaaccacatgtagctattttgatttaaatttaaattaaggcttacagtggttctcacttataatcctagcactgtgggaggctgaggcgggaggattgcttgatcccaggaatttgagagcagcctgggcaacatagggagacccccatctctaccaaaaaaaaaaaaaagtgtatatatgtgtgtgtgtgtgtgtgtgtgtgtgtgtgtgtgtgtgtgtatgccgactgtggtgtgcctatagttccagctacacaagaggctgaggtgggaggatcagttgagtccaggagtttgaggctgcagtgagctatgatcatgccatggcactctagcctaggtgacagagtgagaccctgtctctttaatacaaaaatttttttgaattaatttaaatgaaataaaattaatgtagtttctcaaagtagccatatttcagtggctcagtagccacacacatgtggctagtggtggctgtgttgaacactgcaaatagagaacctttttttccgttatcacagaaagttctattgcatagcactgtagtataaattaatgacaattactacaagatttcaccaagtttatatattctgaaagttggagaatagagtgcaagatatttgttctctggaattcttaggtgggaccttttacaatggttaacctgtctggtaggggacaggaaacttttaaattatagagttcttgctgtgtccttatttgttgttcacaacagccaggccaggcagttagtattatctccgttttatcgatgagatcaaacctgtaagaggaactgtaatttgaaccaaggtttgtctgactttacatcctctattttttgttcttattttggactttaggggtgttgctgaatggattataatccctagttcatggtgtattgtcattagatatcaaagacccttttcttcctcacactcctaggcaaccattttaatgtgtgtttgatttatctttttttaaaattttttttaaagtgaaagcaagtttattaagaaagtaagggaataaagaatggctactccataggcagaacagcctgatttatctttttgtttatttttgcaaaatacaccattgtagcttcaaaaccgttaatttgacacttacatggatggtaccgtattatgtaatctaatgtgagattttcctaatttaggatgctgtttgatgatttaaacacctagccttttcaaaagttttgtgaaaaaaatctttttacctggtgttagactttttggcctttgtcatcagggaagtctgaaggaatctctccttttcctctttgcttagggagtattgatagaaggattatttgtccctgaatgtttgtaaataatttatattacttttgttttcttcatcataggtagccagtgattacttctcatacttctcacatgttgtgtccgagcattgtagctgcttttttttaattgaaagttttattgtgctaattgtagattcatatacagttgtaagaaataatgtagggagatcccttgtacactttgcctaagtgcagctgctttttatgcttctaatttgtatataggcttgctgggaaggggagatgtgaacaaacttgttagaattatgttaattaagtaagagtaaaggccagatgctttttcttaagaatgtagtgaatatatgaactttagcatgtggacttacttttagctgtttttttgcttaatttttagtattgttaaaataacatttttagccaaattaaatttaacagagtttaattgagcaaagaatgattcacaaattggtcagcctcctcagccagtgtaggtccagagagactccagcgcaaccatgtggtggaagatttatggacagaaaaaggaaagtgatgtacagaaaaggaaactgaaacagctgtattggttccaactaagcatttgccttatttgaacactgtttgaacagttggctctctttggccaaaacttggtgattggcgccagagtaggttacagtctttacacatctatttacatatctatttctctttcattatgtacagagaaacttttaggccaaacttaaaatatgtagcctaagggaggtaactttaggttaaacttgatttaacagtatgaatttcagatagtgaagttattatatagctgagttttggataaatgatatagtgtttatttttttaagcaaattgaatttttcatacaaatactattggaagttaattatacaaatatgaaatcttaaattttgataatgattagagatttctatgtatgttttgttttaggttgtttcacgaagaaatccagaggatgtccaggaggtaacatttatatgaagattttattttatgtatttgataaaaatttaactaaatgcttttttgaggaaattgcctgaatcatttgtacatcaacctcttttttttgagacggagtttcgctcctgttgctcaggctggagtgcagtggcgcaatctcggctcactgcaacctctgcctcctgggttcaagtgattctcctgcctctgcctcccgagtagctggaattacaggcatctgccaccacactcagctatttttgtatttttagtagagatggggttttaccacgttggccaggctggtctcgaattcctgacctcaggtgatccacctgcctcagcctcccaaagtgctgggattacagacgtgagccactgtgcctggcctgtacatcagtctttatatgtttgcgtgaagattgtcttcatttcacaaaacagtagctgaagtgtcctatttgagacctactaagtaattgttaagttttagtaggtgttaagttatataaataagaatttaatgaattatggtgctgtttactaagtgatcattgttctggtaactagtgtttacaagatttcagtatcacttaagggcccctatttacccatttcaagatcataatgcctgtgtaataaaaagtatttggtaactaatatttattttaaagattctaacagtaaattatgggtctctgcctactttcacttttagattgaattgacatgttgacatcttggaaaactgctttaggcatagatatttctttttttttaaactttaagttagtaagttcttttgcagattcttctgtgcattttttcattttttttccttctttctataatggtaccagcctgttatgttttgcttaaaattgtggaattctctatttgtatttactttgtgcttgttgtgtatctttaggaatccttactgaggagcttgctgctttgaatgtttcttgatttattttcattttagtccctgctcaatttcactaagactagaaggacatatatcaggattttttccgcctccctaatgtgtttaaaacagatactttaagtttacagtcctgattctgcaacagtattgttttttttttttccacaattaaatatgaatgtctttgggtggtaggttgtttctgtttagccacgggtcccactactctacagaaaatacctggcttgattcatacatttaaggtgactgtttggtactggttgatatgagtgtatggccccaggtttagataatatttaaattttatacattatcatttctggctatgtctgatttcatagttgtttttgtcctatgatttaaaacagatatatttttatacaaaaattagctgggcatggtggcaggcacctgtaatcccatctacttgggaggctgaggtaggagaactgcttgaacctgggaggcagaggttgcagtgagctgagattgcaccactgcactccagcctgagcaacagagtgagactctgtctcaaaaaaaaaaaaaaatagatttaatactattttcctgatgggttttaagacaattcattccctaccaggaaacagaaagaatattgtaatattgttattttgaaagaaaaaaatgtatacatacatatatatgtatcagtgaaagtaatttgcaccattgattaaagtacttttctgtctttacttgtatcaattgatgagtgtgaactattctttagatttctagtttacaactcttaaaattgaaaatgggtgtatttcctttgaatgcattgtctgattgctgtgctgtagtttgtagcttgatgttcccattttccagggagaatcctgaaccaacctatccatgaacatactctctgccattttcttagtccttttttcgggaaaactcttttataataacaactgttggtgaaccattcatctgaaaactcttgtaagtgtcttttagttagacaattgcatggttctttgttagaagtggtataaatttttaaaagttttctatttagttggcttcttaaaatatagaataatcttgaaattataacagtactttttttagtttcccacttagtgtatttaaacattagaattctcatttgggagaggaattcaccacttagagtttgtttttcacttcctttcactttccctctccattaacttattcatttgttactgctttagactatatagtaaagcttcacaagggctattgaggactagatgtactgatagtttaacaaaatgtagggctagtaatacgctagccttataaaataggagaaattttgttgtttttcttttatatataccttggcacatgccaccacatcagtgttttcttcctaagaatgctaaaagatctgtggcctgtcattcagtagattgtgtagaacatgaatagacagcagaaaagtgaagaagagatggttttgctccccctcacccttttttaaacaaattaacctgtacctgtttctctctacaggtaggatatttcactggtgaaatttgggaaaggaaaagaactgaaacaggactttctatgtattatgtcagaaatctctaacttttaaatccttttttaaaaaatagttttattatttatttattatttatattatttatttatttcttgagatggagtctcgctctgtcacccagactggagtgcagtggcatgatcttggctcactgcaacctcggcctcccgggctcaagtgattctcctgcctcagcctcctgaatagctgggactacaggtgcccaccaccacacctggctgatttttgtatttttagtagagacggggttttaccatgttggccaggcaggtctcaaactcctgacctcaggcgatctgctcatctcggcctcccaaaatgctgtgattacaagcgtgagaaaaaatcattttagaaaataggtacacactcagaaatatatcgggaaaggaaaggctcttgaaaagagggaaaataaaatccataagcaaatagtgtggtagtgatgttggttgtaagaagagataatccagcaaattttaaatattaaaactatgtgagcgtgaaaaggacaaagttaattcaattggtggttctgtaaaatacaggaatctaaaaagtttttggtgttattaagtgtaattatctgaaaaggaaacatttatgtagaaaatatttaagggaatgtttttaaaattaagcttttatttgtatgttttatatggttgtcactgaattaatatttcattgagacattttcttcagagtgactttaataaataagaaacttatggagacttggttcaataaagaaagaggttgttatagacctattttttcaatgggaaagtattgaacattaattagagaaaataatttctaaatgtgtctctgaggactttgtgtagtccagatatgaacatcagtacttgctgttgtagtggaagtatatctttgttcacttttgtattttgaagatttctggaaacctcagaacttagaaggagtaagaagaaaaggaggcagtggatgtgacattttgcgatgctgttaggtattttggttctgcagccctagagttgagaagaaggaatataggattgaataaattagggcatggtgaagaaacacagattctcacctggggggttctaattcttgctctgacagactatctactggttcatataccatggtattttaataattattatgattaaattgttaaattttgctccttaagtttgtcttgcagtatttaaaaatgacttaactagaataaattttttttttttttttttttttttttttttacggagtctcgctctgtcacccaggctggagtgcagtggcatgatctcagctcactgcaaactccgcctcccgggttcatgccgttctcctgcctcagcctccctagtgctgggacttcaggcacccaccaccacgtccagctaattttttgtattttttgtagagatggggtttcattgtgttagccaggatggtctcaatctcctgacctcatgatccgcccgccttggcctcccaaagtgctgggattacaggcgtgagccaccacgcccggcctagaataaaaattttatctgcaaatctaattgtttccatgagctacagtcttttgaataactcatgtccaggtcataatgaccttaaccttacgtaatgtccagtttataatgacatttaccttatataaggtactgcttacataagcccatcaaccatttctcctttaattccttggcaatgtcgtatgattgtaatttgatatatttttaaaatataaaaataacaattttttgttcccatcatttcattgttagaatcctcacatctcactgcgtatgctgagaaacctttcctgagtgattactgcctatctgctactgatcttttaatctacaagctaatagatcctgctcagtttttgctcttcaaccctaaacctatctcactgaacagctccaagcagctccctcacgagctcctaagtcaaatgtgttgaaaattgaacctctttcttgcctcagaactgctgctgcttccttagtgttcacttcagggcatggcaccaccattctgtagcaaaacttgctacacagctatttattcttcagtgttcttcagtttatttatcattttaggcaaatactgagtatgtacttttgtttaaaaattgcctaaattaattgtcttcatttagtaatacatacttagcatctcactcttcttttagaaacttcacccccggtgccctccccttttattttatttttgtcagtctactgaccacttcccttcaggactctctaaggtagtactttttgtgaagccttctcagacatacaaggctgatttaggtactacatctacagcactcttggactgcccctctcagcatttttcaagccgtcttatgatgatgttgtcttgtgatgtgttggcttattcttcctaactagactgtgaactctttgaaggcaggacctgtatttcccttctcttcatactttgtaagaatatgatgcttagtggaaagtagggccatagaaatatttgtttggtgactctttttgttgttgagtaaatgaacagggaacatcaggaggaacaagggaagcatcaggaggaagcagtttttaaaaattaattcatattatagtctgcctagcctcctaggattataactgtattaaaaacaataaacattaattaaggtagaatttttggcagcatgaaaaagtttgctgaagagttttatacatacagagggtaggttttttggcaggaatctcttaaatcacacctggttacctgcttgacctgttatttgctcattagcattatactctattgtatatgaaaaacttgttagaaaactttgttagaactgagatgattaagtttttcagaagaccccagtatctgaagtaatgggatttaaaactcaattttactctattttctagagattgaggggctgaatctgtgatatcaaggccatgtttcaaatcctttttctttacaaagtggtttttttttttagatataatctgagtaaggttaaataataattcagactaatgaaggaaaacacacttttttacatgtcgtctaatctagatgatattttgttttttaaaaatatactaattttaatgatgttctggtcaggattcagcttgcctgcagacatcttattactagtgtgaattaagatttatgacatgaaagtccatgttaattgcttgctgcatagctacttcttcagtgttactcagtttatccttttttttttttttgagacaagagtcttactctgttgctgaggctggagtgcagtggcactgtgtcggctcactgcaacctctgtctcctgggtttaagcagttctcctgcctcagccccccgagtagctgggattacaggcgtccaccaccacaccctgctagtttttatattttcagtagagatggggtttcaccatgttggccaggctggtcttgaactcctgagctcaggtgatccacctgccttggcctcccagagtgctgggattataggcgtgaaccactgcgcccggccagtttatccttttaggcaaataccgagtatgtacttttgtttaaaaattgcctaaattaattattttgtctttataaatacattattttgagaaaggatacatgttttgacatctaactcatttgcaggccaattgtaattggtttttgaagagatgaagtgacattttatatagtataaatcttctccatactgggttgaatatttttccagtatgaataaaaccatacttgtttaaaatgaaaatttgaaaccaaaacagaatagtttgaggaagaattgccgctttatatgtaatatatttttactttattttattttatattattttcctggtcagcaggaatctgccttatatttttaaagcaaatattattagttaatttcagtcagttaatcatattgtttaggacatgtgtttgcctttgcatgacaattttgaacactttaatgaaaggattatttgttgttcagatatctgaacctaaatggttatgagatacatgtttaatttttttctctctagataattgtatggaagagatacagtgattttaagaaactacacaaagaactatggcaaattcacaaaaacttattccgacattcagagttgtttcctccatttgctaaaggaatagtgtttggtaagtgattattttgaaattgtaatttaaaaaaataattaattttgtatatatactgaactctaacataactacactatgaagtcagaagcccttttacttattgagataattcatattgttcaacagcacttgaaattgtcttttcttgttcttgttatagttttgtgtacccagaatatatttactcttcctatctatgaaacaaaacaacttcagttccaaccaaccaaataaaaaaccctgtaggaacataagaaaaggtgatattcagttattcttatagttttaaaattctttctttttttaaattaagtctcattttgtatgtttccctgacactttgcttatagtatgaatggtgtggttttctagtatttgcttcttgcaacttctttttgataccttagtattcttttttttttttttttgcctcatcagttttcaaatacctaggtaacagtattttatattaaagtttctgtgtcaaaataattggtgtagtttctgtcccctgtctggattttgactggaagtatagaatattcatgttttttttctataactctaacgtaaatgttcttatatggacagaatttttttgaaatggagtctcattctgtcacctaggctggagtatagtggcacgatcttggcttactgcagcctccacctcctgggttcaagtgattctcccgcctcagcctcctgagtagttgggattacaggcgtctgccaccacacctggctaatttttgtatttttagtagagatgaggtttcaccatgttggccaggctggtctcaaactactgacctcaagtggtccgcccgccttgacctcccaaagtgctgggattacaggcatgagccactgtgcccgggccagaacattttatcctattactttttgcaaccaatttctgcatatgtaattgcagagtcaaggtatatgcacatttatttttcaaactagacaattttttttcaggttatgaaagtagtatatgcaaataactcaggtggtacagaaaaatacttaaaacgtaaagagaaattcagcaataataccatctcctagatagtataatattttggcatattattctagactctgtatcagtgtgtgtgtatggtgtatttttgtgcttattaatatgtatatgcctttttacccatctatgtatagaaacctcaaaaatggaatcttgctatgtatgattttgtaacctggttttatataacagtatatatattttttctttattttttatatgacagtatattatgattgtcttttcatgtcaataaaaagatctacattactaattttaatatgtacatagtattccagtttttgaactgatttattaaccaatcttttactggtatattacttttggccttttgctgttacaaataacactgcagttactattcttgttcatacattactgtgcaggtgtacagtagggtgaattcctgggagaagaattactcagtcaaggggtctgcatatttttgagacttttgatgcatattgtctcattgttttaaataattgtaacatcattttcctttatacattggaataacttttaaattattattattattttttgagacagagtatcactctgtcacctaggctggagtacagtggtgtgatcttgctcactgtagccttgacttcctgggctcaggtgattctccttccttggcttcccaggtagctgggaccataggtgcacaccaccatgcctggctaatttttctattttttgtagaaatggggtttcaccacatttcccaggctggtcttgaactcctgggcttaagtgatctgcctacctcagcctcccaaagtcctgggattacagttgtgatccaccgcgcctggcagataacttttaaagaggcatgtggctaagtaaaataaaaacaaaacacaaaggtagtattgaagaatgcacgataaaaacaagtttcctgctccttccctccacctacttttgcttctagacataactgaattttaatccttttttttcaagtacttatatctgtatctgtaataagcttataccattttttctttttttctttttttttttttttgagatgaaatttcactcttgtcacccagactggagtgcagtggcgtgatctcggctcactgcaacctctgcctcctgggttcaagtgattctcctgcctcagcctccagagtagctggaattacagacacctgccaccacgcctagctaattttttgtatttttagtagagacagagtttcgccatgttggacaggctggtcttgaactcctgacctcaggtgatctggcctccttggcctcccaaagtgctgggattacaggcgtgagccactgcgcctggcccattttttcttgatttaacaacttttacgtatctattgactcactactctggtgggtaaggatttagcttgtttaccctgtttctctgtattattacataatatttttagttcttctgttgactttatttctcgttctgtaagtgtggacaatatcatttgtctaagatgattctaatagcatttttgatcttcctcctacctcttcagctctcttcaccacttaacatttgaaatctgtgcttatagtttaacatttgtcaaaggtggtaatatttatattctctttaatagtcataattaagctcgtaatgtatagaataattctcaaagctagaatgtaataaacatcatttataaaattattattttttgagacagagtctcactctgtcaccctgggtggagtgcagtggtgcagtcccacagcctccatctcctgggctcaagcgatcctcccacctcagccccccgagtagctgggactataggcacatgccaccatgccagtctaatttttgtaatttttgtagcaacatgttttcaccattttgcccaggctggtctttaacacctgtgctcaggcaatcctcctgcctcagccttcctaagtgctgggattataagcgtgagccaccgcaccctgccttattaacgttattatgacagagcaaatattgttcattataacaccaggtggtataccacaattacattttgttctgcaaggttcaattgttacaattactgtgccaacataagaaaaatgtgtaagtgaagtctctgttttccttatactacatcagggaattgaaatcatgccacattttagtttgctaaatatttggaccatgccttttgtgatagccagcctccaagatagcctcctatgattcttttctcctggtattcacacctttgtgtcttcccttctgtcttagtctgtgtagtgttgctacaaaggaatacccggggctgggtaacttataaagaaaagaggtttatttggctcatggttttacaggagataaaagatgcatggggcctccatctgcatctaggaaggacctcagattgcttccactcatggcagaaggggaatgagaggccaccacatgacgagagaaggaaacgagagagaggaggaggtgccaggctttttccaacaggtttagttcacgggaactaagagtgagaaccagcaagccactcatgagacatccattcccgtgatccaaacacctcacaccaggcctcaccttgaacgttggggatcaaatttcaacatgagacttgatggggtcagacacaccatatccaaaccatagcaccttcccagattgtactagggttggtctgtgtgaccaataacaaaagtgatggtatatctcattcctgagatttatttataaaagactgtggcatctctcttaaggttttttttttttttttcctttctctttctcataacttgccctgagggataccagcttttcctatggttaagaacattctggtagcctatgaagaggcccacatggtgaggaacaggggcatccagccaaaaactagtaagcatgaagcctgccacagccatgtgaatgaacttaggagcagattctccagtcccagttgaactttgagatgactacagcgttgaatgacagttaacagcaatttcatgaggggcctgagctagagccacccagccaagccacttttgaattcctgaccctcagagactgagtgagatagtaaatgtttcttgtaagctaccatgttttgggataatttgttacccagcaataactacttaatagactttgtaacaaaactgaaaatgtggagtggttttgaaatgagctatgggctttgaggagtgttggtgagtgcctgaagtgccttgaagaagtgattaattgggcccggcacggtggctcatgcctgtaatcccagcactttgggaggcgtagtcgggcagatcacgaggtcaggaaatcgaaaccatcctggctaacacattgaaaccccgtctctactaaaaatacaaaaaagaaaaaaaaaattagccaggcgtggtggcaggtgcctgtagtcccaactactcaggcggctgaggcaggagaatggcatgaacctgggaggcagagtttgcagtgagctgagatcgtgtcactgcactctagcctgggcgacagagcgagactccatcccaaaaaaataaataataaaaaaaagtagtgattagttggagcctcatggtattcggtaagactgcaagtgaggtttcccaaagaagttaggtaagtgttactggaaactggagggaagatccctcttatgtagttgcagaaagtttagcaacactgttgcctacagttatgtggaaagttgaaaatgtactttgcaaatgaactgggtaagctagctgaagagatttccacccagagtgtttacagtatggtgcttcttgctgctcatagtaaaatgtgaaaggagagagagaaactaaaggaaggattgttaaacaaaaaggtcctaggacttgttttgaaaatgctatctttctggatagcagagagtactaaaattaagaaatgacttctgagcaaatatggcctaaagatgaagcccagtgtgaaataaaatgttttttaagaccttagaaagattcagtcagaccaaatgctctcaataaagattaaggttgtgccttacacatcctctcaaatagtagggcttcgtggaagtgtaagcctctgccaactcagcagaagccaaagctacagaagggtttaacttgagatttgtggctatcacttttgtttaattgagtaaaccccaataagagtcacaggtgacccccccacaaaaaagttataagtaattatatatgcagaaacattgttagcttggactgacaagcagaaaagcagtacaaagtgaaaagagacttttgtctcccccaaattttactggaaggaaggctaaaaacaaccacgaagccacacaccttgctgtttttcaccgaaaaggaggtatgactcagagggtggaaccagtagctcagagggcagagccatagccttggagaatttattcccagcctgtgagccttaatcagaaacttccaacatttgccctgctggatttcagaattactatggacccattgacttctttggggctcgcatttactcccctttttgtacaggaatgtctatagcagttattccatgcctatcccactattgtgtattgagtgggtagaggggaggtaacttgtctatagtttcacaggttaggaagattgtacttaaggagctacacttagggaacgacacctgaagaacctcagtcacacgtggatgtgacttagatgagattctagactttgaattgctgccataatgggatgagacttttggggaccttgggaggagggtgaggagatcttgtatgtgggaggggtgtgaatctttgaggccaaagagaggtctgtgttggccagcttccaagatggcccccagtggtccctgtctcctggtgtttatgttcttgtgaagtcccttcccacactgaaccaggattagtctgtatgactgttagcatatgcagaagggatggtatatcacttccaggattaggttataaaaaagactgtagcttccatcttgtgtgctcatgctcccacctcccctccatgtgtcgttacatgttttggggaaactggttgctttatggtgagaacactcaggcagcctgtggagatgagggatgtttcaaacttacagaaagttgcaagaagaagaatagtacaagaacacctctatactttccaaccagattcacttattgttaagcttttatcccatttactttatcatttgctggtgtctctctcactctttctccttccctctctccctttccctctcttcctctgtctcctctctctctccctcttcccctttctcccccagcacacacatataaaatatatgcacgtaattttacattattttaagttttaatttcttaacttttctttctttcttttctaacttttttgagacagggtctcactttgttgtccaggctggagtgcagtgtcacagtcatggctcactgaagcctcgacttcccagactgaagtgatcctcccactttagcctccctaagtgctgggattacaggtgtgagccaccacacctggccataattttttaatgagctattccaaattatattccaaatttcatgtccctttactcctaagcacttcagttcttcactaagaatagggatattgtattacatcaatggagttcagttatcaatttgagtaaatttaatattgatacaatactttgatataatctaccatctgtattccacttttgttagttgaccttttaatatcatttttcttctctctgggataggatccattctaggattggtattttatttagtcactggaatgttaatatagccgttttttgttttcattatattggcatttttgaagaataccttctgcctctctatccatatccctttccccctttttaaagagaacgattctcattttaggttctctgatgttttctcatgtttagttctaggttatgaattcttcctggctggatactgcataggtgtcctcagagtatctcatctgaaggcacatgatgtctgtctgccccttattagtgatatgaatttgtgtcacctggtcaaggtattgtcaagcttttccactgtgttagtttcctggggctgccataacagattaccatacacttggtggcgtaaaacaatggaaatttattttctcacagttatgaaggccaaagtctgaaattggtatcactgggctgaaatcaaggtgttggcagggatgctctcttttcagaggagagacactgttccttgcctctttcagcttttcgtagctgcctatgttccttggcttgtggcagcattactttagtcttcagggtcctcaacttcaaacctccctctgttccatcttcatatttccctctttgtgaaattgccctcgactctcttataaggacacttgtgaagcatttagtgcccatccagataatccaggataatatccccatctcaagatccttcatcatatctgcaaagactctctaaataaggtaacatttacaggttccagggattagctttagggaaccagttttcagactactacacaatgtatattcatttttttttctttcttgaagctaataagtaacctttgggtagatatttgtaagatcatgaaaacaaaattatcccctggatttagcatccattgatgattcttgcctgactcaatgtttatataatagttacaaaataatgattttccaattcctgtacctctccacctttgctgttacccttccttctccctttatctgtgtctctttgtttatgcatctacgtttctctgtgtatctatagagctgtgtatctgtgtctgtatatctatatattgtatccatgaatctgtccatctatccctaattgatctggactcacatatcttttttttctagtagtttagaatgcattaatacatttaattattttgattcacaaattgtcccagctttgatcagtaggagcccttttaagctggattctgtgtccttgtaacttcctctcatcctattttcttttttttttaatttcagcacttgttatttttaggcataacaagatgttcagtgctcatcttgaatttattctgctcctgccctgaaatctaccatttcttcaaggaaccctagttgctttttgtggataatggtgttaaagactatgctgcttctcagtttattgtattttagctccacatccatccttcattgctttgtcagatctccttttccagctggtatggatgagcttagtcagtagaaggtgttggaaggacactgtaggaagtagggttttggtgtgcttccgttcctatttgctctgtgctgccagtggcatgtgtgggatgcctagtggtactcatcccctaggaaattttgttgtcagttactgcctgcggctccttgcctttcagcctggatctgctggcaccacaacagagcttcctgcttgccagtctcagcctgtagttccttgcccatgaagtttgaccctcctactatcatattagaacagctatgtcagggacaaccagtgggttacagccacattgcctccaatgagatctgaattccagccttggcaaggaggcacctctttcaggtatttcctttggttttcctcctcaatctaggcattcctaagagttgtcttttatttcttcttagtagttaattctgggtaaatagttaataattctttataagactccctatttaaattgctgtatggatttcattttctgtccagaccctggctgctacagagatcactatctggacagtaggtatgcttcttgcaacttacatctaagcttttttcaacagccagagataggaaatgtaatacatttatctatatgcataggtataatgcacacatttatacatacctctaatcatttgcaaacctgcatatatatatgtatatgtgcacgtgtattatatagatatacatatattttagaattgtttataatacctttagtgaaacaaaattttatatgttcaattatatatttagttctctttgtactctcctcccacctcctggttttgggtttctggtcttgactagaaatgtctcctaatgcctacctgttttacaagatgattattatagtactagttaaaaaaaaagtttaaaaaataattcttgaggaatttatatttgaacaggatgtcagatgatgtttcactttacctttttttttacagatgaaatggacttataagatcacttgttagataacccacctttttctcaatgaagttgaattattatctttgttatgtatagacttcatgtgagttttcactaattaaggattttctcttttgtggcatttatttgtctattcttatataaatacctatgtctatatcacattgatttttatgcagcggctttacagagtatgttctgatagctaataccagctatatttcttatcaacattggggaaattattgcctttcaagatcagcctggagttcctggggctcttacagtgataattattggttctaagaggctgtgccagttatccctttattgcttcttagcttcaaatctctttcttcatttcctccttggttaatgggtaggattctttcagtattttttctttatggtgaatacactgttaagcttagcaacggagggcactccatttcaggagtatagggggcttgtcttccttcttccagtatcctatggattttgttttttcttgctctttttgcattgttgccagagccattctgccttggccacacaatctcttgataagcttgcaggctcagccagtttggtgatcacctagctaaggacaccaaggtgccgcagtcctattggagactgagtttctaactctctggctccttctgtgtacccggaatttgtctgtgtatctgcccctcagctttggcctgctagcaccctgcagagttgtttcctgtgtcccttgttccccctccctgccaacacattttggactctagacctggttgccctcctggagagtacgctcctaataaccccctctccttctacaggcctgtctgctagccttggtctgctttaaccccagaaagttgtttcctatggtcttcccactgcagatggtaggtaccccaggacttgcattaccttgctggtgagttggttcctcataccatgactgtgtgctcacctgtcagccttggcatgcttgaattctggaggagtctttcctgttcttctggcaactgtggttcaacgatggcccagggaacctagcaaactttttttccatccaatggctgcaacccaaccacaccttctctacagagatccgaatcccagccttggagaagagttcccctttctaagttgttccttctttgggtattctccctcaccctaggatattcttcagagttctctttttacctttattgttactccactctcatggctaataattttttttttttgagatggagtcttgctctgttgcccaggctggagtgcagtggtgtgatcatggctcactgcagcctctacctccgggttcaagcgattctccggcttcagcctcttgaatagctgggattacaggctaccatgcccaactaatttttgtatttttaatagagatggggtttcgccatgttgctcaggctggtctcgaactcctgagcacaaagtgatctgtccgcctcagcctcccaaagtgctgtgctggtattacaggcatgagccactgcgcctggcctcatggctaattttttttatattaaacttttccctgttcaaattactgtgtggcttctgtctcttgattgaaccctatattgatactctgatttaggaagagttctgaatgatctgaagtaattctgaatgacctgtttccattggctggtagtctacatggaacaggggtttctccaggctgattataggattacagtattcactgaacttgacacttgcttcctcagtacgttttacatttcacgcctacttgagatttggggacaagatacagagaatctcacatagtatagcaacatcagtggcatttgtgccagaatgaagtgatcatcaaaagcttattgctactattctttaattttaacaaatatttaatagtaacaatttatgattttttaatatcttgagatatatgtaatagaggtaacttgggcacataataaaaagaaaaacatttttattttcttatgtgaaagcaattgagggatgtgggcaacaggtcaatagcaatagaaccattagttctgatgatgggtcttcaatccattctgttcccctaccaagcatttgggagttcatgaactcttaccgttgtaggctgttagcatgtgactgcctgcttttggcctttgaccttatattccatggtgcttcacatttctgttgttttctctttacagttactattcaatatcaatggttccttactttttttcttgatacctttcccatttaaagatgtatgtgtgtgccctttcccattgcaactactacctcttttgaccaccattttgctgtttgtttttttttttttaagatggagttttgcccttgtcacccaggctggagtgcagtggtgcaatcttggctcactgcaacctccgcctcccaggttcaagcggttctcctgtctcagcctcccgagtagctgggaatacaggcatgtgccaccacacctggctaatttttgtatttttagcagagacggggtttcaccatgttggccaggctggtctcgaactcctgacctcaggtgatccacctgcctcagcctcccaaagtgctgggattacaggcgtgagccaccgcgcccggccccattttgctgttaaagtgcctggcaagcatgtttacatgccaaaaatctattacctcatgcttttattttgctcaacttatttttcaagtatttatatgtcaggcgcggtcctacgtgctgaagatacattcataagactgaaacagtctctggatcatgtagctattaataatcttctttgactaatttcagtccagctatcaattatctagaaattttatgggcatatttaattcaagaagctttctaaaaattggcactgaggatatcatgatgcaaacagcccctctaagaaacttagagtcttatggttgaagaagtgagcattaggatccagagttgagaaagagaactgtttcaggatgtggtattctcaccatcaagtttttaagacttgtggcactctaaatatgaagatgaagataattttaagaagtcatcagtctgaggagttttaagaatcatgcttctaaacctacagccagtattttttcttgtgttctaaaagtaagaaccctgccttgccctttaattataattttctctctttctctttgattccttgacaagaccctaagctgcatgatccagagactgctttggtgttatgaatgtatcttcagcatgtaggactgtgcctgacatataaataagttgagcaaaataaaagtatgagttaagatttaaaaggtagagtagttataggtgatgatgtcatcaaaagtcaatcccaaagccaaaattaaaatgtttgattatacctagtatggagcaatagatatacaacaggaagagtataaattcatacagtttctttggagggcaatttgaaataaaccttttctattctgtttttaattaatttttctacacatctattctcatgtctacatgggagatatatatgaatgactattagatgttttggtcttagattcttctttatattcttaaaaattattgaagacttcaaaggactgttgtttatgtaggttttagctattaatatttaccatactagaaattttagaaattgtattaaataaaaataaaaaatacactacatgttaacataaaaggatgtttttatgaaaaatgattcttccaaagcaaaaaagaaatagcaagaagagtggtgttggtttatgtttttacaaatctctaatgtctggcttaagaggagatagctggattcttatagctgtttctgtattcagcctgttgagatatgttattttggttgaagtacatgagtaaaattcagggtcacaaagataatgcagttgaaaaagggaggagtgtttttttttttgagacggagtctcgctctgttgtccaggctggagtgtagtggcgtgatctcggcttactgcaagctctgcctcctggattcatgccattctcctgcctcagcctcccgagtagctgggactacaggtgccagccaccacgcccagctaatttttttttgtatttttagtagagacggagtttcaccatgttagccaggatgatctcgatctcctgacctcgtgatctgcctgcctcagcctcccaaagtgctgggattacaggggtgagccaccgcgcccggcctgggaggagtgttttaatacctttttcagataattaaaggtattctttgatacaccaaaacttgatgtgtggtaatttcataaaggctagttgcattgtggaatcagaaccctgtaaatgaaccttttgtactttgttacattacaatccgttggtctgtcttagatttgaatatatcttttacctgggcatgagtttgtaacaccatgtattggtcatttgaaaaatattggtttcctgaattatgcagattttgtaaacacttacccattttattatacagtgttaaaaatcattaatatcatcacagatttctaaggaaaaaattttaaagtattgggaagctgtcaagcttacagtggtttgacagcttgaattttatcactgataacaatactgttggttattttccttgaattgttaggcccagttgtttatgtttgagaaaatgtctgtcaaatatccaaatctgaatagttatagtttgtttcatttcacagaatttaaaaaattattgttctcaagggttgagatttaataaagttaataatttttactgctttatcaaggacattctaaatgaaactggcattacatttctttttttttttttaaatatgagtgagtggcatattatactcgtaatcattatattccgagtaagtatagtttggtgctgttgccttgatttcatgctaagaggtcagcagttttattaccattgcttttagatcatcagtgcaaatgttagtgcagtaaaaaaatgcaactgcttttgtagtagtattattaaaatggtttgaccttgctgattgcctgaaaggccctgcagggatcatctgcagtctgtggatggctcatagagaacacacgtacacacatatatacatatacacagggtgttcattgcagcattatattcagtagaagaaaactgaaaattgaatgtttctctatctgtgattgtatggatgtgccataatttagccaagtaataggattttggggctgtttgaaatacacttgtatgggccgggcccggtggctcatgtctgtaatcccagcactttgggaggccgaggcgggcggatcgcaaggtcaggagatcgagacaatcctggctaacatggtgaaaccccgtctctactaaaaatacgaaaaattaggccgggcatggtggcgggcacctgaagtcccagctactcagggggctgaggcaggggaattgcttgaaccagggaggcggagcttgcagtgagcccagatcgtgccactgcactccagcctgggtgacagagcaagactccatctcaaaaaaaaaaaaaaagaaatacacttgtatggaacaatatccaagatatgtttttaagctaaacaaaacaaacgcgtataatgatgtttagtaagatcctgtgtatgtgtaaataaacatatatgaatcatacctatacacatttgtatagtgtatgtaacctctgagggagtggtaggagggatatttttacttgttgcattgcactttctgtactgtggaatttaacacatttatctttaatgttagaggatacatagctggcttcttaaaaaagaaacttgtcactgggtgaaagagtggcttttaaattggttgaagttcttagctgttattatcagctgctaatggattatcttaaacttttctccacatccttccatattatagaatgaaagtttcatattaatcttaataagtaagcaatttatctcttttaataaatggtaccgttcatttgtaatgtttgataactgtaatgaaccttgtaggcagcagctgtggttgtgtggaaggaattgttggttaataatctactttttttttttttttttaatgaggcggagtctcgctctgtcacccaggctggagtgcagtggcgccatctcggctcactgaaacctccacctcccgggttcaagagattctcctgcctcagcctcctgagtagctaggattataggtgtctgccaccatgcccggctaatttttgtagtttagtagagatggggtttcaccatgttggccaggctggtttcaaactcctgacctcaggtgatcctcccgcctcagcctcccaaagtcctgggattacaagtgtgagccactgcacccagccaatcatctacctttttataggtcctcttacattagtaagtaaacttcagcagcaaaggagtcctcttgtaattttgcatatgatcgagctgatgtagttattgttctaatggtatggtgagaagtacttattttttgcagtcagatagatttagacccgtatcttctgttaactatttactgccagtgtgatcttatacaaattaatatctgagtctagttttcttattggtaaggtaaggataataccttactgttctaacaattatatctgtataatatttagctccatgctagatgcatgtcagctagtgttagctattatctgttactcagtgagtttaccattcctctaacataccttactctcttgtgtcttcttctttagttttgtgttgctccgctgtgaagtttctggttagcctttcagaagatatctcttctaggaagtttgccatgcttcttttcagctgagttaactgtttacccttcctggttattcatctcatcagtatagcacttaactcatgtatttttccccattttttttaaattgacaaaatttcaaatttatgctccccccccccaccaagagaatagtatagtgaacacatatatatacgtttttttccaaattcatggattgttaatattttgccacatcttctgcatttctgtctctatgtatgtgtttctcattttttcctgaaccatttgagaataaaatgcagacatcatgatatttcatccctactccccatgtttctgctatgatcataataccatattgcacctatgaaatttaacattgatgcaatattataaaataggcagtccatcttcagatttctgtagttgtccttgaaatgtcctttttagctttttttttttgattcataatcatgcctctcttggtttctttaatctagaatagttcttattttttttctttttgatttttcataacactgacatttttaaagaacgtagaacagtagttttgccagtttcacaagctatatctgtctgattgttttctcatgaatagatcattgtttgttgtttgttttcttctatctgtcatcagagtatgacttcctgtgagagagagacaggcagctcccaatagctaagaactggccaggcactatattggtttgaccttggtgtttcttagagttggcctggaattcacaattaggctgtggtgttctcgtattgaacaaaaacaattccatagaacattgaacattaagacaagatcactccatgtccttggatgacgacaaaaacaagaccatcctgtagtcatgtctgaacacagacaaaaacataaacattgttcaagtcacaaaaatgatcaaatatcctcattctggttacaatgaatgactactgcttctttataaatcataaccttagccttgctttatttttcctgcttcatagtaagatacattaaaaaatcatagaatcatagaattagaattgagagaatcatagaattacctccacttcctgacagcatccaatccagggcagaaccccacttccttgaacccttccctaacacaagccaaagccctgtaagtcctttctgataccctcttggtgaaatgccccagtgttcccaatggtatgtattctccttagttgtaagaagtaataaattcagcttgtttaactacaggtgtgttcctggtgctgtttggctagagagaatttaatccagagaatcttgacctctctctttctttttactctgtgaatgaacttttgatatagttaagaatcatcagcattaagcttttctagataatttcatactggtcaaggataagttttagttccatgaactagcttttgatgactaacatgcattttaaaaaagttgtaaactctgctatttaggagttcttctaaataataaaaacaacatagggaagataccaaagacagcttataaatcaaacagagaggctttatttttagtgagtaatgagcttagttagaatgtttggatttaattccctcccctccacagcttttaataaccattgttgggtgattgggagtgggagagtgtcttatatatattatacacacacagaaatatataggtatacctcagagatattgcagatttggtttcagaccattgcaataaagtgagtcacacagaatattttggtttcctagtacatataaaagttgtgtttatactgtactgtagtctattgagtgtgcagtagcactatgtcttaaaaaagtacgtaccttaattaagaaatactatattgctaaaaatgctaattttcatctgagccttcagtatgtggtagtctttttgctcatggtgcgtcttgtctccatgttgatggctgccaactgatcagggtggtggttgctgaaagttggggtagttgtggcaatttcttaaaataagacaacgatgagatttgctgtatccattgactcttcctttcacaaaagatttctctgtaacatgtgatggtgtttgatagcattttacctacagtagaacttctttcagaattggagtcagtcctctcagatcctgtgactgctttatcaactaagtgtatgtgacattcagaatcctttgttgtcatttcaacagtgttcacagcatcttcaccaggagtagactccttctcaagaaacgactttctctgctcgtccataagaagcaactctttgttcatttaacttttatcatgagattgcagcaattcagtcacgtcttcaggctcctcttccagttttcattctcttgctatttctaccacatctgcagttacttcctccactgaagtcttgaacccctcaaagtcatccatgagggttacaatcagcttctaaaatcttattaatgttggctgggcatggtggctcatgcctatagtcccaacactttgggagggcagggtgggtggatcacttgaggtcaggagttcgagaccagcctggcaaacatggtgaaaaattagccggacatggtggtatacgcctataattccagctactcgggaggctgaggcaggagaattgcttgaacccgggaggcggaggttgcagtgatttgagattgcgctactgtactccagcctgggtgacagcacgagacactgtatcaaagaaaaaaaaaaaagttgatagttttaccttcccccaaatgttgtcaatggcatctagggtggtgaatcctttccagaaggttttcaacttattttgcttaggtttctgagaggaatcacttgtatgtcatctatagcctatgaaatgtatttcttaaataaataataaataataaaccattgttgggtaattgggggtgaggaagtggcttatatatattatatacacacagaaatatataggtaaataaggaggattgaaagtacaaaattactccttgatcccatggactgtagaattgatgttgtgttagctggcatgaaaacataattaatctccttgtacatctccaccagagcttcgagtgaaccagattcattgtcagtgagcaataatattttgaaagggcagggcacagtggctcatacctgtaattccagcactttgggaggccaaggcgggtggatcacgaggtcaggagttcaagaccagcctggccaacatggtgaaaccccgtctctactagaaatacaaaagttagccaggcatggtagtgtgtacctgtaatcccggctaatcaggaggctgagacaggagaatcacttgaacctggtaggcggaggctgcagtgagctgagatcgcgccactgcactccagcctgggacagagtgagactgtctcaaaaaaaatttttttgaaaggaatctttttttctgtgcaatagatctcaacagtggtcttaaaatattcagtagaccatgctattaacagatgcactgtcatcgaggctttttctgttgatggaacacaggcagagtagatttagcctaattcttaaaggccctaggattttcagaatggtcagtaagcattggcttcaacttaaagtcaccagctgcattagcttctaacagaagagtcagcctgtgcttcgaagtgtggaaaccaagcatgacttctcctgtctaggtatgaaagtgttggatagcattttcttccaaaagaaggctgttttatctccattaaaaatctgttctttagtgtagccatctttatcaatgattttcgctagatcttctgtataacttgaagcagcctctacagatcagcccttgctgcttcaccttgcacttttatgttacggtgatggcttcattccttaaacctcatgtaccaacctctgctagcttccaacttttcttttgcagcttcttcacctctctcagccttcatagaattagagagttagggccttgctctggagtatgctttggtttaagggaatgttggggctggtttactttctccatatcagcaataacgctgcttcactttcttatcattcatgtgttcactggagtaacacttttaatttctttcagtaacttattttttgtattcacgacttggctaactggtgcaagaggcctaactttcaacatttcttggtttgtgttatgccttccttaccgagtcttgctctgtttccaaggctggagtgtagtgatgcgatcatggctcactgcagtcttgaactttgggactcaagcagtcctccctcctcagcctcctgaatatctgggactacaggggactacaggcatactacaggcatgtgccaccatgcccggctaatttttttttttttttttttgtagagacggggtttcaccatgttacttaggctggtctcaaactcctgggctcaactgatcagcccgcctcagcctctgagagtattgggattataggtgtaagccactgcaccctgccttatttccagcttttgatttaaagtgagacacctgtaactcttcctttcacttgaacacttagaggccattgtagaggttaattggtgtactttcaatattgttgtgtctcagggaatacagaggcctgaggaaagggagattgggtacagctggttggtggagcagtcagaacacactcaacacctattaactaagtttgcgttttatattcttgtggtttgtggtgcctcaaaacaatgttattgtattgcaaatgccagtaccaaagattactgatcatagatcactacaacagatataataataatgaaaaagtttgattgtgacatttaccaaaatgtgacacagagacataaagtgagcacatgctgttggaaaaatgttgccacaaatcttcaatttgtaaaaaaatgcagtatctgtgaagagcagtaaattgaaattcaataagatgaggtatataatattgcactgtaaacctcgggaaaaatttgttttgcattttctatgtttctatgtctataatttttctactctgttcacaggaaaataaacattggtactacaaagggaaattcaaagctgtagtaggagaagcacctgattatgatttctcatgttgttacagcctttcaagtgaaattttgattatgttgaaggatacacaagtagagaatggttgcaaggttattgtctgccattaggatgactgttgaatcttgctgctacttttttgaaaattttcaaattaggttgtctttattaaatatattagttctagaagttatttcattaaaattcatctgtgttttttcatttatgctacgagtactatttttttctttgtagtagactttacgcaacattttattgtgaaaattttcaagcatatagacaagttgaaagatgtggacagtgacattttgctatattttccttatcatatatctttccataatctgtcttgtttttatgcatttcagcataaagtgcagataccagtgtctttcacccatacatattttaacatattgtcattaataagagttcagtatttgtttacattttgtttagataagtttacacacagttaaatgcacaaatcttaagtatcccattgtatgtgtgacaaacatatacctgtataacccaaacccctatcaagatatagggcattaccaacacctaaaagtttgcttcttgccccttccctgtcaatccctgcccttaagctacccagaaggaactttttctactatatattagttttgtacatcctggattttaaatggaatcacgctgtacaaacttttcatgtctggcttccctcctgcagcatgtttttgggattcatccatactgttgtgttcatcagaggttcattccttgttattgctgtttagtttaaatgtaccacagtctgtttatccactgttctatcaatgggcacctggaatgtttccagtttggggcaattttaagtaaatctacaataaacatctttatatggacatatgtttctcttgggtaaatacctaggaatataatttctggatcataagataggtgtatgttttattttataaggaactaagagactttccaaaagtgcttgtatatttgatattcccatcaacaatgtatgaaatttctggctgcttcacactcttaccaacattgggcattatcagccttttttaattttagccattctggggcatgtgtaatggtatcttattgtggttttaactttcagttcctgacggctaataggctaaagattttttcacatgcttattagccactcatatatcctttttttttgaagtatctgtttacatcttttgtctattttgtggggctggagttctttgtatatcttagacaccagtcgtttgatgttttgcaaatgttttctcccagtcagttgttcgtctattcatgtgttaatggtctcttaaaaattttattattatcaggaaatgggaaaacattagtttattttagattcagcaggtacatgtgcagatttgttacctggttatattgtgtggtgttgagatctgggcttcaaatgaacttaccacccaaataatgaatatagtacccaatagatagtttcttaacagttatctccttctttccatccccgcttttggagttctcaatgtctgttgtgcccatctctgtgtccatgtgtacccagtgtttagctcccacttaaaagtgagaacatgtggtatttggttttctgttcctgtgttaattcacttaggataatggcctccacctgcatccatgttgctgcaaaggacattatttcattcttttttatggctgtgtagtattccatggtgtatatgtaccacattttctttatccagtccactgttgatgggcacctaggttgattccatgtctttactatcgtgaatagcactacgataaacatgagagtgtaggtgtctttttggtagaatgattcgttttcctttgggtatatacccagtaataggatggctggatcaaatggtaattttagttctttgagaaatctcaaacatgccttccacaggggctgaactaatttacactcccaccaacagtttataagcattccctattctgtgcaacctcgccagcatctgttattttttgactttttagtaacagccattctgactggcatgaggtggtgtctcattatggtttcgatttgcatttttctaatgatcagtgatgttgagcatattttcatgtttgttggctgcttgtatgtcttcttttgagaagagtctgtctgttcatgtcctttgcccacttaatgccattcttctgttgttattctgaagtattttaggaacaaagaaatgagcatgttcctttatcgtatttgttctgataataggattcaatgtaattgaagcttatttaatgcataaccctttatttttggttgtgcactactctgaaaaaaagtctcaattcatatctgcttgtcaaagtttagtggaatagaaacaataaatcaatagcagtacaagaaatgcttttgacatttattccattgcttaagtgttttactttagcttaatggagaagattaaagcctccaatttttttttgtatttgtttcagatagaaataagatctttttagggtactattaaatattaagaagacttccattaagatttctcaacaagtagttaatgcatttaaagatattctcaggtagtctagtgggtcaaagtataaaataatgtgtgcattttctaggttatttttctaagcttttagatgtttacacaattactaatattaatttataggcacttgaatttacttttttctttaagcgataactatattggactataatcataagcactgattcatactttcttatttaggcaaaataaggaataatgagcatttaatctagttggccagtagattttttcctaagattaaatcatttagattgttttcaagccagagaattggttttacctattggggttcttgcagatttgtttctagataatattagtgataggtaagcgagtagtgtcattttagatttggtattgttattgggagggttgagtttaattgttgcatttgaactgagagcatttgaactgagaactaagaaaaacaaatgtggcataatggattatgttgggtttggttatttgtgagaaaactcaagatagaagtccatttcttcctcatggcaaaagatttggaggtagcctcaagcgtggcagctgcccagtgatctggaatccaagctcctgtcttgttgctgtgtcattttttaatgagatgtagtctcgctatgttgcccaggctgagttgaactcctaggctcaagtgatccttctggcctcagcctcctgagaagctgggattataggtttgcgccactgtaccctgtttgtgtcatttttaaccttccacttcttggttcttcttgaaagggggaagggacaaagaagaaagggagagaggttgtatgtcatttgtcttttaaaaagatttctgggaagctacagtataatttgtttatatgctatttgccagaacttagtttatatctatgcctaactgcaaagcaagctggcaattacaattttttttttcctgggctgtcatgtacccatttgaataaaaattgaggaagaaagcaagaacaaatatttggatagcagtggacagcctattccatagtaagtaaagcagtatacagaatgttaggaatcctctaattgactgctacttgcctgctgacctttatttggtcctaggctctatcaagatactgataaaagttatagaccctatccttagaaaaatgcacctgtgtatatatatgcatggaattctgtgggattattgtctctggagcccatccatgaaccattgcctaagaggttgtgtatggatccactgttaagatttcctgttataggctgggtatggtggctcatgcctgcaatacaatcccagcactttgggaggcctagatgggaggatcacttgcatccaggaattcgacattagcctgggcagcgtagtgcgaccctctctctacaaaataattagctggctgtggtggcgtgtgcctgtagtcccagcttcttgggaggctgaagtgggaggattgcttgagcctgggaggttgaggctgcagtgaggttttgatcactctgggtgacagagtgagaccctgtctcaaaaaaaaaaaaaaagattatctgtgataatgtttcattgtaagacatttatttatttattttgacatggcttttaaaagtttttgttattcactcacacagtcaataaaagcttgctagcatgctctgtattttagtcagtatgatagaacttgaagattcaaagaaccatgatattctattaagtgcttactatgtgcctcgcatgaaactgggaaccttaagtacattatccatttcctacattttaaaaatgaggaaataatctgcctaagattttatagctagtgaatgatagaggtagtatttgaattcaggtccttttagttatcgtgaaatagacacttcaccataagcatgagacacactgggcagagggtattttagtggttcagtttcacttgccagtcatataggcacttgccttgcctatataactaggaatctctttgtgcctcagttttctgttaatactctgcaaaggcacttaaaatgtttatgtggtgatgctacttttctgattttgtatttttttattgcaatcagtatgatatatggcatatgataaatgtcaactggtaatctaatctaagtactacaaaatgatcatattttgaaaatgtcttatcagcattcaaattttatgtatcatttaaaaattctatggaaagcaccttttgatcaccttgtaaagcagaactcactggtgccatatgtgtgttcttttttctcacaagcatgctgttatgtatgctgacagcatcacacgttgaatttagcataaaagctttttgcttcaagctgagatttttgaccccactaataatacagatgttctcataatttcctctcttcagcccctttataaatcaaaaagagtagaaaagggaaaattatatgagtaattacagtattagattactatagaaaaccatttcacttctttaaaattctcttttcatctttagtttcgaatcaccagcttcttaaatgtcaactttcttaaattgacaggctctaaattatgaatgtaccatttatttatcggttgacacctttgtctcttgttttatcagaaacattttcttttctactgagagtactgctgattctaattgtagagattagatttgacttcagaagtttgcataataagcaaagcaactaagtgataggcctgctgctgctttctgatctgtggacgtaaactatcataaaccagtgtttgatcattcttcccttaagtgttgattcttatttaattgtagggcgatttgatgaaactgttatcgaagagagaagacaatgtgctgaagacctgctacagttctctgccaatattcctgctctttacaatagtaaacagcttgaagactttttcaaggtttggtagtctttctggaatattttatatcttattaaatacttttgtaatttgtagtaaagtaaaataaaaaatgccacttttgaatttcgttattcactataaaagtagaaattaatagctctataataatgtttatggcatatttcctatttttagtatagaaatttatgctttttttttttttttaaaggaactggttctgctctgttgcttagactgttgttcagtggccattgacaggtgtgatcatggcgtactatagtcttgagttcctgggctcaagcctcctgttgcctcagactcctgagtgtttttgattcatggatcttaaaaaattgatgcaaagagcttagagattgtttaactcactctgtcataattgaaatacattaaaaaaaatgaagcatcataaaactctagtacttaccttcactttttgaagtgtctttcagtggcagattactcttggaatataagccactgtaagtctatattaaatttgttattatgttgacttgtataaagatacaacaaaaatataaaactgcacagttttagagagcaggccagtgcaaattatattactggagatcattggatattagtgttttaagttcctagatatgtaatgctttcattttaagtttttttttttttttttaccatttttaataataattttctaacttattttgaactgtatcggtatatgttgtcagttggtattgttgtatttaattactacattttccctgttgcattgagttaaccttctaaaaaaaaagaaatctaagtgattgtgctgtaattgtttttacttctttaaaatctattcacttgtataagttaaatttcttagcctatataaccagtgatatgtatgaatagtgagatatttaatttttctgattttagtggatctacacagattatttatttatttatttttttctgccagtgcttcatcacctaggaatttattttttatgatgttttatctactgaagaaagttcttttgaaagatattgcaaatttacagtaatagaaataatgatagtaatagaagtgtttatagtaacaataacatttctgatgattgaccgtgttgcttaatttttcaccattctgcaaactaggctgagataataaatgtgatttctgcatatggccctatgcagatctttaggataaaggccaaatcaaattgatagagtatttagctctttgctgttctttgttaataattgtttctatgtgtcagggagtctgttttttatggaaaaaggctttattattaaacaagaatattgctttatagaaattgtgaaaagctgtcatgcaaattaccacctgccatatggctaaaaaaaattagggattatggaagtcctattaaatactttaaacaatttaagtaaaagttagctgttcattgtatttcttctggatatgggaattcctgattgtaattgttgctggaagtcactgggaaatgagactgtcattttcagagtttgtgaaagattggacagtttaagagaagtcaaactaatcttggaaagtatcttagaactatctttaacagcgtgctaggcgggaacaggatactgatttgggaatatcagagcagtggtattcagtcattatctctatttaaatagagataatcaagcaagaaaaaaaaactcattccattagcttgaacaaaaaaaaaggtatttatttttcatatgacaagaagtatgaatgaggaaggtagtccaggactggtatggagctcagtaatgtcatcagtgacataggtttctgggtttaggtgtgaaagggaaaaggccaaaagaaacatggcagtttttaaaagctttcccagaaacatgatctagagatagtccttcttacatctcattggccagaacagggtcacatgcccatccttaatttgaaggagtctcggaaggtgactcttagctttctagttctgatcatggatgaaggctgtggggaaggttttggggtagctaattcacagggtgtgctatagtatcatagtttatttttctctttagagacattgatgatgccacatgcaaatgaccatatagccacttgcttacattgactttaaaaaaccacatacataagagtagaatgaatagtataatgaacttctatgacccatggcctggtttcagaaattatcagtatattgccaaacttgttttatctatacctttccatcccatactcttcactggttgtttatttattagtattagtacagttactaattataattgtacaattcaccgattttcagtaaatttatagagttttgcacctatcaccaacatccaattgtattttattttattcttttttttttctgagacagaatctcactctgttgcccaggctagagtgcagtggcacaatctcggctaaccgcaacctcttgcctcccgggttcaagctattctcctgcctcggcctcctgagtagttgggattacaggtgtgtgccaccacacctggcaaatttttgtatttttagtagagacagggtttcacaatgttggccaggctggttttgaactcctgacctcaagtgatccgcctgcttcagcctcccaaagtgctgggattacaggtgtgagctactgtgcctggccaacatccaattttagatcatttccattaccgcacctctgtgtctacttgctatggtgatccccttttccatccccagcctggggcaaccaccttgttctgtctatagatttgcctttccccataatttcaaatacatggaattacacaatatatgtagcgttttgttcacaacataagtatataggtttctttcacttagcataatgcttttgagcttcattcatgttatgtatcagcattttgttcttttatgttgctgaaatgcatttcattgtatagataataccacattttcttcattcattgataaattgatggacatgtttggatgtttctacgttttggctgttatgactaatgctgctgtgaatatttgcctacaaatctttgtgtggatatatgttttcatttttcttgggtgattcctgaggagaggaattgctggatcttatggtaaattcgtgtttttaagaaactgccaaactgttttccaaacggaaaatagccagtaatgtttgaacttaccagttgttccacaacctcaccaacacttggtattgtctgattttttaactgtagccattctagcaggtgtgcagtggcatttcaccatagtattaatttcagtttcctaatggctaatgatgttgagcatgttttcctctgcttttttcatatatctttggtgaaatgtccattaaaatctacccatttttttgattgggttatcattgagttgtaagagttctgaatatattctgtataaacagtcttatcagataagtgatttgtaaatattttctccccagtctgtagccttttagttttcttagtggtgtcatttgaagctcaaaagcttttagctttgatatgatgtataatttatatatattttttcttttttgggttatgcctgtcatacccaggaacttttcgagtatcccaagatcatgaagattttcttctgtttacttttagaagttttaatgttacaggtctgtgattcatttttagttcattttatatacggtgtgaaggaacggtctaaattcatcttctggtgtgtgtatatctaatattctgagcatcatttgttgaaaagactatcctcattgaatcaccttgggactcttgctgaaagtaaattgactgtaattataatggcttatttctggactgttgatagttctattaatctacgtgcctgtcttatcctagaaccatactgtcttgattactgtagctttttaagtattgaagtcagctagtgtaagtttgcctactttactttttcaaaattgttatggcaattttgagttctttgaacttccataaaaatttttagtggcagcttatccatgtgaacaaaaaattctcatagaattttaaaattattttattattttacttcttttttttttttttttaaagaattggggtctcacttttttcaccgaggctgggatgcaatggcacaataatagctcactttaacctcaaactcttgggctcaagggatcctcccacctcagcctcccaagtaactgggacaggaaccaccacacccagcttatttttaaatttttttgtagagacaggttctcactgtgttgcccaggctggtcttgaactcctagccttaagtaattctcttgcctcagcctcccaaagtgctgggaatacaggtgtgagtcaccacacctggctgaaggtattggaaacacctgctaaaatccttcagtttgatgctctcccaactgagttattttggcttgctcctcagaattctgattagaattgtattgaatctgtagttcagtttggggaaaattgtcattttaacaatattatcttgcaatccatgaaaatgaaatgactctatatttatttggatattctgtaatttctttttgagacggggtctcgctctgttgcccaggctggagtgcagtggtgccatcttggctcactgcaagctccacctcccgggttcatgccattctcctgcttcagcctcctggttagctgggatgacaggcgcccgccagcacgcctggctaatttttttgtatttttagtagagacggggtttcaccatgttagccaggatggtctcaatctcctgacctcatgatccacctgcctcggcctcccaaagtgctgggattacaggcatgagcaaccgtgcccggcccgatattctgtaatttctttaagcaatgtttcataattttcagggtataagtctggagcttcttgccttaaatttatttgtaagcattttaatcttatgatgctgttttgaattaaactgtttttttttccatgtagtattatgctttaatggttcattcatgttgtagcatgcatcagtactttatccatttttgtgattatgtaatattcttttgtgtggctatggatatactacattttgtttatctacagtgtgtgttggtgcatatttgggttgttccccttttggctattatgaatggtgctgttatgaatattgacatacaagttcttgtgcagacaggtatttttgtttctcgtaggtatacctaggagtggaatttaggtgggaagtttttttttttttattggagatttagagggtgtgtatgtatgtacatatatttatgtttttaaggttcatccaggttgtagcatgtatcagtagttcattccttattatggctaaataatagttcattgaatggatatgaatataccacattttgcttatccattcattagttgatagacattcagattgtttttgcttatggctgttatgaaaaatgcttcatttgatccttttttataattttgatttatttatatttgctattttatgagtcatagtccttttaattctttaatcatgttttcccttgataatatgaacatatttttaatagctgctttgaagtttttgccaagtccaacatctttgttccctcacagatagtttcgattgactggttacctcccatgtttgggtcacatactttcctgtgtctttgtatgtcctgtaatttttttttgttggaaaatctatattttggataatatacgatagaactctaagttctgatgttttttttcttcctgaggattcttgccattttatgttagtgtgtttagtaactaatactttttgttagtgtgtttagtccatagtaaatctgtggagtccatttcctgtgaagtgtgtgactgctgatatctctgcccaatatttaattctaattttatttttaagccaggctatataggggttagacctgtgtcagcatagctttgtggtcagccagtgctcggtcattgcttgtgcttaaacacctgtgccattatatgctttccttttaatgctgatgattttttaatgtgttttcaaagtctcagctgttttaaaatttgccctggcttttactttcctctgaagtcttgaatttcctctgtgcctgtgcactgtctcatggtttgccaggtattcgtggatagcttgacccctctctggtctctacacagatgggtagtgagctttatgaagaccccctgtggctgtgttattttctggatctccctgctgtctggtcttttcctgactgcaacttcaggtgtgctgagccatcacttttccttgccatatatttggccctgagattgctactattattgacaatatttggggtggatttttttttttttctgtgcttcaatccaaatcacattagcctcctcaaaagtgaacctgctggttttcaagacttgccttgcccttatataattactgtgaccactcagctgggatgggggttgggaggaactgaggcaagaacatcacagacgtccatagttcttacctgtggttctgtggtttctcggtaaccactctttcatttgctttatgcttttagtcaatttccagagccctcaatggtggttttgacagatttctccagatttataattgccttttggggaaagcatttgctggatctcctcacttaactataccagaagtccttccctgctagactcttcattaacagaaaaactttgagatactatatatcccaaaatttctatgaaatttttttactgcatactcagaaacacctaaaaggttatttttgaattagaagtttaaaattaggattgtggcattattttactgctacatccctctagttcctgtataacagtttttgttgtgtttcattaaatatttgttctttcctatttattttttataacagtgtttgttaaactaggtaaataaaatatttaggattatgagctaaaacattttgcattttaaattttatcttacaagaagatcttatgtcaactaataataaacatttattgagtgcctacattgttctaaatactctgtgtgtattttttattttgcatgaaatatgtaaaataaaataatgtcttagttagaagacattttataggtcggtaacttaaatcgcacacctagtggtagaagaggtagttaatagttgaaagatactttgttttaacattaactttatcttttgacattctctagaatacttggaaatcttgatttggtttggatattgtttaaaagatggcttagtctagaatagatattctttttggagaaaagttcaaatataagctgtaatctgaatattgtaataaagtgtagaataaagtaatacaaattgtcgctcctaaagagaataatcatttttaaggttttagttcacataacactaagggaagtaaaatgtggtaatttgagagggaccatttcaaatttctgttccttaaaaacaagctgacagagaagggacttctgattaggtaaagatagtaattgagttttttttgtgctgaagtagagaggaaatgggggcttgtaattcttttgagctttattattctgttagtagtgtttggaggcatagaactgttggtagaaggtagaggggaaggtattaaggagcagaagagctattgttttaattatttaaggattataagctcttctattgtgattggagcatacataaagctatagcacagcatcataccaccactacttgtctggtgatatcattctctagctgcatgtagagtaagattaactttctgaggcgtgaatttgcaaacctaaatagggaattaaaatgatagccacatagagaaatcaattttatatttattttttatatctttaaaaaatatctctactaaaagtaccttaattttttttgttttacctatattgtatacaagtggttctcaaactttttttttatttttatttatttatttattattattatactttaagttttagggtacatgtgcacaatgtgcagggtagttacatatgtatacatgtgccatgctggtgtgctgcacccattaactcgtcatctagcattaggtatatctcccaatgctatccctcccctctccccccaccccacaacagtccccagagtgtgatgttccccttcctgtgtccatgtgttctcattgttcaattcccacctgtgagtgagaatatgcggtgtttggttttttgttcttgctatagtttactgagaatgatgatttccagtttcatccgtgtccctacaaaggacatgaactcatccttttttatggctgcatagtattccatggtgtatatgtgccacattttcttaacagtctatcattgttggacatttgggttggttccaagtctttgctattgtgaataatgccgcaataaacatatgtgtgcatgtgtctttgtagcagcatgatttatagtcctttgggtatatacccagtaatgggaaggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcttgtccttcgcccactttttgatggggttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgacattgcttttggtgttttagacatgaagtccttgcccatgcctatgtcctgaatggtaatgcctaggttttcttctagggttttgatggttttaggtctaacgtttaagtctttaatccatcttgaattgatttctgtatgaggtgtaaggaagggatccagtttcagctttctacatatggctagccagttttcccagcaccatttattaaatagggaatcctttccccgttgcttgtttttctcaggtttgtcaaagatcagatagttgtagatatgcggcgttatttctgagggctctgttctgttccattgatctatatctctattttggtaccagtaccatgctgttttggttactgtagccttgtagtatagtttgaagtcaggtagggtgatgcctccagctttgttcttttggcttaggattgacttggcgatgtgggctcttttttggttccatatgaactttaaagtagttttttccaattctgtgaagaaagtcattggtagcttggtggggatggcattgaatctgtaaattaccttgggcagtatggccattttcacgatatggattcttcctacccatgagcatggaatattcttccatttgtttgtatcctcttttatttccttgagcagtggcttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgcacattgattttgtatcctgagactttgctgaagttgcttatcagcttaaggagattttgggctgagacagtggggttttctagatatacaatcatgtcatctgcaaacagggacaatttgacttcctcttttcctcattgaataccctttatttccttcttctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagcttttattattttgaaatacgtcccatcaatacctaattgagagtttttagcacgaagggttgttgaattttgtcaaaggccttttctgcatctattgagataatcatgtggtttttgtgtttggttctgtttatatgctggattacatttattgatttgcatatattgaaccagccttgcatctcagggatgaagcccacttgatcatggtggataagctttttgatgtgctgctggatttggtttgccagtattttattgaggatttttgcatcaatgttcatcaaggatattggtctaaaattctctttttttgttgtgtctctgcccagctttggtatcaggatgatgctggcatcataaaatgagttagggaggattccctctttttctattgattggaatagtttcagaaggaatagtaccagctcatctttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtctgtagtattctctgatggtagtttgtatttctgtgggatcggtggtgatatcccctttatcattttttattgcgtctatttgattcttctctctttttttctttattagtcttgctagctgtctatcagttttgttgatcctttcaaaaaaccagctcctggattcattaattttttgaagggttttttgtatctctatttccttcagttctgctctgattttagttatttcttgccttctactagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaaggcatctttatttctgccttcattttgttatgtacgcagtagtcattcaggagcaggttgttcagtttccatgtagttgagtggttttgagtgagtttcttaatcctgagttctagtttgattgcactgtggtctgagagatattttgttataatttctgttcttttacatttgctgaggagagctttacttccaagtatgtggtcaattttgtaataggtgtggtgtggtgctgaaaaaaatgtatattctgttgatttggggtggagagttctgtagatatctattaggtccgcttggtgcagagctgagttcaattcctgggtatccttgttgactttctgtctcgttgatctgtctaatgttgacagtggggtgttaaagtctcccattattaatgtgtggtagtctaagtctctttgtaggtcactcaggacttactttatgaatctgggtgctcctgtattgggtgcatatatatttaggatagttagctcttcttgttgaattgatccctttaccattatgtaatggccttctttgtctcttttggtctttgttggtttaaagtctgttttatcagagactaggattgcaacccctgcctttttttgttttccatttgcttggtagatcttcctccatccttttattttgagctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagtcgatgcagtttcttcctagtctcgatggtctttacattttggcatgattttgcagtggctggtaccagttgttcctttccatgtttagcgcttccttcaggagctcttttagggcaggcctggtagtgacaaaatctctcagcatttgcttgtctgtaaagtattttatttctccttcacttatgaagcttagtttggctggatatgaaattctgggttgaaaattcttttctttaagaatgtcgaatattggcccccactctcttctggcttgtagagtttctgcagagagatctgctgttagtctgatgggcttccttttgagggtaacctgacctttctctctggctgctcttaacattttttgaattttaaaataatagtctatttctagggcagtttaggtttatagaaaaattgtgcagaaagtacagagttttctcatatatctcttcttcctccccagcccccagtttctgccattaaatatcttgggttggtgtagtacgtttgttacagtcgatgagatatacctattgtttttttttgaaaacacttgtcatctagtttaatagattagtatagtcgtttctgtacatctttacacatacttaattgggataactattttttatttagtgttgtttatgctcttaatgctaatgaaacacaattgctcttatctctttagggtggaataattaatgatagttctgaattaattggtcctgctgaagctcactcagattccctcattgatacctttcctgagtgtagtacggaaggtaagagattttaatttttttgcatttcaaaggtttggattacagaagactataaatcatatctgcattgcaaaaagacagatgtatataggaatttgagggtatttcactgattctaagatgctttttttctttacattttattatcactgatgttgggtgcatgatattgggtcaggcatatctcatatttaattggcagcttttttttttcatagtggtatataaaataatgattcatcctccaattaatggtatcttagaattgatgaaatatggtataatgagtagttcagaatttgtattgtctagtgtaagaaggccttacttggccaggcatggtggctcatgcctgtaatccctgcactttgggaggctgaggtgggtgaatcacctgaggtcaggagtttgagaccagccgagccaacgtggtgaaaccctgtctctactaaaacagaaaaattagctgggtgtggtggcaggcatttgtaatcctagctactagggaggctgaggcacaagaatcgcttgaacctgggaggtggagtttgcagtgagctgagactgtgccactgcactctagcctggacaacaaagcaagactttgtctcaaaaaaaaaaaaaaaaaagccttactcatttctttagcgcatctgacttttagagaactaatttcaagactggctttagagatttagtcatttagccacaaagaataaaccctaaggcagttttaatgtttttgatatgtttttaaataaaatgagtctaaatcaagttttaatcactttcattcaagaatgcttaatctcttgttttattcttctattaaggtacacttgaatttatacatttcagcctttggatttctgtaactagttttttttcagggaaggttacggaaaaaaaaagatttgggggcaggggtaggagggatttttaaaatcaaaatagataattagatttgttttaggtggcttaggtttggtttattaaaggtaaaataataaactaaataatattgcttatctctttcatgagtaagagtttatggtggaggaggatgctttatgaggatgaggtagccatcatctcattgtagtgttgtttttgtgagggtatgtactcctgtcatacagcagcagccacactaacataaatctcttgcagtaaatttccatcgtgatttggtaagagcaacgtgttcttatttattatgtgggctggtgcacttaagttttttttttcttttggtactaccgtattgagaagtggttagcttttattctttttcattgtactttccattgacttagcatctatttatttaaacttagtgttctgtgtaatgcatgggggccacatgcccaggggtcttcactgagttctcagtatctttgactccaccctgattctgccagggtcatagaaaaacattgttgacagtaattttactttataatctattattttttttgtgtgtgtgtcgggggcggtggtggtaaaatatctgttctttgtgacctattttaatcagagatccttgcgaaggtttggaaaatctagtccctgcttgggatcccaatgtgattctaatagaaccagtttcctcggaaggtgacttttctgtataacctaagctggctgttgcctcagtttccctactcctgagaaagaggagtgcacattttccacctgattccatactgattctgtgagaacaagtaggagagttagaaatatttgtaggagaggctgggcatggtggctcacgcttgtaatcctagcacttttgggaggccaaggcaggcggatcacttgaggtcaggaatttgagaccagcctggccaatatggtgaaaccctgtctctactaaaaacacaaaaattagccagacaaggtggctggtgcctgtaatcccagctacttgggaggctgaggcatgagaattgcctgaaccatgggggtggaggttgcagtgagccaagatcacgccactgcactccagcctgggcatatatatatatatatatatatatatatatatatatatatatatatatatatatatatatatatatatatatatgagagtattcaatgaggagtgcaatagtcagaaatgcagaatgtttcttttctctatttttttgatacaagaatcaaaggttctgtgatatgggagtagttatattcttctgatatctataataagcttctgttactaggtgggagtcaaccatggtgaaagaacggtatcttaggagcctattttagtataaggcaatcatggatgcaagctctgcagagatctttctgttctttgctgtagtctaggccagaaagggagaagcatgattattaggaatgaggtttcttgggatggtattctaaaatactgatgctgttcaaggtgaacagatggctgtattaatgctaaaggagacacaacctaaagctagggtgagcatgtagtttattctccaaactgggacacttctgagaattatagacagtgctattaataattataccaagaccacaaacatgacacaggacagcctcaggcaaactgagctgtaagggtgacccttcctaaagcagttgtttcagagtttacctctgaagtttcaaaaagatgtgttttctttggaaggatttatcttttaggaatgtgcttttatgagagaaattggggctaacatttctgtcaaaaacacggaaaatgacttatgacatctaaaaggaatattgacattttatcctgtcagtgcggtttagtttttcaactatgttaccatctctgaaacacactgtgatccatgaagaatgaaaaccatggaactggaaatgctgttaatggttatgttgtttttctcccctccctttaaaagttgcatgcctggcaaattaatcctgctgaaagatattaggttgataaatacagatagatcaaagtgtcagacagcttgcaaattcattgttatttgagagggaaaatggcttttaaatatcgtaagattgtttggcatagtgggaaagtggaagatttacttcataccaaaaggtctgcaaactctggagacaaccagggagaggaacatctagtagcaaaagagcaggaaagccagcagccagccaagccccacaggtacgcagtgaaatggagggttgttagagggatcgtggtgacaaatgcttgtgttttggatttagagctaaaatgtgaggaagtgattcaccccatgaaaacttctctaaatgtactattttaagccatgttttaaaggtggattgtcatttttcatatttgtgaattagctagctggtggagtgaggcagagggggtaaatcttaatatatagtctgctgtttcaatgttctttagttacagttagagtgacatggcaagttgatcacttctcagagaacagaggtagaggtgaagtgatcattatttttgttaatatcttaaaatgcagtcaacagatcctaatatactttgaaatgaaagttttctgaggaaaacatgacgatctgggtgtctgtttatttgttttgtgatagggtctcaccgtgttacccaggcttagtgcagccttcatgtcctgggctcaagtgattctccttcctcagcctcctgagtagctgggactacaggcaggcacaaccatgcctggctaatttttctttttaaattttttgtagaaatggggtctcactgtgctgcccaggcagctctcgaactcttagacgcaagtgattctcctggccttggcctcccaaagtgctcgcattatgggtgtgagccactgtgcttggcctgttttttaaaattacagttactttgtagtagcatgggatagagaaacccctttaaggttttgtaaaaaataatttggtgataaactggtaaatatagtttgtttaatatgaaattgaaaattaagaaattatttggtaggtttttaaacaaaatattgttttacattttaaaaatgaaatcctggttactctttatctcctttgttcaaagaagttaaactatattttttcaaagatgaaagaagatgtaattggttgctaacatcttatttctattatgtctatttcaacttatgtcttttccttgaattaaatttagccgtgaagttactaggacatttgtagaaacctgcccaaatcggtgcatatcagttgagctccttgacatatttctctcacctgttggcctttttgaagggtgtagattgctttggtgccatgctggccttgatatcagagacttggatgttggtatagtctcatctggtaacctgtgtcatttcctcttcctaatacatcacttttcagtttggggagggacattttttctggttcatgcagcaaatgagagaaaataattaggtaattgtaaccacaaagaaaaattgaatgatcagcttattgtatgtagcatatcttaagaatgaatatgcttaaatgtcttctgggaataacaaaatctacccccacctttttttggctggaaattgtgaattaagaactcctcaagtgcttattgtaactattgtagagacacgaaaggatctattaaactgtcttgaattaactattttaaagtaaatgaaatgtgcattttgaggatagcatctattgctcgtctttgtaacggatcccttaaatgacattaaggtcaagatttgtatgtttatttgatggcaggtgggggtagattttgttattccaggagacatttaagaatattaattcttaagatctgctacatgcaataagctgatcactcaatttgtctttgtggttacagccacctaataattctttacggtgtgtagacagacatgaagattgtgattaaactgtgttaaattgaatggcgttgattatatttaaagcactggttggtctaattggaaaggtgtatagttatttaagtttgaaaaaaatctgtatcgaaataccatttattttgtcttattatttgtgttattttcatttaatagatttaaacttgacactttgaggcaagatcattttaaataggaatatttgtcacatgattggttacttaataacctaaatctattttcaagacaaacttaaagtctatttactacataatatagtgtgagatgacaaaatacagaaagtattaaatattaatttaaatgtaaatttatagaaagtgcaagtaatttaaagtaaaattaagtgcaaatgtccactaggtggcaccataagaactctaaatcttgttactggtatttttctaggccctttggtgttatgtatgttagaatatctcttgcatactcagcttgaagagattcttttttctgttatgtgcttatttacccaacttatttttattccctgcccccagttgaattttccttggtagtggagcttgacaaaaacaacaggtcattttttccccccaagatagccacaaatgagaatgtaccagtgtgtgtaaatgatacacatgacactgatgataaatattgactcttacaaattctagggctattgaggataatattggatattaggagtttaggggttgggtgggacaaataacagaaaattcatggtatgccatgggaatcattataaatgatacacttaaatgtcttatttcacaattacagagtttgaatttcagagaagtttagccatgtgccgaagatactccaggtatttgatagcactcacagaactatattttgaaatgaagagatttcattttatggaggggaggcggggagaagacatatttggtatagaaaactcagcatgagctacttgcatactggtaatgggcttgatgtcctggaggctagagaaagttatggagagtagcagagtataaagttcatttggcaaaaaatgaagccaagtgatggatctttattatgataagatagcagtattagggttgtaattaagattgctgtgttgttttctgggcttattttgttgttttaccaaatctgtacgaggtattctgaggctctttttgtacattttcaaggatgaagcataatagacatgacccaagaacgttataaaaatgtgaaacttcaaaggaaaggttcttttttgtaacaatagctattactaaatgatgaatagggaatcacatacaggaatcttaactagcattaagctttggatttaggtattcacttaaaatcatatttataagggcttctttcttaatggaaactggtatgtatgtcttctaccttagggtaacctttgttctactggctagataacttgctttgtgcatggcgcatgagtcattgctactaggaaaaatagaaattcctttttgttgactatggcaatatttgaacctcagggctcagtgaaagctatcagctaataataatgaggccatgtattttatatatagtcacccatgagagaccacctgttgttctaaaggaaaccgatctctttttacagatggtcttcaaatacagatttctgatagtttatagtataaagatttattctatggcaactcaacctgttcccctggggcctgtctttcagagatggtgtcctagacagatttcactatactgccctactctgagcagttcaaagcacagaggtaagggtaggtaggtgaactgggatgctaaataaacgcctatgtctgtagctgctttttaacaagtcacctggggccctctaatagccctgagacttgaatttctgtgatacgaacctggaggcagaacgctttcatagaacctttgactttttccccttgtatcacttccaaaaaaagcttaggtttttgccttgatggtgttggtgaaggatgcaccttttactcttgcgatggcccagagggcctctttaagtatggggttgacttcaggttggtttaacttttgacaaatagtctctgtattatgtcaaatgtcagtgattgccctgccttatccacaatgtccttcctacctagactgagaacctgtcacttgcttgttgctccctatatctttcttgttaactttctttctgggcttcagggagctagtttgcgtttcgtatgatatttatatatagttttgtatgaaataagttgaattgtagtgtgatttctaggagttgaacaagcactgtattaagcagatgtgttaagtatataatataaataaactaggcattgaatatttacatataatatgtttataaataagattcattgctgtggtggtgaaaggagtttttaaatgttatcttcctcgagctggccggagaatacgtcattgagaagaagggaatttagaaactgcttaaatatggaagagaaagatatcagtgagtactagaagatgattggttgcattgtgtggtcgaggagatatggtagggttaggcttttcaggcatggtaagatgcaacttcaagaggataattaaaggaataaggtgggcaaggaagaggtgtcaggggtttgcctgctttaaacagatctgcctttgtacttgtgtctaactccttttttaagtttggaattcttgacgctagctgctggttgatccatagaggtttatatttcacaaatgatgcctgtataactttcttttactcagataaattcccaatattggcccttgatgcatctcttttgatatctttcagatactgaacttaagggcttaccatacacaaagtatattattaaattctatattatagaattacctataatcttaccatacacagaaaatcactgttaatagtgtatgtttctagccttttttctgtgtgtgtttgtttttaaagtagaattaagtatacatactcatttgtagtttgttgtttttgcataatataagacactttagcattaaatattctataaaatgattttaatagctgtataatattttatcataaggagatatcataatctattattaggaatttgttattgccacatttttactaatttttgtgatggacagatggacattcttgtatgtagatcttttttgtacacctctgataggttttggtataaattgctgaatttctgggtgaaagaagcaattttgcgcttttgatatgcattggcaaattgtcctctaaaaaggttaaagtagatgtctttttatttctctttgcttcttctggtttggctatataaatttctcttttttatctgcttgtgtgtgtgtgtgtgtgtgtgtgtgtgtgtgtgtttgcttgcttttaaagatgccgaattaagaaattatttagaatttgaaaaggaatgctttgtatagaatgtttatttacttaatcttactatctttctctctaggtattttaatggtcttacttttttgatctaatctcatttaatcatgattctcattgctaataaaatatgatttgaaaggtaagaggaaatatgactatggtaccagttttttgtggtcaaaagccaagaaacagagtatacataactttgcccgcttgccctttggtgttattgttattgttaaaaggaaaaatggggcaaaacatgaaacagaacaatgtgatagatggtgtgaaggttatagtgacaagataccagagaacagacaaaagagatctctaatacagcatttcctttcttttgtgattagctatataaaccagaacttttttcaaccttatctatttgtttatcagtttcaatgggctagattatatattggcatcatttaaggaaataagtttacattgaaatacataaaatatttaaaatgacaagaaaaatctcataaaatttatatatatttcttaggatagtagataaataactgtagattgctataaaagattcttattatgaagtactgttactgtccgtatggctgaaatgtcagaggactgaaaagattttcactaggctcaatgaatctcatttgagattgtcggtttaatgaaatctgttgctttttgggaatagaatttgttcttttggggcattctaagaagttgaaaaaaagttgaaaatgaggatatatattgacagggtgccaaagcagcatctaaagctgattagaaatttgagcttagtggccagtaacatgtttttaccctaacttactttatttgatatgaagtaggcaatttgaatttaaaataggggttggcaaaactatgttctatgggctgaatctggcctgccacctgtttttgtatggcctgaaaactaagaatggtttttgcatttttaaatagttaaaaaaattaaaagaatatgattttgtggttttgtgatgggaaaattataaggaattcacacttcaatgtctgtaaataaagttttactggaacacagccatgcttattcatttatatattgtctatggctgcttttgcactacaatggcagtgttgagtggtgacagagaccacatatggcctgcaaagcctaaaatatttactttctggccctttatagaaaaagcttgctgatccctgatctagaattgtatagtctaatccacttttaattttgatttagtatataatcctgaggatatcattttctttttaatttttttttcctgagaaacttggcagataatgttcagtggtgaatgcagatctcagttatttccaaactagtttttatataactctgttgtcagtcttatttaatggtatagatcactggctctcaaatgtaatcttcagatctctgggtgtttctgagatattttcagggagttcataaagcaaaactgttttgataataatgccaggacattctttgtcttttcaccatattgacatttgccctgatgatgcaaaagccatggtaggtgaaactgctgtgcttgggcatgaatcaaggcagtgtcaccaaaccgtaacagtactcattgcacatacttataaaaccaatgctaatttttcctaagtagtagaaactgttacattttgttaaatcttaacccttgtcacttgtctttttaatatgctgtgtgaaaaaatgagaattatacataaagcactctgcatactgaactaccatggtcgtcttgaggaaaagcacttatgcagttgtttgagccattagctgaactagctgcttttttcatgggacaccattttgcttgaaagaacaattaacaaactgtcattattcagacttgtgtatttggcactttttttcttgaaagggagtgaagtaagctgacacttcaaggaaaacaactgatattatttgttgccaatcataaaattggagttttcaattcaaaattaggattttcagataacctctgtctgccactttgggtttgacagtttcccaatacttagttttctgatgagattggtagataatgaaatgttgacatatgattttttgggataatgaaatgtgctgtcaacatttcgaagatctttataactaagggaaccagtattttcaggatgaccaatgtgtgatgttataaattcatgcacagataaaagatccattcagtgtgcaagacagaccaatggatttgaatgtaacagaaacagaaatttcattcataggattttatattccacattacaactaagctttaaaaacctatcacttgttgagttttggtgtagtatcaaagaacaatattcataattatttgaaaaggctaatacttgtttctttttcagttacattatctatgtgacatttccttcatatctttcatccaaaacaacatatgacaacagattgtgagcagaatcagatatgagattctagctatctgctgttaatccagacattaacaaaaatgtaaaacaatgtaaaacagtgcaaaaatgtaaaacaatgccacttctttcactaactttttttgttttggaaaatatagttatttttcataaaaattatgttaacatgtaatggggctttaatgctttattttatacatttctagacttcttttgtaaatatcaatattggtatttaataaatattcacagatacaattcacatgaacaaaagctttttagagtccacaatcattttgaagaatataaaaggctgtcctgggagcagaaagtctgatatgtattgtggatcgtgctcatttaccatgatgtcagttatatgaactaggagaaggaattttcactgctaaataattcagtagcacctattacctcttttttgtctgaaaactaaggtggaaatatacctttccagaagcttgtagaagaggctgagatgaaaatgtctaaaaattcagtttttaaaaaatgctaaatagcatacattttccagttacggatggttacctaaaagcacacttctgaggacgcattgtgtagttgttatatagttacaggttgagtatccctaatctgaaaatctgaaatctgaaacacttctgtcccgagcatttcagatgaaggatattcaacctgtttatgtaattgttataaaagttataatataatgatagtctattatgctttatatgcattaactctattcctcatttaaagacttgcataataagtaatactattaagtaacctgctgttggtcacacagtaagttttaagagctggcgctgggcttggtggctcatgccatctaagctactcgggaggctgaagtgggaggattgcttgagcccacgagttggagtgcagctgggcaacatggcaagatgctgttctcaaaaacaaaaacaaaacaaaaaaaagagagctgagattcaagtgctttttcctttattaaaatgctattatttatagcaactatgtgtacaggcaacagctttctgtaaatagcttacaggatcttgtggtaaaggctctttttggcaaccaaactagataaagatttgtcttcaattttagtttgatgattaaggcaagaagttgtcttccagagttacagagagacagtaaaatgaatggactaagcctaaacaaattgctagacactgacttccatcagtaaattacagccttccaaattgacttggataatatgaaaaatgaataattagcatgatttgtattcgtttggctgattctcaatttaatatctgtttactattgtgatcatatttctaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggtatggttttatgtatattatgttttggcatgctcttttgttggtatgtgggaaaaaaaagtacatacatatatcttctgtatagtcttatggaaataatactgaaaatgagaaattactgaagcttaaaagacctatatatggatatatactttaagttccttgagatgttagacattatcggaggtacttaaccctctacttttaatcaattaatccacaaaaacaggatttaaaaaaaagtcagcatgtcttgaagtctcttgtatgaataataatctttcttttctgatttgaaaaggcagtgttttaccggccttcatctctctcaggagtaattcacagagattcttgatgacctgaagagacaaaatgaaatggatttttaaactaagagcataaaagattcttgggtttgccgactattctgttctttgtagttgtagtaaattctcatttaattaatggaggtgatgtgggacatgtagagctgactgtaactgaatgtctgtatatagaacttacttttttgaagtatcagctattgttttaacccttaaatttttccttataaaagcagaatgaagcattctgcatttagttgcatgactttttggatgcagtaatcaaagattgatattgacattcttccagtggtttcatttacagaagatcatcattttcattgttctgtggtcttgggtttgtcggtaccattcagattaccagtctcctgtattactaacactttttactacagtacttctcactatgcctagtatcctgtagtccagaagccttttgttatttctggagtataaactttcagttttataaaatggtgtacctgtctgtatatggagggtcctaactgcttcttaaccaggattttgaccatttctcttgtttttaggtttcactcccatttcctaatgccaccaattcctgaatttttggagagttttaccatgccatgtaaatcaggcaactttcttgattcccttttagtaacttctcatccatctacctttttttttttaaattatattccatggcagcttttatattctaaaattttgttgctgttaccttctcagtttctttattcttgtggggttttgtcttaaagaaatttttgactgccatgttaatagagtttctggagggagaatagctaaagaaatgtgttcagtttgccatcttcaactgggaattcagatttcacaattgatacttaatttcggtgggcctgaggatcaaacagcgattaatgttttgtgtgtatagcaataagaggagatggagtcttgtttcttttttcattagttattgtcttactaaagttgcttatataaccatttggaacctgttaacacagtttcaaataattgattctaaattcatttctcattaattttgtcatcttgatatgattaatattagctatcacttttaaggtttctaattgatacctaattttgaagttacttgttttcttgctttgatggaaagatcattttcaccctaattttatttttcaaatggttttataatgttaggttttttttttttgagatagagtttcattctgtcacccaggctggagggcagtggtatgatctcagctcgctgcaacctttgcctccggggttcaagtgattctcctgcctcagcctccctagtagctgggactataggtgtgtgccaccatgccgaactaatttttgtatttttagcagaaacggggtttcaccatgtttgccaggctggtctcgaactactgacctcaggtgatctgtctgccttggcctcccacagtgctgggattacaggcgtgagccactgcaccaggccatctgttgggttttttgtttgctagtggagcattctggtcttaaatatctattcatttttattctttgccttaactctcattttgggttgggagtttaaaatgggtatgagttataaaaaaatctgctctgacattttttccatttgttttcagagaattatgtgctaaaacatcactggtgtttaattgacacaaataaaacacatcagtgtggtcagtgtgacattttttaagttatttgcatttaatcttagaacatttcataatgttaccacttgatggcaccagaaaaataaaaatctgtgcttcaaaatgagaattatagatgcatgtcagaaaataacaaataatgtgtcatttggttagttactttgctgattatggtggtgaattatttctccactagaacttgataccaaacctactagactgctatcttaaggaacattaccatttaaccatgtatctcctatttaatgcatgtttgtctttttgaaagcacaatatccattcctgctctggattggtttctgttattaatatgccacaattccagaagttaataactgactaaattgattttagtcttttattgtttattcataatgtgatcaatttttattcagacaaactatgggaaccacaatcatagaattctaatttttaaccagtatataaaagaacctttgtttcagtcctcctggttacacatttgaccctgtgtcaaatgtaagatcaggacagtgcttccagtccatggattctgtactagcatactagtcaccacctaacagacatatggacattgtccttcaatttctggggaaactgggggctctagttatgagcttgatttgacctttattttcagaagagatgtttccttgggtaaagtttgttctggggtaacaaaactgttagtgaaatatctctatagccagtaaaacgtatgaatcatttaaattgaactcttcataacatttgttcttgtgacctttattggcatggattggcatgccttataataaaataagtatttctggatatctgataatacagagaaaataatctttcagagctaagtaatgctttatacaaagattcttgtgggttggcaaattttgttattttgttactaaactattcatcctaaagaagtttatctgggttgttagtaggtctgataaagatggcttgatgtttttcttatttaactggtatttgcacagctgagaccacatgcaaaacacaatagcaacagctctctttgcccatccggcagagaataagtataccctgatagtggtaactttgaattctctttgaacctgacacttcacttactccctcttagaaatggttcttggaatgaaaggactgtctactcttctaaattctcaggtctttatggatttaagagagaaaatccaaaagtcagagttgaaggaatcaacttgaatttttgaaaaggatgttgcaatatatatatcacactttcctgtccatcttgtttatatattactgaaagtggcggatatgattaatctatgtgtgggcttattggagtggttgtggtaatatagagtggtaaatggattacataaaggtatcaataaaatgtttaagtaatttattacatgcctgtcactgtacaaggtatttttcttacattatttttaatcttcaaaggaaccctataagttgaactatgactggccatactggactttgtctaaggacaccaaaatttagagggtgcaaacatttaatataatgattctaaaagcttggcacctagttagcaagaataattatttaaaacaggaagctaccagatggcgagcattgttagtaacacccatctgtgggctacatcatgaattacagagtcgatttgagagctggttttgtgtagtttgttccaggtgccaaaagtactggtttgatgtctttgtaaggtagatattgtgatccctgttttataggtggagaaaactaagacttacataaattaagcaatttgctcaaggacacaaactagtgaaagttgagctacgattttaatctaggtctttctgagcctaaatcatattttcttcgtattgtgctatgctacttctcacatgttcctcctaattagattagcattttaagatggagaagtgggaaatcctctccattgtagaatatttgaaaactttcttattttgagtatttgtcatttttccttctatccatttgtttgttttcactcagccatctattcatctagttgatctttcaacaagcatttatttcttgtatgtagcaggccctgtaatagggaatataaaatggttattttctaaaaatatagaatcaaattgagtgacggcccttcaagatgagatgtttctgtcaacttaatagcatgctaatatgacccatgattttgtagtgtatatcttgttgaaaatatctggtagatttgctgccatagttatacccgttgcttttcacttaacttgatgttgatgccacacttaaaaaataccccattatttccccctgcccttctcactctttttcttttcttcctctctcattttcttccttctcctctccttcccttttacctcctttcctctcctcttctcttctcttgcatacattatgagtgacatttcataatgtatttctggatattgttgatatccaatttttctttgaagattttgttgatatttttgaccagtgagactatttttaatgttagtactcagattaagagatgcaaacattttcattctggtaaatggtataataagcagtaccaaaccattttttatagtttattcttgggtagatatgtgctaggctatcagggatgtccagacgtatttcagacaccatgaccttgtatggagcttggaccattgatttattccatgaataagagttactcaaatatttagaaacccaaaggataaagtttttggctttggaaatagatagataatatgaaaaacgtagtaagtttaggtttgataaagggaagcaagtcatgtgattttggtatttagggaatcttagaaccaatcccctgtggatactgaagggcaactgtataagattataattctgagaatagaggtagttttccttcttccttttcaatttggatggcttttatttctgtttctcacctaatgctctggctagaacttccagtacaatgtacaagaacattgggaaagcagacattcttgtcttgttcctgatatctcagggggaaagatttcagtcttaccgtggaatatgatgttagttgttggtttttcatagacgccctttatcatgttgaagaagttctattctattcctagttttttgtatgttctcttgcaggggtgttggattctgacaaatgctttttctgcatcacttgaaacaattgtgctttttttcttctttgttctattaatgtggtatattacattgcttttcttatattgaaccactctggaattcctaggataaatcccacttgccacagagatttttatcttaagtttgaacccagttgtgccttttggtatctcttgtgtattttgtttatcattgtaatatggttggaaaagagggactgcttattgaggtatgagccttctatccgtctctgtctggaagttgagatcttatttttcaatagggaggagtattaaacaaatacagaatatttcttattttattttattttttccttcagttgtgacctgtgacctgaatgtcatgaaaattttccacagctttttctgttttaaaataaaatgtgtacttttcactatgatttaataaattgccttagttgagaatttttcagatcttaactgttttgaaactggctagaaggaagcattttaaaacagtctaattaagatttttaaaaatagagatttgaaatgatttaaatatgccacttagtcttctgtcttccctcctcatcagcattctgttttttcctttctttagttgatccaggaagtgtctgccaataggagtcagcagttactaatgcagtgaactcagaaggaactatttcataggttcagagagaagacttacagattctctgttctcaatattcacaaatgaaaagagagttgctttttaaattatcctatactcaggtaattctctttcaggttttgtgttaagactagattttcagctccaggtagcaaaatcgtaaccaactcaaagaggctcacatagaaaacattgttttagtccatctgaaaaagagtgttttattccacttaaatgattacatatagctcaattcaggtgttcaagaaatgccaacaggtctctgtctttttatttgcctgtctctgttcacaccctgtatttgctatcccctttctcttatttgattttatcttcatggcatgaaaggtaacccctgactagctccaggtttacaaagactttgtcctcaggatcctggaggaagagggtattttccctcatagctccaataaaagcctcagggaggattggcctggcatgcgtcacatagctttcacctctgtctttgtaacctgattaggcataggttatttggtcatccctgggaaggtggacagagctatccctgatgcactgcatgaactgaacggcataaccatggaatgtggaaggagtggatcaaaatgaggaagggatgttaggcagaaacaaaaaaaaaacacattgaaatgttatcttctgcttatctgtcatggcccaacagtgccgtttattatcctttctcccctggccttaaaaaacaaaaatgattgttttggttgttcatgtgtgttctcttacatgtttcttagatgataattctctagagaaccggcatggtatctactttttttaaacttttaacggaagtatattatatatacagaaaagtaaatatcataatcatatagctgaatgtattttcacacatgggacactcccatgtgactggcatccagatcaaggagcagaatttggccagcaccatagaagcttcttcatctcccctcttcaaaggaaattattattctgatctttaacagtgttgagtgcaagaggtctgctttttcttttaagaaatattttggagaaggagtcttgctatgttgcccagactgtcttgaactggtctcaggcagtcctcctgcctcagcctcccaaaaagccaggacttcagtgtgagccatggcacctggctcaggtctgcttttttctattcccattccttacaagggcagggttccagttttgagagcctgctttctgttgtttccaccctcttctctgcaatttccattatggatgatgatggggaatgggttggggtcttgtttctcttttatttctgtaggatcctgacctttctctcattttcttctttccctttggcctttcactgccacaccttgaaggggtatcactcattttctatatatctgattcttccccagtaggaaggctttaccaaggctctcactttttattttcttcactttcgagcctataaagcctgttttttttatttttaaattttatttatatttatatatttttttgagatggagtttcactcttgttgcctaggctggagtgcaatggcgcaatctcggctcaccacaacctctgcctcccaggttcaagggattctcctgcctcaacctcccgagtagctgagattacaggcatgtgccaccacgcctggctaattttgtatttttaggagaaacggtgtttctccatgttggtcaggctggtctcaaactcctgtcctcaggtgatctgcccaccttggcctcccaaagcgccaggattagaggcgtgagccaccgtgccttgccaaagcctgtcctttaactatcagatgccaacctgtgtttggcatttagttgggcttcctttttctgttttgtttgtttgttcgtttgttttttcctgtgctttggtttaagtccagtttgctctctctctctctctctctctctctatatatatatatatatatatatttttttttttttttttttttttttttccttccccccacccccaccaagggatctcttaagcttttcttcctctggtcaccacatccattggcttacaatagggggccctgggagtgctgttgtagtttggttggtttttctatttacagataatccaaaggtcatggtatctttgtttcctagtggtgctgaaaatgtgagccatatgtggatttatttgtgctcttgattttttgtttgtttcttgagaggttatgtggagacatttgaaatttggtggccattgttgtcctctaggcccaagagttcacacagattgatttcagaatgttcaacaacttttgtatgcctaaaataaactttacttggttgtgatatggattatcctttttatatatcattggatttaattgctaatatttattcatttatgtacaggcttaccttgttttgttgtactttatagcactttgcagatttttttttttaaaaccaaatagaagttttgtggcaacactgtattgagcaagtcttttggggccattttcttttttttcttcacaactttcattttaggttcaaggggtatatgtgcaggttcgttacataggtaaattgtgtgtcacaggagttggtgtgcagataattttgtcacccaggtaatcggtgtaatatttggtaggtagttttccagtcctcaccctcctcccaccctttaccctcaaagaggcctcagtgtctattgttcccttctgtgtccatgtgtactgaatgtttaacttccacttataagtgagaacatgcagtgtttggttttctgctcctatattaatttacttagattatggccttcagttccatcttttgttgctgcaaaggccatgatctcatttttttaaatagctgcttagtattctgtagtatatctgtaccatattttctttatccagttcaccgttgatgggcatctagcttgattccgtgtctttgttattgtaaatagtgttgtgataaacatgtgtgcatgtgtctttatggtagaataatttgtatctttgagcatatacccagtaatggagttgttggattgaatggtagttctattttcagttctttgaggaatctccagactgctttccacagtggctgaactaaattacattcccaccagcagtatataagcattccattttttctgcgatgtcactggcatgtgttattttttgactttgtaataacagccattctgactggtatgagatgctgtctcattgtggttttgatttgcatttctctactgattagttatattgagcatgttttcatatgtttgttggctgctagtatgtcttcttttgagaagtgcctgttcatgtccctgcccattttttaatggggttgttttttacttgttgatttgagttccttatagattctgaatattagacctttgtcagatacatagtttgcaaatattttatcctgttctatgggttgtctgtttattctgttgatagtttgttttgctatgcagaaactctttagtttaattaggcccagttgtcagtgtttttgttgcaaatttttttggagtctttgtcatgaagtctttgcctgggctgatgtgtggaatggtatttcctaggttttcttttagggtctttatagtcttaggttttacttttaagtctttaatccatctttagttgatttttatatatggtaaaaagtaggagtccatttccaatcttttgcatatggtagccagttatcccagcaccattttttgaataggccatcctttccccattgcttgctattgttggctttgtcaaagatcagatagttataggtgttctgggttccataacctagaaataaagaagggtttcattggtctgtgtgtctgtttttgtaccagtaccatgctgtttttgttactatagccttgtagtatatttgaagttgggtagtgtgatgcctccaggtttgttctttttgcttatgattgctttggctattcaggctcttttcttattccaaatgaattttagaattttttttcttattctgtgaaaaaatgtcattaatagtttgataggaatagcattgaatctgtaaatagctttggggagtatggtaattttaataatactgactcttttatccatgagcatggaatgcttttctatttgtttgtgtcatatctgattcctttcagcagtgttttataattctcattgtagagatcgtttacctccctggttagctgtattcctaggtattttattatttttgtggctgttgtgaatgggactgcattcttgatttggctctcagcttagacgtgattgatgtatagaaatgctactaatttttgtgcattgatttttgtattctgaaactttgctgaagttgttcataagatctgggagcctttgagcagagactgtggggttttctaggtatagtatcttgcgaagaaagatgatttgacttcctctcttcttatttggatgctttttatttctttgtcttgcctgattgttctggctgggacttccagtactgtgttgaataggaggggtgagagatggcatctttgtcttgttctggttctcaaggggaatgcttccagcatttgtccattctgtatgatgttggctgtgggtttgtcatggatgactcttattattttgaggtatgcaccttcgatgagtagttcattgaggatttttaacacaaagcgatgttgaattttatcgacagccttttctgtgtctattgagctgatcatgtagttttcatttttagttctatttatgtggtgatcacatttattgatttgcatctgttgaaccaaccttacatcccagaaataaatcctacttgagcatggtagattagctttttgatgtgctgctggattccttttgctagtattttattgaggatttctgcatcttacattcatcaaggatagtggtttgaaatgttttggtatcagaattatgcaggcctcatagaatgagggaggaatcccttgattttttttttttttttgaatagtttcagtaggattggtacctcctcattttttttttcttttttttttgaaacagagtttcactcattgcccaggtgggagtgcaatggcgtgatcttggctcactgcaacctccccctcccgggttcaagtgattctcttgcctcaacctcccaagtagctgggattacaggcgcccatcaccatgcctggctaatttttgtatttttagtagagacggggtttcatcatgttggccaggctggactcaaactcctgacctcaggtgatctgtccgccttagcctcccaaagtgttgggattacaggcatgagccaccatgcttggccatcccctcttttttatacatgtgacagaatttggctatgaattcattttgtccagggccttctgtttggtaggtttttaattactgattcagttttgcaacttattattgatctgttcagatactcagtttcttcctggttcagtcttgggaggtggtatgtttccaggagtttacccatttcttctaggttttctaagtttgtgtgcatagaggtgttggtaatagtctctgaaggtttttttatttttattttttgaatttttgtggggtcagtagtaatgtccttttggtcatttctgattgtgtttatttggatattttccctttttttcttttttagtctagctagaagtctgaatcttatttgttctttcaaagaaccaacttaaaaaagtcgtttgtatggtttttctcatctccatttcattcagttctgctctgattttggttatttcttttcttttgctacctttgggattggttagctcttgtttttcaggtttctctaggtgtgacattaggctgctaatttgagatctgactttttaatgtggatgtttagcactgttaactttactcttaacactgctttagctatgtcccagaaattctagtatgtcgtatctttttttttttcttttttcattagttttgttgggtggagtgttctgtagatgtctgttaggtctatttagtcaaacgttgagttttggttgtgattatatttgctgatattctgcctcaattatctgtctagttctgtcagtggaatgttgaagtgtctcagtattactgtgtgattatctaagtctctttataggtctctatgaacttgtttcgagaatctgggtgctccattgttgggtgcatatatatttaggatagtcaagttttcttgttgaatcgaaccctttatcattatgtaatgcctttccttgtcctttttgatcattgttgatttaaaatcagttttttttctggaatgagaatgggaaccctgctcttttttgttttccatttgcttgacagatctttcttcattcctttactttgagcctgtgggtgttactgcatgtgacatgggtctcttgaagataggatatagttgggtcttgctgtttatccaacttgccactctgtgccttttaattggggcatttaatctgtttatgttcttctggttaagaaccattactggggagctagtacggtcttttggatgtaaggagacactctggctcctagagttgccagagttcttgcactggttctttctcatctgtgtgggctgatcttcctttaactgtggtgtaatttgagtatagtcaattggctttatttctggatgttttcaggtggatgaaagtttgtaaagggtctttgcttgtggctgatttcttggcattggtttcacagggttgcaaagtatttttgatgttgaagtttgggctgccatccggtagatggcgattaagcaaccactaccctgatcagtcggcagccagcaacataaaagcagtattccctctaacagcaaaaagattgcgacttactgaaggctcggatgatcgttgtcattttttagcaatatttttaaattaaggtatgtacattgtttttaaagacataatgctattgcactcgtagtacactatgaatggtgtaaacgtaattattatatgcaccgggaaacagaatgtgtgacttgctttatcatcaaattcacttttttgcagtggtctggatcagaacctacaatatctccaaagatatgcctgtatatatatttttatttttcttagattaggtatatttagcaaatttaaaagtaaattagagacatcgtggcctttactaccgttgtgtagtttatatctctagaatatagggtcattcttcttcatatccacaatatatttatcatccttaacatattctatgggaaggattttaatagtagattcaatttctttagtagatattcaactgttttgtatatttcttctttcgtgaaactcagcaagttctatttttcaagaaatttgtctgtttcacataaaaggtgaaatttaattgtagaagtgtttatagtgtctcctaatcttttggatgtctgttgggtttttctggattttggttatttgttatgtatttttttttcttattcactcatgttagcattttatcagtttttttaatgttcaaaagaattaacttttaacttttattttgctgttctgtgttttctattttatagatttgtattcctttctcattctacttacatgaagtctgaatattctttttatttttgagttagaagattacatctttgagtttcagcctttttttaatatacatttaggattattaaattttccataaagtatttgtttagctacctcctatagattttgatatgtcaaaccttagttattatcagttcaaaatatttttcatgttttgttttcgtttttaaatctcattttattagttttctattggtgctttaactacttaacataaacttaatgattttcaaaacaaatttttaattttattgttttgtaggttagaaatctgacgtgaaccacactgggcaaaaatcaaggtgtgagcagcacctttttttttttttttttcctggaaactgcacataaaaataactgttttcttgtcttttctagcttctggtggccacctgcatgcctttgcttatggtcccctttgtccatctcaaagccagcagttttgcatcgctctgaccattctttcatagttacatttcacagtgatcctcagccaggaaaggttatctggttttaaggagctatatgattggattgggctcatgtgaataatctaggataattgccctatatcaaaacccttaaccttaatcacatttgtaaagtttctttagccacgtaaaataacatagacacaggttctgggcttagggcatgaacatcttcaagagtcccatcattattctgcctcctgtacctgtgaattacttagaagtatgtcataaatagcataagcatattgtttaattttctggcagttggagttctttagttttttattttttagagacagggtcttgccttgttgctcaggctggagtacagtggcacaatcatagctcactgcagcatcaaactcctgaactcaagtgatcctcccaccttagccttcagagtagctgggattatagctgtgaaaaaattcatagaaatgggaatcttactatgttgcctaggctggtcttgaactcccgtcctcaagaagtactccagccccagcctcccacagtgctgggattataggtgtgagccactgcacctggccccctttcttgacctttctaagtctactttaccagcttgttcttccccacttgatctttaaatgctgaaattcatcgtgacttggttatcaaccttcttaggctctttaccctattctccttaggtgatttcaggattacatactttaataactgtctacaacagcagtgtacaatagcaatatcatatcaacacatatgtaatcctgaattttctagtagtcacattaaaaaaaaagattcagggccagtgcagaggttcacgcctgtaatcccagaattttgggaggctgaggcaggcggatcacgaggtcaggagatcgagaccatcctggccaacatggtgaaaacccatctctactaaaaatacaaaaattagctgggcatggtggtgggtgcctgtaatcccacctactcaggagactgaggcaggagaatcacttgaacctgggaggcagaggttgcagtgagctgagatcgcgccactgcgctccagcctgggtgacagagcaagactcccatctaaaaaaaaagatttatactgctgaccaagataggtaacagtctttcctgaagcaactaaaaataccagacaatatatttaacaatgattttcgagacactgggcatcaggtaatgaaagacagtgatttctgagaggaaacaaatgaagttaggctcatgattgtcccagattgctgtcttgaatttctaggttgtggtgcagggagaaggaagccatttggatcctggcagaacgttctctctgagttaagaagatgaagttgagaggctaggaagaatgaagttagagtttgtagttagagcttgcaggatacgatatttagaattattgcctgatgtccagtgtgttgtctagaggagagataatggtacagagattggtagtgtctcctggaatatacacagagtactcattagtgtatgctgtggggaaactactcgagaccaaaaaagatatcccaaaaggattacgagacacaattctggttgctcacacagagctgggaatagtgtcttcctaagaagtagtctcagaaacctcaatcatgtggcattaggtagaatacatagaaggagtaatagtactgtggaataataattaggcccactcccacaagtcttttaaaaaatacataatttttatttttttcaattttttggtaggtacatagtaggtgtatatatttatggggtgcatgagatgttttgatacaggcatgcaatgtcagataagtacatcatggagaatggggtatccatccccttaagcatttatcctttgagttatgaacaatccaattacacgctatgtttttaaaaaatgtacaattaagttattattgactatagtcaccctgttgtactatcaaataggtcttattcattcattctgtttttttttttttttttttttttttttggtatatgttaatcatcccacctccctgtaacccccccactacccttcccagactctggtaacccattcttttactctctgtgctcatgaattcatttttttttttttttaatatttagatcccacaaataagtgagaacatgcaatgtttgtctttctgtgcttggattatttcacttaacacaataattttcagttccatccatggcgtcgcaaatgacaggatctcattctttttcatggctcaatagtaccctgttgtgtatatgtaccattttttctctatctgttcatctgttaatggacacttaggttgcttccaaatcttggctattgtaaatagtgctgcagtaaatatgggagtgcagatatctctttgatacactgatttcctttctttggagtgtatgcgtagcagtgggattgcaatttttttttttttttttgagacagagtcttgctttgtcgcccaggcaggagtgcagtggcacgatcttggctcactgcaacctccacctcctgggttcaaacagttctcctgctcatcctcctgagtagctggggttgattacaggcgcccgccaccatgcccgggtaattttttgtatttttagtagagacggggtttctctgtgtcagccaggatggtctcgatctcctgaccttgtgatctgcccacgtcggcctcccaaagtgctgggattacaggtgtgagccactgtgcccggccgtgggattgcaatttttattttttttgaggaacctccaaactgttgaactatgtacaacatagtgcttgtactaatttacgttcccaccaacagtgtaccagggttcccttttcttcacatcctcaccagtatttgttattgcccgtcttttggatataagccattttaactgggcggggataatatctcattgtagttttgatttgcatttctctgatgatcagtgatgttgagcaccttttcttatgtttgtttgccatgtgtatgtcttttgagaaatgtctgttcatatcttatgcccgttttttgattggattattagattttttccctatagagttgtttgagcatcttatatattctattaatcccttgtgagatgggtagtttgtaaatatttcctcccattctatgggctgtctcttcacttttttgattgtatcatttgctgtgcagaagctttttaacttgatgtgatgccatttgtccattttttgctttgattgctggtgcttgtggggtataactcaaaaaatcttttcccaaaccaatatcctggagattttccccaatgttttgttgtagtggttttatagtttgagttcttagactttaagtctttaatccattttgatttgatttttgtgtatggcaagagataggggtgtaatttcattcttctgcatatgggtattcagttttcccagtaccatttattgaagaaactgtcttttcttcagtgtatgttcttggcacctttgtcgaaaatgagttcactgtaggtgtgtggatttctttctgagttctctattctgttccactcatctatgtgtctgttttgatgctggtagcttgctgttttggttacaatggctctgtagcataatttgaagtcaggttatgtgattcctccagttttcttctttttgcttaggatcactttggctattctggatcttttgtggttccatataaattttagtgttgtttttctatttctgtgaagaacgtcattgatattttgatcaggattccattggatctgtagattgctgtgggtcatatggacattttaacaatattgattctaccaatccatgaacatggaatatttttccatattttgatgtcctcttcagttttttttcatcagtgttttatagttttcattgtagagctctttcacttttttggttaagttaattcttagatattcagttttatttgtgactgttgtaaatgggattactttttaaatttctttctcagattgttcactgttggcatatagaaatgctactgatttttgtacattgattttgcatcctgcaactttactgaatttgttagcagttctaataattttcttgtctctttaagtttttccaaatacacggtcatatcatctgcaaacaaggataatttgacttcttcctttccagtttagatgccctttatatctttctgttgtctgattgcttctagtactgtgttgaataacagtggtaaaagtgggcatccttgtcatgttcctgatctaagaggaaaggcttcagtttttctgcattcagtatactatctttgggtctgtcatatatggcttttattaggttgaggtgtgttccttatatatccagtttttgaggggtttttatcatgaagggacattgaattttatcaaatgctttttcagcatccgttgaaataattatttggtttttatctttcattctgttgatatgaggtttcacattgattgatttgcatatgttgagccatctttgcatctcaaggggtaaatccccctggtcatgatgtgtgatctttacaatgtattgttgaattcagtttgttagtattttgttgaggatttttgcatcaatatttatcagagatattggtctatggttttcttttttttggatgtgtctttgtctggttttgatatcagggtaatactggcctcatagaacgagtttataagtattccctcctctatttttcagaatagtttgagtaggattggtatcatttcttccttaaatttttggtagtattcagcaatgaagccatcagtcctgggcttttctttacttagagattttttactatggcttcaatctcattatctgttattggtctgttcaggttctgtgttttttcctggttcagtcttggtaggttgtatataagtaggaacttgtccatttcttctagactttccaatttattgacatatagttgcacatattagctactaatgatcctttgaatttctgcagtaacagttataaagtctgtttttacatttctgattttatttatttgtatattctttttttttcttagtttggctaaaggtttgtcaattttgcttacgttttcaaaaatccaactttttgtttcactcatcatctgtattatttcatttcagttcattcattgctactctgatctttattatttttttctactcattttgggttcggtttgctcttgcttttctagttgtgtaagatgctcatttgaagtttttcctcttttttgatgtaggcacttgtagttctaaacttccctctcagtattgcttttgccgtatcccataggttttgggatgttgtgtttccattatgatttgttttaagaaattttcagttctttacttcttcatttactcactggtcattcaggaacatattgtttaatttccgtgtatttctgtagtttccaaaattcctgttgtcattaatttccagttttgttccattgtggtcagagaaggtccttgaaacaatttcaatttttgttgaatgttttaaaacttgttttgtgacctgacatatggtctgtccttggaaatgatcaatgtagtgaggcaaagaatgtggattttgcagcccttggatgaaatgtcctgtaaatatctattagatccatttggtctgtagtgtagattaagcctgatgtttctttgttgctttttctgtctggaagatctgtccaatgcagaaagtggggtgaagtctccagctattattagattggggcctatctctcttgttagcactaataatatttgccttataatatatgggtaccccagggttaggtgcaaatatatttaaaattgttatatcctctcactgaattgacccctttatcattatatagtgaccttgtttgtctcttcttatagtttctgttttgaaatctattttgtctgatacaaatatatcagaaaaaatattttttagtttccattggtgtggaatatctttttctatccctttattttcagtctgtttgtgtctttataggtgaagtgtgtttcttgtaggcaacagactaatgggtcttgttttttcatccattcagccagtctatgtcttgattgtagtttagtccatttgcattcaatgttattatttataagtaaggacttacaccattttgttattttttttctggtggtttagtggtctttcttctttctttccttcctgtcttcctctagtgaaggtgataggatttagtttcttgctttttatttttttgtatgtacattatatgttatttatttatttatttatttatttatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcacgctgccttcaagcatctgtttaacaaagcacatcttgcaccgcccttaatccattcaaccctgagtggacacagcacatgtttcagagagcacagggttggaggtaaggtcacagatcaacaggatcccaaggcagaagaatttttcttagtacagaacaaaatgaaaagtctcccatgtctacttctttctacacagacacggcaaccatccgatttctcaatcttttccccacctttcctgcctttctattccacaaagccgccattgtcatcctggcccgttctcaatgagccgttgggcacacctcccagacggggtggtggccgggcagaggggctcctcacttcccagtaggggtggccgggcagaggcgcccctcacctcctgggcggggcagctggccgggcaggggggctgacccccccacctccctcccggatggggcggctggccgggcagggggctgaccccccccacctccctcccggacggggcagctggccgggcagaggggctcctcacttcccagtaggggcggccgggcagaggcgcccctcacctcccggatgggggggctggctgggcggggggctgacccccccacctccctcccggatggggcggctggccgggcggggggctgacccccccacctccctcccggatggggcggctggccaggcggggggctgacccccccacctccctcccggacggggcggctggccgggcagaggggctcctcacttcccagtaggggcggccgggcagaggcgcccctcacctcccggacggggcggctggccgggcggggggctaacccccccacctccctcccggacggggcggctggccgggcagaggggctcctcgcttcccagtaggggcggccgggcagaggcgcccctcacctcccggatggggcggctggccgggcggggggctgacccccccacctccctcccggacggggcggctggacgggcagaggggctcctcgcttcccagtaggggcggctgggcagaggcgcccctcacctcccggatggggcggctggccgggcggggggctgacccccccacctccatcccagacggggcggctggctgggcagaggggctcctcacttcccagtaggggcggccgggcagacgcgcccctcacctcccggacggggcggctggccgggcggggggctgacccccccacccatctccctcccggacgaggcggctggcctggcggggggctgaccccccccacctccctcccggacggggcagctggccgggcgaggggctgacccccccacctccctcccggacggggcggctggccgggcggggggctgatcccccaacctccctccaagacggggcggctggccgggcggggggctgacccccccacctccctcccggatggggcggctggccgggcagaggggctcctcacttcccagtaggggtggccgggcagaggcgcccctcacctcccggacggggcagctggccgggcggggggctaacccccccacctccctcccggacggggcggctggctgggcagaggggctcctcacttcccagtaggggcggccgggcagaggcgcccctcacctcctggacggggcagctggccgggcggggggctgaccccccacctccctcctggacggggcggctggccgggcggggggctgatgcccccacctccctcccggacggggcggctggcctggcggggggctgatccccctacctccctcccggatggggcggctggccgggcagggggctgaccccccccacctccctcccggacggggcggctgatggggcggggggctgacccccccacctccctcccggacggggtggctgccgggcggagacgctcctcacttcccagacggggcggctgccgggcggaggggctcctcacttcccagacggggtggctgccgggcggaggggctcctcacttctcagacggggcggccgggtagagatgctcctcacctcccagacggggttgccgccgggcagaggtgctcctcacatcccagacggggcggcggggcagaggcgctccccacatctcagacgatgggcggccgggcagagacgctcctcacttcctagatgtgatggcggccgggcagaggtgctcctcacttcctaggtgggatggcggccgggcggagacgctcctcactttccagactgggcagccaggcagaggggctcctcacatcccagatgatgggccgccaggcagagatgctcctcacttcccagacggggtggcggccgggcagaggctgcaatgtcggcactttgggaggccaaggcaggcggctgggaggtggaggttgtagcgagccgagatcacgctactgcactccagcctgggcaccattgagcactgagtgaacgagactccatctgcaatcccggcacctcaggaggccgaggctggtggatcacgtgcggttaggggctggagaccggcctggccaacacagcgaaaccccgtctccaccaaaaccagtcaggcctggcggcgcgagtctgcaatcgcaggcactcggcaggctgagtcaggagagtcaggcagggaggttgcagtgagccgagatggcagcagtacagtctagcttcggctcagcatgagagggagaccgtggaaagagagggagagggagaccgtggggagagggagagggagagggagagggagaggcaaaggcaggcgcagaggcaggcacagaggcaggggcaggggcaggggcaggggcaggggcagaggcagaggcattatatgtttttttgtttgaggttaccatgaggcttgcaaatatatcttgtaacccattattttaacttgataacaacttaacacttgtataaacagacaagcaaaaggaagaataataaaaactctacaccttaactttgtcccccagcttttaaacattttgttgtttctgtcttattgtgttgcctatgtcttgaaaagttattatttttcattggttcatcattcagacttcctacttaggataagagtagtttacacaccacattacagtgttataatatttggtgtttttctgtgtacttactattactagtgagttttgtaccttcaggtgatcatttattgctcattaatgtccttttctttctgattgaagtactccctttagcacttcttgtaggacaggtctgatattgaaatctgttagcttttgtttgtctgggaaggtgtttatttttccttcatgcttgaaggatacttttgctggctatactcttctagggtaaatgtttttttttatttcttcagcatgttaaatatgtaattcttgggaaggctttccagacatttgaaaggacttgtgtgttgtgatctaagctgtttctgctttagggctcaccacaagcctggtaatgttatggttcttgcagactcttagaggtaccagccaccttgatggtcttggacaagatcagggagaattctcttgattaccagtcagaggctcttgttgtttccttactttctcccaaacatataaaatctctctctctgttctaagccacctaaagctggaggtggagtgacacccctggggccaccaccactatgactgctctgcatcagacctgaagctggcacagtgctgggtcttgtccaaggcctgttatagccactccctggctactgcctatgtttgctgaaggccctgggactctgcagtcagcaggcagcaaagccagccaggcctgtgtccttcccttcctggtgatgaagtctcccaatcccttcgtggatatagaagtgctgtcagggagtcagggactagaatcaaaaaccttagaagtctacccggtgttatcttgtattgcactgttggggcactcaaaccacaaggtgcagttcttcccactcttccttcccttttctgaaggcagacaagccttaccccatagccactcaccccagaccataggactactgccagaatactgctggcattctcttaagtcccaggatctcttaactcagcttgttgtaaatgctgcctggactgggactcacccttgagggtagtgggttccccactggccaagggcaggtccggaaatgctgttcaatagtcaaggcctgaaattggggcaccttaagtgcccgcttggtgctctacccttctgtggccttgctggtatctaaggtacaagagaaagtcccctttacttttccctctgcttttctcaagcagaaggagttttgctctgtagtcaccacaattggtaatgtgctgagtctcacttaaagtctgcaagtctcacaggctcgcctgaagccgtaagtgtagtacctgggtaatgttgctgattattcagggtccaagggctctttagttagcaggtgatgaatgctgccagcacgaagtcctttctttcaaggcagcaggttcccttctggctcagggtgtgtatagaaatgtctgggaactaggacctggaatagggaccacacaactctgaccagtgccctatcttgctatggctgaggtggtttccaagatgcaagacaaagtcctccccactttcctctcctttcctcaagtggaggaatggcgtgtcttttggagctatgagctgtgcagcctggggttaagggagtggtgatgccagccctcccttgactgcctcagctagtatctcagtatgccatgtgtcctcctgtccactgtctctgggcctagttcagtactaggactcgcctacaagttgcagtccttatggcctcaaatgcctttcaaatttacttggagacacagagtgctgtagcccttgttggcgaggtttgcaggcagtcaatttctgaccactaggatcagtgattcccctctggctagagtgggtttaaatgctcccatcttgggtgggctttagctgagtttggtccagttttcctttttgctctaacaggacagcagttgctgttcagtacctcacagttgctgtgttctccctcccccagacgctctcatagacactctctgcaccatgctccagtaggagctggggtgcagggggtgacgtcagcaattcgggactgctttttttttgtatcttttcagtgcccctttcagtaagatgaagttaaaaccaggtactatgagtactcacctgatttttggttcttatgaaggtgtttttttctgtgtagatagttgttaacttggtgttcttgtgggcttggggatgattggtggagctttctattctgctgtcttgttccaccgtccccactctctcaaatcgtaaaagcaagacctaaaaggatcaaactatattcaagaaccatttctgtatcctagaacaaagctcaaaaatattgatagtagttagaaaaacacccaccacccaacatggtaaaattcaaaatgttaccattcatgcatagaagcaggaaaaatacccccttaattgagggaaaattaatcaatctaatcctaccaggaattgacagagatgttagaatgatcaggtaagggctttaagtgttgttgtaactttgtttattatcttgaaaaagttaagtggagacatgtaagaattacaaaagaccaaactgaacttctataggtagcatccacagtgtcagaaatgaatgcaaaggttgtgatctgtggcagattagattttccagaaggaaagattaatgaacttgaggacatagtaatagaaactatccaaaatgaaacagtgagataaaagtatttttaaaaattaaaaaaaaggacttcactgaactatagaactatttctgtatatggaactgggacgtgtgaaaatggagagggggaaacaaaatatttgaagaaataatgcctgaaagctttccacatttaataaaaacaatttgcaagtccaaaaagtccgataaaccccaagcaaagaaacatgaatactacaccaaggcacatgataatcaaattgctcaaaaccagtgataaagggaaaaccttgagattaacagcaggcagaagaaaaaagacaattcatgtatgaacaaagatatgaatgtcatcagatttcgtgttgaaaacaatgtaagagagatgacaattgatgaatatatctgagtagagaaaaaggtggaaaaaacctgtcaactgagatttctatacccaatgaaaatatctttaaaaatataggcaaaataaggaattgtttgggagtgatgagtatgttctgttttctctttgattttcttggtcagtctacctgaaagtttgccaattttgttgatctttttgaagaattaattttttaaatttcatttgttttctctgtatttcttctattttctgtttcatttttttctcctttcactgttttatatggtttgctttaattttttagaatttatcttaagaggtaaaagcttaggttatcaatttgatatcttgttttcaatgttggtgtttaaaactattagtgtccctctaagcactgcttccacatcccataaatttagatatattgctttcattttcactcagcttgaaataatttccagttatctttgtttcttctttgattcatgtatttttaagatatgcattctttagttttcaaatatatgtgaattttccaatttttaattttttttttttttttgagacagagtcttgccctgttgcccagactggagtgcagtggcacgatctcggctcactgcaggctccacctcctgcctcatctcctgcctcagcctcctgagtagctgggactacaagtgcctgccaccatgtccggctaatttttttatgtttttagtagagacggggtttcaccgtgttagccaggatggtctcgatctcctgaccttgtgatctgcccgcctcggcctgccaaagtgctgggattacagacgtgagccaccatgcccggcctttaattgttgatttctagttaattgttatggttggtgaatatagtttgcatgatttaaattattttacatttattgagacttgttttgtggccaagtacgtggtctgtcctggagaatgttctgtgtgtgcttataagaagcatatattctgctgtttttgtatggagtattctgtagattcagaattcaggttggttgataatactgctcaagttttctatattattactgattttctgtctctttgttctagcgattattgagacatatctgatgaatattgttgaattgtctgtttccttatttctgtcattttttgcttcatctgttttggagatctgttagtagatgcaggcatgtttatagttatagtttcctgattaatataaccttttaatgttataaaatgtctattattgtctgtggtaacttttctttcttagaatagattttgtcagatattggtatagctgttctctcttatgattactttttgcacggtatgtttccatttttttatttacaacctggttgcttctttgaatcaatgtatatcttctatagacaggatatagttagatcctgtatagtttttttttaatccagtcttagaaataatctctgcttttgattaacatgtttatgtacacttaatgtttgacaatgtatagaattcagccatttgaaatggcactagttaaatacatttgtagctgtgtaagccaggtaaatcagtactgtgacttcttgctactctcaccctgtgtttggttactagccttaacaggtaagatctatcttgttctcttgccttgtcttggcaatgtgcttgctattccagcacccttgaaactagggctctgttcagttttgatcagacccacctacagcttcctcaaaataaccatttgacctaaaactcaggcttggcagctgggaaactctcatttaagttgttataatactttcccgatctttgtgggaacaaggtggggatagacagatacccataacatatcacagtagctaatattcagggaaagcaaagtttaattaattttagtttattgtacttacaaatggagtagcccagtttagaatgatttgtatcgaaataaagagttaaataagcttggacacatagagctacttctccagtatttttttttaaactttttttgaaaacattcagacagaaaggcatgtttcctgagagttgtttattaccaagttttttctgtgctaaaattagtagtcacagatatgtaaaaaattgccctccttttttaaggaagagaaggaaccctagaaaactagtgtaggcttgtagttcttccttaatcttagatttaatttgttctggaaacatagaactttagagattacttacccagaaccttcaggaatgtctatctgggaatgattattggtatacactattacttattatataatagtagtagtaataataatggttatgatgatctctcatgtagtgagaactcaagaaggacaaagttcatatgcaaaacagtatgttttgcttcttcatttgtcatttcaagatatatgtttggtggatctagatggaatggattttgtatcattaaaaaaacaacccttaaacttctgttgatactcaggaggcttagtatactatagcctattggcataaagtgctgaattttccccagggttaccactgaaggaagaaagtctggacgagtagtttcctggcatatgcttcttgaattgttggctattttggtgtcaaattttatgttgagagtttcatgttttaatgacaaaaatgtttactggaaattatagcttggaaaagagagccactttcctgcttcagtagaaagctaggtaaagcattgatgtggggtaaagtagctgtggagttttatattcagattgtatgaacagtaaacagagcatctaaaataaccacttgcacgttgcaacaaacacatcatcatttgcttaaaaaagagttataattacagttgacgaagcatggacaccataaaaaatgcattagtttggcttgacacattaattacctgtttttgcagatgtttttatgtattgttgtatgaacagtttacaaaataattacaggaaagtcatatggaaaataaactaagtgggtggtttctcgtctaaatattttcattcatgtgaatctgtgaggcacagctgctctatagcaaaagcagagagatagatgaggattctcgaagtgttttttattagtcgatctctcatcagtatcaccacatttttatatctgtagcaatacagtttaaaaacatttgagagggctgatttattccctgtgattactcaaaaatctttgattctgatcagaagaaatgtggatatctacgattattttaaagtaaaccaaatgaaacccaaaaaaccctaaatgaaaatctattattttagttctgacaggttattaggcaccttgagaaagagttaatcattattttgtaattacttgagttatgcagttttatattacttatagcttattatatctttataattaaactttgtcatgtgtaaattacacagttcagcttatttgttctctcttatgaagtattaaaactgtaaatctgccttttctcagaagcatactgtgttgccgttagtgttctcaaaatgggtttcatctgaaaaatagccaggtcattatacagagatattttacctttacaaaatattacggaacacatcattcaaaattataactgtcaaacaataaaaagatagctttgtagacatcattctgtttacacagtggtttataattacttagaatatctgtgctgtattttcctcatgttattacaatttttcataaaattaaatcaaaatatagattctccttttagtccaatcatgcatcttttggaatatgttcacctgtattccttttgtttgcatttcagctacacggatgatgaagaccataattaaagatactttccctgacatgcattttatgtaactattgtttaagttagagaaaggcactaagttatagaaagaggtaattgagacatcagtaggcatgaaggtattgttatcagaccttataatagtggtggcaagtcatatacaacatggaatactatgcagccataaaaaaggatgagttcatgtcctttgtagggacatggatgaagctggaaacataattctgagcaaactatcgcaaggacacaaaaccaaacaccacatattctcactcataggtgagaattgaacaatgagaacacttggacacagggtggggaacatcacacactggggcctgtcatggggtggggggatgggggagggatagcattaggagaatatctaacataaatgacgaattaatgggtgcagcaaaccaacatggcacatgtatacatatgtaacagatctgcacattgtgcacatgtaccctagaacttaaagtataataaaaaaaatagtggtggcaagtaatttatatacttatccattcatttgtttaacaaaattttattgaaggtcttctacatgtaatgttctatgacagtgctgagatgactataaacattgagatgaccatgtgcctggaacatagtagataactcagaaactattaggcatcttttaaaggggataggaggggcaggaataaatgatagagaacattttcactctggtagtttatataaaggaagttaattgttagggaggattttctctgttactctgaaattgttttcaaatgtgatatagtctgagagtattacttgactcattcttttttttttttggtgacaaagtctcgctctgtcacccagggtggagtgcaggggcaccatcttggcttactgcagcttctgcctcccaggttcaaatgattctcctgcctcaaccacctgagtaactgggattacaggtgtgcaccaccatgcccagctaatttttgtatttttaatagagatggggtttaaccatgttggccaggctggtcttgaattcctgacctcaaatgatccacctgctttggcctcccaaagtgctgggattacaggtgtgacccactgcacctgccctcattctttgaatcatttaaatatggagatatatctgtttgtgttaacagccatttgaaaaaagatgaaatggagtctattctgattctgatgtattaatacactaagtcaatttaatttttatggtagagatgcattaaaggagtctgaaacttcatgggttgagaataataaactgcttgttatcagtaattgtcttgatcactttagatcatttcaaaggaaaaatatgggaattaatatcatggcatcaagaaaacaattattggactctagattcttccgtagattttctacttctcttaagatgtgtgtctcatggccagtgaaagaatgaggaaaatcctttttgggggtcaggagactttccatgtttaccagattaaaaactcataatttatgtggagtttcatttccaaattttctctgatgatatttttattccttctcataaggaaaaattttagttccttagttttggctctttctttttcgtttggtgtctgtcattagatctttgtgatgttttaatcttaattttttataagccatttgactttagaacataagagaaacttaagggactgctatcattattatttggacaagagtttggactgcaaataattatttggacaagagtttctcatcactaagagactggccatttttattgcctggccagtatctctctctgttgcccaggctggagtgcagtggtgccatcacagctcattgcagccttgaacccctgggctcaagcaatcttcccatctcagcctccccagtagctgggactacaggtgtgtaccaccaggcctggcgaattaaaaaaaattttttgtaaagatggggtcccactatgttgtcccagctggtctcaaactcctgggctcaagccatcttcctgcctcagcctctcacagtgctgagattacaggcgtgagtcaccatacttggccagcaatgttattttgaagggagtaaataagtctttggattctctctttaaaattgcataacaaggaaaaataggttagggagcagaaagaaattgttgaatctaagaacactgtctctgtaggtatttaacactctatgatataatgatgtataatatttgttttcagttagtgttactgatagcagaaaaactgctagacattattgaaaacaatcataattgaggcattgcctgggcatcaatattatgacttttactattctttggtgactctctgaatttctagggtcacatgaaattggttttgaaaaaacattaatagggggttgactaaatgcaaatggaaatcagattccctgactggttcatgttatacatggaaagactgatggcttcagagttgtggtagatgtgtagaactataaattactgttcttctcaaggttgccttttgttgtcagaacacttagcataaggcagaaatggtaggctgtacctgaaaagaacaaaacaccattaaacataataaatcagcacttaaaaaaaactaactgtaactaccaaggccatctcaagtgtgagttttcttttatgtgactaaagttgttaacaacaacaacaaaaaagaaggcaaaaaagcagcaacaaacaaaaactcaaaccgagtttgatttggatgttctttctattgtgataaatctgaatgaaatcaagcatgcttgactaagcacagggcccattgggagagtatttgtggtgtagagaaataaagataagaatataataaaatgtgactaagtagagtcttatgtggggattaacttctgtgcatgtggcagaaatcaaatagagtcaaaatactcttaatagccccttaaaatttcccacgaaacacagatatagacatactgtctttcaagatgtttaaattggcttgttcttcctccagcatggcttttcttttgttgaacaaatgatgaggctgttagttatattctttttagtgactaagagtagaattgaaagaaccgttttttattctaggttgcgaaactgaattttattagttccatgagtaaaaatgcctcttgattttttttttttaaatgggcaaatgagaaaaggccattgttatccaaatacatatttgggtaataaagatgttcaagagaccagtttttctcagaaagacctgttctcttttacatggtatgacatataactctttgtagctccagttttcctgtatgtttgtctgttgtctctccattctgattctgctttgctttgttgcctaacaggcacctttctcaaattcttatgtttatttctctgtatctttgtttccatactcacctgtacttctcctgtgctctgtatttttcttgtcctactcagaaacagtagaataatcaaattcaaattcagttatggtactttatattgaaaggtagcttaggatagtggcaagtaccctgaagtatggtgtaagacatggtttaggttcaggctcttatagtaactgtgtaactgagaaagacatttcacattcctcagacttaattttcttataaaagagaagagatatatttcttataaatagaatatggtataatgaagggtgccaagtggtgatggcttcttggataagttagaatttctggattccgttatctgtataccgtgccttctataaacttttcttagtgactgaagtcagagatggtgcactgagaaacacagcatgggtaattgagtgtttctgtaaatttcatcaacaactttggattttctcctcatatctactcagctactccctatcagagatcacacactataatcaccctgtatgatcagaaattgagaaggtgaagaaacacaggttgtcacaatccacattaagacatctcttatgatacaccagaactttttaacataaaggttattaaataatgggaacaatttttctttctttttttctttaaagacagagtcttgctctgttccccaggttggagtgcagtggttcatgcagtggcatgagcgtggctcaccacagccatgatttcccaggttcatgtgatcctcctgcctcagcctcccaagtagctggaaccacaggtgcgcaccaacacgcctggctgacttttgtattttcaatagagacagacatgggatcttgctatgttgcccaggcttgtgttgaactcctgggatcaagcagttctctcaccttggcctcccaaagtgctggaattgtaggagtgagccacagcctagtttttcttttttgaatgcctaagcccactggaaattcttgctgtagctgaatgattaacagataatcattgtggactgtgtgtgtgtattttaaaagggagaacaagaaatcaagcaggttagagttaattaaacattttttggtcaattaaaatctgtttaaagtcacatttgtcaataatttgactagttagaaatatcctggaaatctatagagtcatctttttttttttctggtactgacaaacctgaataagcattcaggagcagaaatcttcaagagatagtttttattcttggatgctgctgttgatcagcagtgattatgacctccttttaagggattgataaggaaggaaccgtagtatttatgtataaggttacttttttgagtcttgctctgttgcccgggctggagtgcagtggcatgatctcagctcagtgcaacctctgcctcccgggttcaaatgattctcctgcctcagcctcatgagtagctggtattacaggtgcccgccaccatgcctggctaattttgtgtgttttttttgttgttgttgttgtttttgttttttttgagatggagacttgcactgtcgcccaggctggagtgcagtggcgctatcttggctcactgcaagctccgccttccgggttcacaccattctcctgcctcagcctcttgagtagctgggactacaggttcccaccaccacacctggctaattttttgtatttttagtagagacggggtttcaccatgttagccaggatggtctcgaactcctgacctcgtgatctgcccaccttggcctcccaaagtgctgggattacaggcgtgagccaccgcgcccggccagttttatgtttttagtagagactgggttttgctgtgtgggccaggctggtctcaaactcctgacctcaggtgatccatctgcctcagcctcccaaagtgttgggattataggcacgagccaccgcacctggcctatatataaggctacatttaaaaagcctttcagtatttccatcacatcattgtagtttccttggaagtggaaccaccatattcagcaggagtccatttcaacttctggcttctggttcttgtttctgttactatggagactgcctagaaagtggcagaaaaaccaaaagtttaaaaaatagtaatttgattataaaatatggctttaattctagctttaactagttgttccatatcttgacatttcgaattccaaattatttggtgagttttttttttttacgaagcaaattttgaaactttattaaagcttaaacacactgaattaaaaagtaaattgccatagtttttattatatttgagcctaaggtgaatcaaaaatcttaaatggggatttaaattagggcttggaaggcattatataatctgaaatgagaagagctaatgacaatggaaatagcagactccagacacagtaaaccctaaaccaaaggactagtattgtgtagaaatagcaaatagatagcttttattatgtggcatgttttatcttcaaagtatgttatagttatttaagtgattttcacagaatatactcatttttcaactgagtagaaaagccctctaaaaccttgcctttaggacgtaagcagattgtaagggtagaggcagaagtacactgacattttaattgcgggttgaggagttggagagttaataaataaatgtagatggttccacagttaaaaagcaatagaaattttccccccaccaagaccagttatatttgtgaattcctcatgaaggagagaagaggtggaatagtaatgtaaaaggtgtgaaatgaaagttatttagcgaaattgcaatcccaactttgttgcagcttttcgttgaggtccgtatttagtcaggattctttggtttgcatgtgcggaaatccaaattcggactacctcagggaaagaagggcaggaatgtagctttgcctgaaatcagggatgccagttacattagaggaaagtaggttcacctgaaaacactgggatttctttctattttttcttttaagtctcgtatatctgctttctgagttaagttcgttctttcacattggcctttttttgcattggcagaaaccagctgttggcagttcctactcctcttatttatagctcgaataacagagacagtccagtttgtgttgtgccaattcctcccttcttcaactgtggccaggaggatagggttctatgattggctcagctcctgactaggggggcccatccttggctaaatggaccttggtgattagagggactgatatctgaaacaagaaagcagctttcattcaaaccacctggttagtgatgaggggaaggggtagaagagtatgatgggaagaagaaagggacatttcccagaagcagaagatgctgttccaggcagaaataagaagagggttctactagtagtcttttgggggaaattatctctttattataattcagttcacttcagttcagcaaaccaggaaacattgttttgtaggatttggtttttagaaaaaaaccaaggttgaaaacacacacacacacacacacacacacacacacacacacacacacacacacaacagctgttgcatttggtcctatttgttgagttgcttagttgtataatgtctggactagggctagtctttttgtcttcagagctttttacaaatagacatttcttatatatttgactcctacaaaaatacatcaaattatcaatacatatttaaataggagaatgttagaatttggataaatgaaatcaatggggggtaatagttagacttggttgatactaataactttcatgtcttttccaattttgaatatctcttcttttttgttagaaatgtgaacaagcagtgtattgggtagaaggaagttaattttcaggttgaactgaggaaaatttattttttacatgtccagacttttttttttaggagagtcaagccctacccgtcgagaagctgtgaagagaagaacagccgagtacctcatgcgggcagaaagtatctctagtctttatgggaaacctcagcttgatgatgtatctcaggtatgtctcatattttgttgtgtgttttcttcagtgattttttgctgtctggtctctctgctttatttctaattagaatgttataggattttgattttttgaattttattaatgattttcataaaggttgttggtagaaagaaatgcattatagcaaaccaccaaaagtggaataaaataagacttgctttctccttttcttggtcttttattagtttcttactgtacccttaatctcctcatctgtagattgacagtaatttatactgttatgatatctatttgtatttggacattttaaagttagattgtgattcttgtataattgttctccagttttattgattcatgttaaaactattcattttaagcctaagttatacaagtatatgctattggtcacctggaattataaaagcataattctagcagagatagttatgttatttgggacttctgctagacttgtctaaaacgcagatgaatactgaaaacattagaaacattgcaggttattattgtttttatgctgtatcgacctggatttggcaaatttctggaggaaacttttctgttattttttttctttatatcaaatgcaatttaagaattgtgtcttccggaaatgggagaaagggtttagtttcttttcttttcttttttttttgaaacggagtctcactctgtcccccagactggagtgcagtggcacgatctaggctcactgcaagctccgcctcccgggttcacgccattctcctgcctcagcctcccaagtagctgggactacaggcacccaccacatgcccggctaacttttttgtatttttagtagagacagggtttcaccatgttagccaggatggtctcgatctcctgacctcatgatctgcccgcctcagcctcccaaatagtttattttcttaattgatctaagagtcaggcaggcttgttcatatccagctctgccacttgaagtcatagaagattggacaagatacttaatcccacttctgcatgtcagtttctatatctgaataatgagaatatagtaattttttgctgggtagttactaggattaaatgaagtaaaaaaaaaaatttctgtggattacacatatacacataaatcaagtgcctctctagcatgaagatcagcccataagccaaagactaagttttagcctcattcttcatttccccttcatataccggcttatatactttttcctacacatttttatgctttgtatgctttttgaaaatgataagatagcagttgtcaaaactgtactaatcagtgtaagacattctgagaatttctgatgttaagtgtttgaccatttcttataaaacaaaaagattgtgtttcaacttgcaagccatatatacttatgttgctctaacataatctaacataatgattgtgttttaaatgacattattctgctgattgattttcagattgtgaattactgcgactcttttagtctgtattctgtttgctaatcttatcctattctctatcattgttcttttaattatattaaatttatttcctttactttttcaccattgaattttatctttttaagtggaatatttatgtaaacattactttgattcaattcccattttccgtgggattgacaaccttcctcgtgtgcagtactaatgtgtatatactcaatttcattttgggggggcattgatgaaagcattaacataattccctgtgaacttgctttactaaatccatcttgtatataaatattgtaaaagtttttttaaatttttaaatttttaagttttttttttttttttttgagatggagtctcgctctgtcacccaggctggagtgcagtggcgcgatctcagctcactgtaacctccgcttcccgggttcaggcgattctcctgcctcagcctcccgagtagctgggactacaggcgcatgccactatgcctggctaatttttgtatttttagtagagatggggtttcgccatgttggctaggctggtcttgaactcctgacctcaggtgatccacccacttttgcctcgcaaagtgcttgtgattacaggcatgagtcaccacgcctggccagtattctaaaagttttagggatttaaaattaccagtattctattcattcttataacattaaatttgaatggtttacctatacttattcatgtaatcctcctacttttgcatccctgttagtttcctataggcatatctatgaagcaataatttcttaggtaaataagtatgttgagcctcctgtatagttttaactagaagaatagaaccatgaagtatatcagtcagaatttcttcaagtataacttctaatgagaataaaacagaagagatctaatataggaaagctgattacatttgattatacagtaattcattaagcatcttttaagactgtatatagaatcaaactagatatactttggagttatacaaaagatgatgacacagcctgctcttgcaaatcctgtagcatagttgaggacctgtatatgtacatagttgagcaaacaaagttacactggtaagagccatcctaatgggaaattctatcagaaaggataaaaaggagtgccttctgaatctgatttgacatgtaggattttttcggttcttaggcaaggaggctagaggagagtaggcacagtatttttcttttatggtaaacatttgctttttaaattttccttttgtatgttattttgttaagcctggccctttttggccaagagcatccttgattattttctcatgtataatttaagttaaaagtcttccagaggattgtgattagcttggtgcatttattatttcacttctttaaccatctttgggtctgaatttcaaccaacacaatgagaggatttgtgtaaatgatttctaaggcccctttagctcaaatttggtgcaaagcagatattatttctctctggaatcagtgtgcaaacatttctttctagcctggttgattaagacaataaaggaaccctttttggctttttaaatttttgttaattattgttttctcctttggtacagtctatcatgacttcttccacccaggttttctgtgatgttttaagtgtttgtattgaactttagagatctttatataataaatataaaagttctaagtttcccagtcattcatgttaatatcctttttgcaaaagcacagaaaggaaaaaaagcactctcttactctttttcttcattgcttcattactaaaaggctccaagaaaatttaggagcaggtttcacataaaaaggaaatgaggttttttttaaagtaaaggttgaatcttaactgaaggagacagatttctttcttttttttttttcaaataaatcctagacaacgttgaatgatttaagaattaatgttgaaagaagctttccctggaaaagatttagaatagtttttttgctttttttagctataggaatttgaaactaaagatcaaatttagaaaaagacaataaatgatctaaatttagcacataaaatatttgtgtagtttctaaagtgtgaatatgtttttatgcagttacaaggtgtgaatgaaaattaatatgtagaatgtgtgcctttcctgaatatttgtagattttgagtacaactgatataatattgcaagtatttttctattgtgcattttgtttacttgtattattaattgatattattccattattccttagaaaatattttaaatttgccctcagtgagacatttgcttaagtcagtaataggtctgcaatttagtgtcaggcttgaaatgtgacctagtgcggctcaggagacggggtattagggttggtagattgcccgtgaaagtctttgcaaagccaaaaattcatggatgaagccaaattcaggagctttgtcataattagacagtagagttcagagtgtggtttcttgatacattctttgtggtgctttccttttgcccttgattgcttgttttcccgcagtaatggttactctctctcaggttatttgaggagtaagtaaccgtattctaaatgtggttggtgaaacagcagcatcagcatcacctgagagctaggtggaaatgcagaatatcagacctactgaatcagtatcttctttttaacaagatcatcaggtggtgcacataaaatttaagaagtactgcaccaacagattgggaagaatagagagagagatctcactgagaacaggaaataatatcaagtgaaaaagacagtgggcaggctgaacaccaacttcaaaaacaaatccccaaacagaaacaaagccttttaaagaatgtacaacaggcctgtaatcccagcactttggaaggctgaggcaggtggatcacttgaggccaggcgttcgagaccagcctggccaacatggtgaaactgcatctctactaaaaatacaaaaaataaaaaaataaaaaaattagccaggtgtggtggcacatgccagtaaccccagctactcaggaggctgaggcacaaggttatcgtttgagcctgggagatcgagcttgcagtgagccgagatcgtgtcactgcactccagccttggtgacagagcgagaacaacaatagtaagtaggttttaactagtgtgccaattctaatccatgcgtagtggctgccaagagcattgtattgagaagagttgtgagactgtgggattaacagagatgcctgccgtggacttgaccagttgagtgatatgtacttgccacctctgcttttgaagattgttgggtcatcatgtactcctgcctctcttcccttgtctttagtcctggtatagatgaatacaaccattctttgcctctcttagcatcttctgctataattgctaataaatgtaagtgaaaatcttacttttccatcaaggaactcaatcatattacctagaaatacattgcttctcccgtcgcgcttcatagcgcaatgggccaagtttcccctaacaacattctattatttcataagtaagatttaatcccctcttatctattacctacttttgctaaccttgctgcgtctcagttttctcatctaaaaaaaaaagttggacttgatctctaaggtctctttctgctcttaaaattctgtggatttgtatgtccttttgccatctgaagaaaggagtagatctataggattctacccaatttaagcactacatatgagaaatacaatttttttattgatgattttatttcatggtctttctttgttcgtttctgtgatctcaaacttttatagatggttaaagtaaaaagagaactttaatgatcactttgcctttggtcatttgtccttcaatttccccattcctgtctttgcaagagtaaccttactaaatcactgttttcattgggttatttctcatagaaagacttgttgtctagacttcggagactgtatagtcaagacttttcttctcggcattcaaggcctgtgaaaactgaccctaagtatataattttattttcctctgttctccaatttgaacaacttttccccaacaggctaatgctttccaattgtatacagtatagaataactttttcctaatctaatttccacataacatttaaaatcacctttagtcccacatctttctgagaccacagtttttcatacactaatgatgtatctatgtagtcccgtatttttaagagagtgttttattgttatttaactgttcatgtatttgtcttatcttctcaaatggtgaacttcttgaggttagactgagccttttgataatttatagccctttcagttatcatgcacatagtgggtgcacagtaattatttgttgaaagatgcaatagagatttcatagtttgctttctttgctctttaaattgccaaagtgaacaaataactttctttggaaactgaaagaaacagtgacatctgtgaataaggaggtataaataggagatagggatgttggagatacttggccatattttctaagacaaatgtaatggattaaatatcatttaaagtattcttttttccctccttatgacttttccttagcattccttttgccaaaatcacaagcagttcttacttgttcttgtagcaagaggcagcagcagaaaagaatttttaattttcagaatgtgttggttagtaaaaggattgcaagctttagaatagtagttggagttcttccactgtctctcttcctgaccacagacaaacactccagcattctgagaatccctttattcatctgtaaaatgggaattatataataccaacttcctgtaagtacatcacctggtatggggtgaagaatagagatgaaacaatataaatgaagatagaaaagactgtttctactggccgggtgtgctggcttatgccttcagtcccagcactttcggaggacgaggtgggtggatcacctgaggtcaggagttcgaaaccagcctcgccaacatgatgaaactccgtctctactaagaatacagaaattagctgggcatggtggtaggcgcctataatcccagctactcaggaggctgaggcaggagaattgcttgaacccgggaggcagaggttgcagtgagccaagattgagccgctgcactccagcctgggcgacaagagcgaaactccatctcaaaaaaaaaaaaaaaaaaaaaagaggttattgctattacatgtctgtttacatattataacactaaaatatcttgctaaatgtttttatatccctaaaaaggttccccttagtttttaagcttatagggaggcagaaatatatccgttttttttatggtacctagctcagcacctcatgaattgagacattaaataaatatttttgaaatgtatctaagaagcataaattaaatcaatttaaaggttattatctagtctaattgtcactatcaccaactttctcaagcatctttagaaataaaaagtctcttttaaaacttaaacatcatttcaggtacagttaaattattatttgcttgctaaatctgaaaacaaaacaaaaaaattgaaaagaattagaattgctgcttttagaaaaattcacaaatggtagttttcccagttgtaaatgacacctaattttccaagtaacctccctccctagattccctcctttctctctcctctcctcatttctgctctccctcacattttccaactaactaaatactagcaatatgctaggcactgtgaatatagacatgactaaggcacatttctattctcaaggagctgcctgtctggtgatgttggtctgtacaggaacttcaagtatcaaaaatggtatctcaataattcccttaccatggtgtttgatcaggatattttatcttccattcatagggtcagaatgtttccgctgtattctaatagatttttgatagcaataaggtctgctctaagtaagtaataaggctttgtgtctcctgttgtcctttgcagcatcaccattttaatacaggatcaatgtagcagtactttatagttgtaaatgtcgtatggaggtgcccttagaatttatctaatttaatggcttatattactgatagggaaaaactaaaactaataaatggaagttgggattattttaaaattgtgtgcagaatttaaatcttccttcctatgttcactgattttttaaatcttttttgtagctaacagactgttttccacatcacagatattcaaatatttgaagaaaaatttctttctcttacaaatcatctcttaaacaggctcagttttagtaattattggttatatgatgaagcttcttaatttttcacaattattggtaatttttctggttgaatttgaatggaccagtccctctgaaaacacataatacataaagtaacaattatagaactgtagctttatgatgagagagaatggcttgtgcccctccctccccatgtgtgcttattattatattgttttttagttcccccacttccaaattactcttgaggtgtctgggttaaatataagactgggattgattgttggcccagttatccatttgttacaaagttttatgatagctgtatggtctgaattgaattattgctctagaaactgccagctcattaatttttctttttaaaattttttcaatgttatgatttatttacttgcaacttttttcttgctttttctttttgattttctttagtttttatttttaaaaattttatattacagacaaacagaaacttcttcctttcatctttccattctctgatttatgatgaatttactttcctttggcctggcatttgcttcagcaggcagccttccttcaagtacctccctgattgatgtataatctttgatatcttccattagcctccaggatcactaagttcaaggcccctttggaacctaaggagccctgccgaggagctgaaggccttcagagtccttggggtgattgacaaggtaattcttcagtgtctcttcaagagttcagtcataaatcgactgcatgctgacattctgtctttgaagctttggatcttaaggatatgaaacaaaaggagaaaatgactcaaatgcatgtgcactttacaataacaaaagcaaaagagaaaaagcttttatctgagcaattcatgtaaggtcatgcaaaatatatttgagctaaaggagaaggcgcatatttgttggcattcagttgagtaaggggtttggttttatagaagtgttatagcagagtaaagatgtattgtgttaataacaattgtgagccagtagttgttcaacattaattaatacggtcattgtaatggtcaaaaaagtggaatccccttgtaattaccatttactgagcacctactatatgtcggaccctatgttaggcattttatatgatacaatctttcttacaattgtatttgcatcttggtggaaaagtgatgtttagagcagattaaataacttggcccaaagtcacatagctaatttaggatggtgctgggatttgaacattactttttttgactcaaaagctgtactttttctagtacactaacccctcacttcacacccacatgcattttaattttaggggtaaaaatactggcctcacagagttatctgccattgtgtatgtgcaaatttggtgacatctcacgccaaatattaacagtactgttcctatcagatggtttacaagtgtaatttaaaagccacagacaacaaaccatgttttaagtatatttgctcaaccaccgctttaccattcaaagtaaataaaatgctttatttaatattaagggataggttaatttagatattttttcaccattaaccattttttatgaagcaccttaatgttcatttttaacttactatacattatttgtgaagtatgcgtgtgattccatcctaaaattgagcaatatgtagtattctctagcaatttagacagtaaaagtttgaagcattccaaagggaacattaagttggatattacataaagctgtcggtgtcttaagttctggcaaggatcatttttctcaaattcatattactgaattttgaacttaaaaaattctaagtagtaggatttttctttttttaagagcctgaaatattttcataaccgtgttttctgtggcttttccagtttggaaaacattcagtttgagagtagatgaagacaatatagtaattgagtagtttctaggttctcagatttctttgcaggcaagtataccttcttgaggtacagtgtctgccccctctcttagatctatttctttgacaaagtatggcctttcattgctatgctataagtgtgagtaagttaccttgaagtcctagtaatagctagtagtctcacaggtttgtttaaataagggcttttggctgggtgctgtagtttgcacctgtaatcccagcactttgggaggccgaggtgggcagatcacttgagcctaggagtttgagactatctgggcaacatggtgagaccctgcgtctacaaaaaaagaaaaagctgggcatgtagtcccagctgctcgggaggctgaggggaaaggatcccctgagcctggggagtttgaggctgccgtgagccgtggtcatgcctctgcactccagcctgggtgacagagtgagactctgtctcaaaataaataaataaataaataaataaataaataaataaataaatatcaagtctttaaaaaaaaaggaaaaatgctgggtgtggtggctcatgcctgtaatctcagcactctgggaggccgaggccagtggatcacttgagaccaggagttcgagaccagcctgggcaacatggtgaaaccccgtctctaccaaaaatacaaaaaattacctgggcatggtggcacacacctgtaatctcagctcctctggaggctgaggcaggagaatcacttgaacctgggaggcagaggttacaatgagccgagattgtgccactgtactgcagcctgggcgacagactgagactctgtctcaaaaaaacaaacaaacaaacaaaaaaaaacacaacaaaacaggaaagaaagaaagaaaatagaaggacttttgacagtagaagaattcctaagttctgctgagggataatttggtactgtctttacttactctgtttagctgggaaaaatgtttggtgtttagaaggtgacatttaacttttttttttttaattgacagaatctcattctgttgcccaggctggagtgcaatggcacaatcttggctcactgcagcctccgcctcgtgggttcaaacaattcttctgtctcagcctcctgagtagctgggatttataggcacacaccaccatgcctggctaatagttttttgtatttttagtagagacagggttgcaccatgttggccaggctggtttcgaactcctgacctcagatgatccactcgcctcggcctctgaaagtgctgggattacaggtgtgagccatggtgcctggcctaacttttcttagtagagataagggaatatgtatttggggaattaagaagctttgggaattaataagtctttaaaatttataacatattcctgtgaaaacataagtaggtataggccgggagctgtggctcatgcctgtaatcccagcactttgggaggccgaggcgggcagatcacctgaggtcaggagttcaagactagcctagccaatatggggaaaccccatctctactagaaatacagaaattagctgggcattgcggtgggcgcctgtaatcccagctactcgggaggctgaggcaggagaattgtgtgaacccgggaggtggaggttgcagcgagccaagattgcaccactgcattccagcctgggcaacagagccagaccctgtctcaaaaaaaagaggaaaaaaaaaaaaagcaggtacattttttgaaagttgaactgttttttaaagataagttactttctgttgtactgaggactacctaaaatttgggttttagaaacttgaagtatggaaaataaatgttgaataaattcaaaaggttagaaaatagccaggatatattgatctagtcctacagaacacagtttctttgattctgtttcattacagtatttggtttttatgagttattttgagtgctatctattaacctaggaaaaatacagttctgaattgaactgcattaggattaggatttcacaaacttttatgtagaaaaaaataaagcagattttttattaatatctagactgtaagctctgtgaaaacaaaattgtgtctttcttggtcaccactatgttctcagtacctagaatcgcttggcacataatgggtgctcaataaatatttgttgaataaatgaattgaaacttaattaattttaaatatatatagaatgacatctactggtacaatatgagactgctacctggtacgattgtatgaggtgacaactcagaaagtgtttacccagagggatagtaattccatagctgtatgttgatttagtattcaaagagaagtaaatgactttctgttcttcaattgggattataaaatccctcattaacatagatatgcaaaaattgtatatgaagaatagccagaaaacaaggaaatgtttaacctgattaaaaaaaaatgtgtagtcttcaaatagttgagggctgtcttgaataggggaactgtataatgttttctctaatcttgagggtgaaaagggctattaattgtgtcagaacaacaagtgcaaactaaaatcatctcagttaaaccaggaagtctggtttctctgtgaaaaaggtagttagggaagagacttgcatgctaatatcctcataggatataactagaaccaaattagtacaaattcaagagaaacaaattattgctcatgataagaaataccttttgagaattagcatattgaccaaaggtgtgctagattcctttagatcttaagagtttcttgtcatttgagacattcaagtgaaggctgaaagattgatcattgggatgctatagaatgaactggatggaattttacattagataacttttaattatttctttgatcctgcaggtttatttacatagtctttgtgtagcaatagcaggggagagaagaaattagcggaaaaaaaactctgatgggatgaggaggatgcattactattattttaatataagtttttatagacatgggtgcaattctttttgttgtatttgtgtggtacgaatatacgggatgtgcttatatttgtatgtgtataaagattgtttatatatggtaatttgtaattgggttagaagagtctagattggtagtttggtagtagaatgcccaagtgctaagagagtttctgagaaagatcactgttgtataacttctctataaaaagtataaaggagcccatagtttagtatacagtaacgtaccaatgttactttcctggttttgatattgaattagaactatataaggtgtcaccactgggggaagctgggtgaagggtacatgagactctttgtactgcagcctcctgtgagttaaaacaagaaaagggtaaggggaacattgatgacttgaaacccagagtatactaagatttgattccctcatggccagttaactcttctggtttgtgagtagcctgagtcattctgtgtgtacatgtgtgtatggtattcacaaggaagatcggtgaagatcgtatatctggatcgcccaaatttattgtcactgaaaaacaacttaaatatgctttgcaagtcatcgttataagagatgccacacactttgtaagtctatgactatttactaggtcagatgccttcacattttgtaatcaagatagcttcccaactttatctgatgcctgccaggcagaattcttaagttgacttgccattggaaaaatgtaggcatttctattctgtagctaaaatataattgagaaaatgtgtggaaattgctcaaattgagtagctgttgaaaaactggtacttattttttaaggtacctaagtaatatcttctctgataatatgtggaaaaacatgtatttggaacacagaagcatcaatattcaggtatttgctcattaagggaacactggattgaactggattaaatcaaaaggacatagcacaacattttttaagtgctaaaaggaaagaactatcaaccagaattctatatcctgtgaaaatacctttcaagagttaagggaaaataaaggtattctcagatgaagaaatgcaaagagaatttgttgctgaccagcctaccctaaaagaataaagtgcattctctaaacaaagtggaaacaatacatgcaagaatcttgtcacgttaggaagaaagaaagaacattggagagggtaaaatacaagtaaatacaatggactttctttctctttagttttggaaattatcttttatggttgaagcaaaaattctaacactctctgatgtagttctaagtttatgcagagaaaatatttaaggcaattataaatgagggagagtaaagggacataaaggaaggtaaagtttttatgcttagcttgaaatggtaaaatgatgacaccagtagtttgcatgagttatgtatatataatataactagagcaaccactaaaaagctttttaaagtatacactaaaaaatgctatataggttgggtgcagtggctcacatctgtaattccagcactttgggaaactgaggtgggtggatcacctgaggtcaggaatttgagaccagcctggccaacatggtgaaaacctgtctctactaaaaatacaaaaattaaccagcatggtggtgcacgactgtagtcccagctactcaggaggctgaggcatgagaatcgcttaaatctgggaggcaaaggttatagtgaaatgagatcatgccaccgcactccagcctgagcaacagagtgagactccatctcaaacaaacaaaaaatactgtagataaaccaaaatggaattctaaaaaatgttcaaataacccacaaaaattcaggaaaatggaaacagagagaacaaacagaacgcaaaatataacatgcaaacttaagccctaacacattataaatataccagttaaaaaaacagagattgatattggtttaaagatatgacccaactttatggtgtttataagaaactcacttcaaacataatataatgagatatatatatgatatatatacatatatcatgatacatatatatcgatatatatgatatatatattttatatatcacatgtttgaagtgagtttcttatatatcatgatttatatatcatgatatatatgtatatatatcatatatgatgcatatatatgacgtatatatcatatatatatcatgatatatatcatgtttgaagtttcttatatatcatgatatatatatatgtaaaaagtaaaaggatggaaatgacatgtcatgcaaacattaaagaaaacaggagtggctatattaatacaagataaaatatgcttcataccaaagaaaattatgagagacagagaggacattagataatgataaaaggacaatctaccaagaagaaatagcaatcctacaaatgtatataccagacatcagaactgtaaaatatatgaagcaaaagctgatagaaagtgaaaggagaaataggcagttacaggtggagacttcaactgtctcaaaaactgataaaacggttagacagaaaatcagcaacaatacagaagaactccataataccatcaaccaacaaaatgtaactgacttttatagaacactctacctaagaacagcagactacacattcttttgcagtgcccatggaacagaccatttctagggccgaaaaacctcaacaaatttggaagtattgaaatcatactgagtgtgttctctgaccatgtctgaatcaaattattaatcagtaacagaaagataacaggaaactcgccaaatacctagaaacaaacagttatactactaagtaattcatgggttgaagaagaatctcaaagggtattaaaaaaaaatgcatatagttgaatgaaaacaaaagcagaacataccagaatttatgggacacagctaagccagtgttcagagagaaacttataacactaaatgattatatcagaaaacaggaacagtcaaatctaggttcctaactcaaaagaactagaaaaagaacaaaataaacctaaagcaagcaggaggaatgtaaagagcaggaagcaatgaaattgaaaataaaaaaccgtagacaaaaatttttgcgtaaagctggttcttttcaaagatcaataaaattgataaacctctaacaagagagacaaaaaagagaatacaccaattattactgtcaggaatgaaacaggtatggatcttgcctacatcaaaaggataacaagggaatactacaaacagccctacacatgtaaatttgataatttagatggaatggaccaattcatagaaaagtacgaattaccacccaaaataaatagataatttgaatggctctttaactattaagggaactgaatttataattaaaatactactaagatgaaatcttgaggctcaaatagtttcaccagagaattctaccatacttttagagtcaacaccagttttacacattttcttcctgaaaatggaagaaagagaaacagtttccagttcattttatgagaccagtattactctgatatcaagacattagaagaaagaaaactatagaccaatattctcataagtgtaggtatagaaaccttcaacaaaatattagaaaatagcaacaaaatctaaaattaattctataccatgaatttattatttaaattcatttaaattcattaatttcattaaattcatatttatcttttcaagaaaaccaacttttcatttcattgatcttgtattttttttttgcctcaatttgatttatttcccctctgatctttattttcttctacaaatttgaggtttggtttgttcttactttctagatccttgaagtacatcattaaattatttgaaatttttcttttttaaaaaaattgggcatttattgctataaacttttctcttagtgctgattttgccatagcccacagattttggtatgttgtatttccattttcatttgtttcgagaagttttttaattttctcaatttcttcattgacccattggtcagtcaggagcatattgtttaatttccgtgtgtttctgtatttctgacgttcctcttgttattgattttgtgttttatcccattgtggtcagaaaagatgcttgacatgatttttttaaaaattcgctcatacttgttttatggcctattttgtggtctgttctacagaatgtaccatgtgctgatgagaagaatgtgtattttctaactgttgggtgaaatattctgaaaatgtcagtaggcctattagatttagtgtgtagtttaactctggtttctttgttgatttgccgctggatgatctgtccattactgagagtggcagttagagtctgctactattattgtattgcaatctgtcttttctttattagatctattatgtttattttatatgcttggttttacaatcttagatttgtagtctgttttatctaagtagagctactcctgtgcttttttgttttccagttgcatagaatatctttttccaccccttcactttcagtctatgtgtctttataggtagggtaggtttcttgaagacagcatatagttgggtcttatttctttattcagccactctgtgccttttaattagagaattaaggcctggcacagtggcttatgcctgtaatcccaccactttgggaggccaaggtgggcaggatcacctgaggtcaggaatttgagaccagcctggccaacatggtgaaaccccatctctactaaaaaatacaaaacttagccaggcatggtggtccatgcctgtaatcccagctacgtgggaggccgaggcaggagagtcacttgaacccaggaggcagaggttgtagtcagctgggattgcgccactgcactccatccagcctgggtgacagagcaagactctgtctcaaaaagaaaaaaaaaatttaaattcagtattattattattattgataagtaaggacttactttattttaacaatcttttttttttcctgcttattttctggttattttgacactcctgtcttttttcttgtcttcctttgtggttctgtctgtctttgtgggtaagtacttttctctggtagtatgttttaatttgtagctttttattttagggagtgtcttatgggttttgtgctgtggttgccagttaccatgaggcttacaaaaaatatcttacaaatataacaagagacagttcatcttaggtcacaaataataagaatagaaacaaaggcaaaaaaaaaaactacacaaaaataatctgcagtttaacatcatcacccccacattttgagttttagttgtctcacttttcattttctatattacctgatttgataaaatcaggtaatttgataaaatcagtggattttgcatcactgttaacagtagtataggattctgggtttgtttatatacttaatttcaccagtgttttttctttttttttttaaaccttttttttttccccttcaaattgaagaactccctttagcatttcttataatgtagatctgatggtggtgaattctttcagctttagtttgagaaatagtttctctctccttcatatctgaagtataattttgctgaatacagtattctcggatggcagttttatttttggtttgttttttaagcactttgaaaatgttgtttcactcttgtctgcgtggtttctgttgagaagtcttgtcagacaatgtggaggtcctttatatgttatttgcttcttttctcttgttgtttttaggatcctctctttgcccttgacctttgagggtttgattattatgccttgaggtagtcttacttgggttgaacctattttgtgttctgagatttttttgtatctggatatgtatatctttcggaaaaatttctgttatttctttgagtaagcattctagcccttggtgttgctcagctccctcttgaacactaataattcttagctttggtcttttgagataatttttaatatcttataggcagcttcattcttttctactcttcttttttctcttctgatcatgtattttcagatagccagtctttgagctttccagttctttcctctgcttcattcatctgctttgagagcctccaggaagttcttcagttcagcaaatgtgtttctcagttcgaagacttctgtttgattttttgtttttcagacagcgtctcaccatattgcctaggcttgactgcagtggcacaatcatggctcatttcatcctctattgcctaggatcagtgattctcccatcttagcctccggagtaactgggaccacaggcttgtgccaacatacctggctaattttttttgtagagatgggggtcttcctatgttgcccagactggtcttgaactcctgggttcaaacagttctcctgccttggcttcccaaagtgctgggattataccatgcctagcctctgtttgattttaaaagattatttcagtttcttttttttaaatttttttcttcttcttcttttttttttttttttgagacaggatctcactctgtcacctaggctggagtgcagtggttcttggctcattgctgcctccacctcccaggttaaggtgattctcgtgcctcagcctcccaagtagctgagactacagacatgcgccactatgcctggataatttttggcatttttagtagagacggggtttcaccatgttggcctggctggtcttgaactcctggcctcaagtgatccacctgcctcggcctcccacagtgttagaattataggcatgagccactgtgcctggcctaatttcttttttaaaatttctttgataaatttttgagttgcttttgtatgttatcttggaggtcgctgactttccttataactactattttgaatttgtggttagagaactcacaaattgctttcttgttaggatcagttgccggatttttgttttgtccttttggggaggtcatggttccctgtttgctgttgtttcttgtgggtatattttatgtctttgcattgaaggatagttattaatagatatttatagaatagttatttattctagttttttttctgtccatcttgttttggtttctactggatatatttgcttagtgaatctttacatctaggtaactgcctctttttagctctaggaggtaccttaagcttgggttgacctcagctctggtaaatgatcagagtgatgcctgctctgaaggtgagaggtcccaaagggattaggctggcagtgtgttaaggctagctagaggtttgtgcccaggagtccatacctcttctgctgagcagcctctcagattgggcatctctgtttgctgagtagcagagcagactttccagggttgggggtgatagtcccacctcctgtctttgtctctgcctgtcctcaggagtatttctccctttaggcagtcacgatgcttcccatggattaaggtggggacaagtctcctgcttgggaacccaagatgttggggaacctggatgaccccctcagtcttaccttttacagttatagaaatgtagttgggtggagggagggtgagattttctgcttggtgccaggcagaatggagggggaggggtgtcacagatgtggaggtctgattcccttgccatctgttcagagttgttttttgtttgtttgtttgtttttttcttacttctccacggccccaggaattatctcattctcatatttgaattccatgttgttactggtaaaaatcttggcacttacatatttgtttgtttgtttgtttttctattggagaggggggcgtgaaaacagcttgcacttatatttctatgtatgaacaatgcacacataaaaactggaattaaaaatacaatacctttataataatattgaattactagatgtaaatataacaagacataggagcttttatgctgtaaacttcatagcactgatgaaagaaatcagaggtctgaattattggagaaacatatttattagcagactcaccatagatgtaaattctttccaaattgatacacagttttaaacagagtttctatcaaattttccgcaaggttttttttttttttaaatgtaaatatagacccgattattctaaaacttatttgggaagttataggaactataatagctaaaatagttttcaaaaaagagtaaggtgggagagtcactctgtttgatttcatgactttacagtaatcaagattttgtggtgctggtatagagacacacacatagagaacagcatacaaaatgtagacatagtcccacaaatatggctaattgatttttgacataggttcaaatcagtataatgtaggaaggttaatatttccaacaaatattgctagagtaactgggtattctctagcaataaaagtgtaccttggccaggcatggtggcttacgtctgaaatcccagcactttgagaggccgaagtgggtggatcacttgaggtcaggagttcgagaccagcctggccaacatggtgaaaccttgtctctactaaaaatacaaaaattagccaggcgtgatgatgggtgcttgtaattccagctactccggaggctgaggcaagataattgctttaacccaggaggcagaggttgcagtgagccgagatcatgccagtgcgctccagcctgagtgacagagtgagcctttgtctcaaaaaaaaaaaaaaaaaaaaagtgtacgttgacatatcctcacacttcttaaattttttttatttttaatttttgtgggtacatagtaggtgtatgaatttatgggttatatgagatattttgatacagggatgcaatgtgtaataatcatatcaagggagatgggtatccatgccctcaagtatttattctttgtgttacaaataatccagttatattcttttagttatttaaaaatctgcaattaagttgttattgactatagtcattctgttgttttatcaaattctagttgttattaattctattttttgtacccattgtcccttcccacttccccttccgaaccctacacgatcctttccagcctctggtaaccatccttctactctctgtctccatgagttcaattattttaatttttaactcccataaataagtgagtacatgcaaagtttgtctttttgtgcctgacttatttcacttaatgtaatttgacctcagcttctatccatgttgttgcaaatgactgaatctcattcttttttatgcctgaatagtacttcattttgtatatataccacatttttaaaatccgttcatctgttgatggacacttagattgcttcaaatcttggctattgtgaatagtgctgcagtaaacatgggagtgcaagtatttctttgatttattgatttcctttcttttgggtatatacctaagagtgggattgctggagggtaaggtagctctatttttaggtttttgtggagcctccaaactgttctccatggtggttgtactaatttagatttccaccaagagtatgagggctcccttttttccacatccttgccagcatttattattgcttgacttttggataaaggccattttaactggggtgagatgatgtctaattatagttttgatttgcatttctctgatgatcaatgatgttgaacagctttttatatgcctatttgccatttttatgtcttctttttagaaatgtccattcacatcctttgtccatgttttaaattagacttagattttttcctatagagatgtttgagctccttatatattctggttattcatcccctatgagatgggtaggttgccaatattttctttcattctgtggattgtcccttcacttttttgattgttttctttgctgtgcaaaagctttttgcttgatatgatcctatttgtccatttttgctttggttgcctgcgcttgtagcgtattactcaataaatttttgcccattccaatgtcctggagagtttcgccagtgttttcttttagtttcatagcttgagggattaaagtctttaataatcaattttgatttgatttttgtgtatggtgagagatagggattcagtttcactcttttgcatatggatattcggttttcccagcactgtgtattgaagaggttgtcctttccccagtgtattttcttggcaccttttgtcaaaaataagttcactgtagatatatgactttatctgtgggttctctattctgttccatgatctttgtgtctgtgtttatgccagtaccatgccattttggttactatagctctttagtataatttaaagtaatgtaatgtgtttcttccagttttgttgtttttgcttaggattgcattggctattctgggtctttgtggttatatataaattttaggattgccttttctatttctgtgaggaatgccattagtattttgataaagattgcattaaatctgtagattcctttagtgtagttattttaacaatattgattcttttaattcatgaacatggaatatctttccctttttttgtgtgtcttcaattttcttgcatcagtgttttatagttttcatcgtagagatctttcacttctttggttaattcctaggtatttaattttatttgtagctattgtaaatgggattactttcttgatttctttttcagattgtttgctgttggcgtatagacatgctactaatttttgtatgttgattttgtatcctgcaattgtactgaatttgtttgtcagttgtaatagttttttaggggagtctttagatttttttcaaatgtaaaatcatatcctctgtaaacaaggataatttgagttcttccttttcaatttagatgctctttatttctttctcttgtctgattgctctagcaaagacttctggtactgtattgaataacagtggtgaaaatgggcatccttgttatattctcgatcttagaggaaaggctttcagtttttcccccattcagtgtgatactagatatgggtctgtcgtatatggtttttattatgttgaggtaagttttttcttcttttttttgagatggagtcttgctctgtcgctcggctggagtgcagtggcatgatctcggctcactgcaacctccgcctcccatgttcgagcgattctcctgagtcagcctcccaagtagctgggactacaggcacgtgtcaccatgcccagcttatttttgtatttttgtagatctgcccgattcagcctcccaaagtgctgggattacaggtgtgagccactgcacccagctgaggtaagtttcttctatccccagttttttgagggtttttatcatgaagggatgttgaattttgtaaaatgcattttcagcatcagttgaaatgatatgggttttgtctttcattctgttggtatgatgtatgacattaatttatttgcatatgttgaatcatccttgcttccctgggataaatcccacttggtcatgatgaatgatctttttaatgtgttgaatttgctttggtagtattttgttgagtatttttccatcagtattcatcagtcatgttgttctatggttttcttttttttgatgtatctttggttttcatatcggggtaatactagcctcatagactgagtttggaagtattcccacctctgtttttcagagtagtttcagtaggactggtgttctttaaatgtttgggataattcagcagtgaagccattgggacctgggcttctcttgctaggagactttttattatgctttcaatctcattacttgttattgatctcttcaggttttggatttctttatggttcaatcttggtaggttgtatgtctctaggaggtttgtcaatcttgtttaccttttcagaacaccaactttttggtttgttgatctcttgtattgtttttctcatttcaagtttatttctgctctaatctttattatttcttttcttttaattatgggtttggtttgctcttttctggttaagatgcatcattaggtggtttattttacatttttcttttatttttgatgtagacacttccaggtgtaaactgccctcagtactgcatttgctgtatcccatagattttgggatgttgtgtttccattatttgtttcaagaaatttttcagtttttttcctcagtttctttgtggacccactggccattcagaagcatatttcttaatttccgtgtatttctgtagtttccagaaatttctcttgttactgatttctagttttattccattgtggtcagaaaagatgcttcatattattccagttttttttttttttaactgttttgagacttgttttgtgacctgccatatggtctgtccttgaaaatgatccacgtgctgaggcaaagaatgtattttctatagccattggaaggagtgttctgtaaatatctgttaggtccatttggcctataacacagattaaatttgatgtttcttttttgattttcttttttcttttttctgagtcagagactcgctctgttgcccaggcagcagtgcagttgcactatcttggctcactgtaacctctgcctcctgggttcaagtgattgtcctgcctcagtctcatgattagttgggattacaggcacatgccaccatgcctggctaattaattttgtatttttagtagaaatgaggttttaccacattggtcaggctggccttgaactcctgaactcaagtgatccacccgccttggccacccaaagtgctgggcttacagacgtgagccaccatgcctggcctctttgttgattttctgtctgaagtatatgtctgatgctgaaagtggggtattgaggtctatagttttttttagtttttatttttattttttctgatggagtctcactacgtcacccaggctggagtgtggcggcaagatctcggcttactgcaacctccacgcttaaacgatcctcccacctcagcctcctgagtagctgggactataggtgcgcaataccatgcctagctagctttgcattttttgtagatatggggttttgccatgttgcccaggctagtctcaaactcctggattcaagcgatctgcccatctcagcctccaaatgtgctgggattggaggagtgagccaccatgcccagcctacggttattattgttttggggtctatttcttcagctctaataatatttgctttatatatctgggtgctccagtgctgggtgcatatatatttacaattattacatcctcttgctggattgacccctttatcattatataattacctttgtgtcttcttatagtttgtcttgaaatctattttgtctgatgtaaatatagctacttctgctctgcatggtttccattggcatggagtatctttttccatctctttattttccgcctgtgtgtctttataggtgaagtggttttcttgtaggcaaagcagcattgggttttttaaaatccattcagccactctgtgtcttctcattggagagtttaatctgtttatgttcaatgttattgttgatagtttaggacgtacttctgccattttgttttctggtgattttgtggtctttccttttttccttccttcctgtattcctgttagtgaatgtgatttttctctgatggtatgatttaatttcttgcttcttactttttgtgtatctatggtaagttttttgatttgaagttaccaggaggcttgcaagtactgccttataacccaggggtcccccatccctgggccacagacaggtgtcactctatcgcctgttaggaaccgggcctcacagtaggaggtgaacagcaggcaagtgagcatttaccacctgagctctgcctgctgtcagattagtggtaacactagattctcataggagcgcaaaccctattgtgaactgtgaatgcgagggttctaggttgcgtgctgcttatgagactcttaatgcctgataatctgaggtagaacagtatcatctcaaaaccatgccctacatgtaccccctgtccccaagagaaattgtctgaggtggaacagtttcatcccaaaaccattacccccactagtctgtggaagagttgtcttccatgaaactggtccctgatgccaaaaaggttggtgactgctggtttatataacattcttaaaatgacaaaattatggaaatggagaacagatctatggatgccagtgtttagattagagatggtggaggagagaagggtgtgtgtgtgttagggggtgatttgcaagggatagcagcagggagaggtttgtggtgatgcaacacttttgttttttaattttctagtttttttgtttttgtcccttttggagaaaaggcaaacacatttatttaacaggagaatcacagagtgagcatcctggtggaacacttctgggtcttgattgtgcttgtggttatgagaatgtatacaattgataagatgacatagaactattaatatgtacacacataataccagtgtcaattttctgcctataatagtatactgtagatacatacaatgtagcccttagagaaaacttaatggaaggtacgtgggaattttctgtacaatgtttgcaactttctagtgactctacaattatttctgaaataaaaagttttaaaaattcgtaacgtgtttattggtctgtcttttaaaattatttcaatagtttttggagaacaggtcgtgtttggttccatgaataagttctttagtggtgatttctgagattttggtgcatctatcacctgagcattgtatactgtacccattgtatagtcttttctccctcactgcccttccagcctttctcctgagtcctcagaggtcattatatcatacttatactgttgcgtcttcataacttagctcctacttataagtgagaacgtatgatgtttggttttctattcctgagttacttcacttagaataatggtctccaactccatccaggttgctgtgaatgccattattttattatttttatggctgagtagtattccatggtgtgtgtgtgtgtgtgtgtgtgtgtatatatataccatattttctttatctacttgttggtaatgggcacgtaggctggcttcatatttttgcaattgcaaattgtgctgttataaatgtgtgtgcaagtgtcgttttcatataatgacttcttttcctctgggtagatacccagtactcaggttgctggatcaaatgttagttctactgttagttctttaaagaatctccatgctgttttcgataatggttatactagtttacatttccactagcagtgtagaagtgttcccttttcaccacatccacaccaaaaaattatttttttttgattttttaattatggttattctttcaggagtaaggtggtattgcattgtggttttcatttgcatttccctgataatttgtgatgttgaccattttttcatatgtttgttggctatttgaatatcttcttttgagaattgtctattcatgtccttagcccactttttgatgggattatttgtttttttcttgctgatttatttgacttccttgtagattctccgtattagtcctttgtgggttgcatagtttgcagatatgttttccccctctctggcttgtctgtttactctcctgattatttcttttgctgtgcagaaatttttagtttaactacatcccatctatttatctttgtttttattacatttgcttttgggtacttggtcatgaactctttgcctaagctaatgtctagaagagtttttctgatgttatcttctagaatttttatggtttcgggtcttagatttaagtctttgatgcatcttgagttgacttttgtgtaaggcgagagatgaggatctggtttcattcttctacatgtggtttgtcaattatcccagcaccatttgttgactagggtgtcctttacccacttcatgtttttgtttgctttgttgaagatcagttggctgtaaatatttggctttatttctaagttccattggtctacatgcctttttttgtttgtttgttttgagatggaattttgctctcgttgcccgggctggggtgcaatggcgcgatctcggctcactgcaacctccgcctcctgggttcaagcaattcttctgcctcagcctcctgagtagctgggattacgggcatgtgccaccatgcctggctggtttttgtatttttagtagagacaggatttctccatgttggtcaggctggtcttgaactcttgacctcaggcgatccacccgcctcagcctcccaaagtgttgggattacaggcatgagccaccgtgcccggcctctacatgcctgtttttataccagtattatcctgttttggtaactatagccttgtagtacagtttgaagttgggtaatgtgatgcctccagatttattctctttgcttagtcttgttttggctatgtgagctcttttttggttccatatgaattttaggactctttttttctagttctgtgaagaatgattatggcattttggtgggaattgcactgaatttatagattgcttttggcaatatggtcatattcacaatattcattctacccgtccatcaggataggatgtgtttccattttttcgtgtcatctgtgatttctttcagcagtgttttgtagttttccttgtagagatctttcacctccttggttaggtgtattcctaagtatgtatgtatgtatgtatgtatgtatgtatgtattttttgtagtcgttgcaaaaggtgttgtgttcttgatttgattctcagcttggtcactgttggtgtataagtgctgctggtttgtgtacattgattttatatcctgaaactttattgaattcatttatcagatctaagaactttttggatgagtctttagggttttctaggtatatgatctgtctgttttgtctgctatataagtagttactcctgcttactttcggctttcatttgcagggaatacctttttccatcccttttccttaaatttatgtgcgtccgtatgtgttaggtgagtctcttgaagacaacagatacttggtggatttttattcattctgccattctgtatctttcacatggagcatttaggccatttacagtcgatgttagtattgagatatgaggtattgttctattcctgatgctagttgttgcctgaaaaccatggccttttttttcattgtgttacggttttataggccctgtgagatgtatgctttaagaaggttgtattttggtgtatttcgatgttttgttttaagatttagaacttttagcatttcttgtagtgctggcttggtagtggcatgttctctcagcatttctttgtctgaaaaatactttatctctccttcatttatgaagcttagttttgctggatacagaattcttggctgataattattttgttcaacaatgctaaagatagaaccccatttccttctggctaatagaatttctgctgaactatctgcttttaatctaaataggttttcttttataggttacttgatgcttttgcctcacagctcttaatattgtttcctttgtcttgactttagataacctgatgactatgtgccttaggtgatgatcttttgcaaccaatttcccaggtgttctttgagcttcttgtgtttagatgtctagatctctggcaagcctggggaagttttcctggattattccctaaaataagttttccaaacttttagatttctcttcttcctcaggaatgccagagagagtaggagggaggaaggaagaaaagatacaaaatgtcaaaactcaaatgggaagaatagactactgagtaagtatgtatattttcaagaaactgaatcaataattaataaccttccaaaatagaaagcaccaggaccagatggttttactgttgaattttaccaaatgtttacagaataaattatatcagttatctgcaatctcttctagaagacagaagtagagggaatacttctaactcattatatgaggccagcattattctattaccagtttttaaatttacccaaataaaattaaaacttcagtcccctcaacatacatccacccaagactgaaccaggaagaagttgaatccatgaacagaccagtaacaggtcctgaaattgaggctgtaataaatagcctaccacacctccccatcaaaaaaagcccaggaccagatggattcacagctaaattctacagatgtacaaagaagagctggtatcattcccactgaaactattccacaaaattgaggaggagggactcttttgtaactcattttatgaggtcagtatcacccttataccaaaacctggcagagatacaacaaaaaaggaaaacttcaggccattatttttgatgaatatcaaggcaaattcctcaacaaaatactggcaaattgaatccagcaccacattaaaaagcttatccaccacgatcaagtaggctttatccctgggatataaggttggttcaacatatgcaaatgaataaacatgattgattcatcacataaacagaactaaaggacaaaaaccacatggttatctcaatacatgcagaaaatgcttttgataaaattcaacatttcctcaggctaaaaactctcaataaactaggtattgaaggaaatacctcaaaataatacgagccatccatgacaaactcacagccaacctcgtcctgaatgggcaatagctggaagcatttcccttgaaaactggcacaagacaaggatgccctcccttgccactcttattcaacatagtattggaagtcttggccagggtaatcaggcaagagaaagaaataaagggcattcaaataggaagggagtcaaattatccctgtttgcacagtgctatatctagaaaaccccatagtctcagcccaaaagcttcttaagccaataaacaacttcagcaaagttgcaggatacaaaatcaatgtgcaaaaatcactagcattcctatacaccaacaacagtcaagccacgagccaaatccagaatgtaatcccattcataattcccacaaaaagaataaaatacctagggataaagctaactagggaggtgaaagatctctacaaggagaactgtaagccattgctcaaataaatcagaggtgatgcaaacaaatgggaaaacattccatgctcatggataggaagaatcaatattgttaaaatggccatactgcccaaagcagtttatagataatgctatttctattaaactaccattgagattcttcacagaactagaaaaaactattttaaaattcatatggaaccaaaaaggaacctgaatagctaaggtaatcctaagcaaaaagaacaaagctgtaggcatcatgctacatgacttcaaagtatactacaaggctacagtaaccaaaacagcatgatactggcataaaaacagatacatagaccaatggaacagaatagagaacccagaaataagactgcatacccacaactatctgatctttgacagacctgacaaaaacaagcaatggggaaaggattccctattcagtaaatggtgctgggataactggctagccacatgcagaagacagaaactagactccttccttacaccattttcaaaaattaactcaagatgaattaaagactaaaatgtaaaatacaaaactataaaaacccttgaagacaacctaggtaataccattaaggacataggcactggcaatgattttatgtcaaagatgccaaaagcaatggcaaaaaacaaaaattgacaaatgggatctatttaaactaaagagcaaactttaaactgcacagcaaaagaaactatcaacaaacagaatgggagaaaattttggaaactatgcatccaacgaaggtctaatatccagcatctataaggaacttaaatttacaagaagaaaaaaacagccccattgaaaagtgggcaaaggacatgaacagacactttttaaaagaagacatacatgcagccaacaatcttatgcaggaacaggagaccacataccgcatgttcctacttacaagtgggagctaaatgatgagaacactcagacacatagagaggaactacagacactggggcctgtcagagggtggcgggtgggaggaagaataggttcaggaaaaataactaatgggcactaggcttaatacctgagtgatgaaataatctgtacaacagacccccttgacacaagtttgcctatgtaacaaacctgcacatgtacccctgaactttaaaaaaacaaacttatgttcatacagtatcctgcacaaggatgtttatagccactttattcataattgccaaaatgtggaaacaaccaagttgttcttcactaggtgaatgggtaaatcaactgtggtacatttagacaatggaatgttactcactggtaaaaaagaaatacctatcaagccttaagacatggagaaaccttaaatgcatattactaattgaaagatgacaacatgaagaagctttatattatataattccaattgtatgacttctggaaaaggcaaacccatggagacagtaaaaaggttagtggttaccagatattgggcaggaggtagggatgagtggtggagtgcagaggatttttagggcagtgtaactattctgtatactagaatggtggattgtccaaatctatagaacatactacagcaagatagaaccctaatagaaactgtgtactccagatgataatgagtcattggtgtaggttcatcagttgcaacacatgtgccactctggtacagaatgttcttagttgcggaggttgtgtgtgtttgaggccaaaggaactttttattttctgctcaccatttgtatgaatctaaaattgttctaaaaaatgaagtctgtttaaaaggagaaaaatcaatacagtcactgccatgtttggtgaaaggcatgtggtaccttcaatagtgtgccttcatctaaaattgtgatactatagttgatgttaaaattttaagagatacaggagaaattttgagctgagtgtcccagacagctggctagctattccagatgtgggacagaccactgtgtttctaggtggtttttagtttgcttggggtcaaagtcttaggattacatattatgtgtacaccatgcagaattctaagctctctacataaattatttaatgctctcagacagtttgcagataaaaaacctgaagccagagagcttaagtgttttgtataaacacactaagttacagatcaagggtttaaactcaggtctctttccaaaactatagctctttatcattattcagaactgaatttctttgattattataacatttatattccttctcaacttactgtattacagtatcattattcattaaacttcctttaaaaaatcagtgtgccctaattaatgaatttacaatatgaataatagcatttaaaaaaactacagcagctgggcgtggtggctcattcctgtaatcccagcactttgggagactgaggcaggtggatcacttttgagatcaggagttcaagaccatcctggccaacatagtgcaaccctgtctctactaaatatccagaaattagccaggtgtggtggcgggtgcctgtaatcccagctacttgggagtctgaggcaggagaatcacttgaactcaggaggtggaggctgtagtgagccaagatcgccccactgcactcaaacctgggcgatagagtgagactcagtctcaaaaacaaaaaacaaaccaacaaacaaaaacaaaaaacaaaccaaaaaagacatcagtcaaaaccccctacagtgacaaatagggttaattgaatggctgagttagggtcttattttatccttactagacaccatcattgtgtgttttataaatacctcgatgctttcaaaccattttaaaagacaaaaatattttaattatgattgtatttattgattaaaaaattaaaaatgggaaacatataacattattacgctattctaaatgctctttaatggtctcatagttttctactatgtactgtggtttatttaattcgttctctttaggttgttttcctctttttttctgcctgtgatgaatattcttagaggtcagtcatcttatgttttctttagtatattttttcagagttggagattatgggtcaaacagtatatatgcacattttaaactctccagaaatattacagtgttttaaactcctactagtagtacagattgagtttcctttatctgagatgcttgggaccagaggtgtttcagattttgaagtttttcagacttggggatatttgtattatatatatttactggttgagaattccaaatccaaaaatttgaaatttgaaatgctacaatgagcatttcctttgagtgtcatgtcagttctcaaaaagtttccgattttggagcattttggattttgcattttcagatttgggatgctcaacctgtatgtgagaaggtttacttcctcgtatccttactgacaacatctgccatttgctgatgaaaatttggatttcactgtcattttaatgtgcaattttaattgttaataggatatatttttaaaattttttattgactgtgtttcttcttttatgaaatgcctgttttaagtccttttcctaaatttttttattagaggtttatatgttcttactgaattttcagaagctctttttataagaatatgtaaacttttgtcttgaatatacaggggtattttccttcaagacaaaaattttctgtttcttacatgttcattatagaaaaatcaaacaataagctaaaaaaaggtataattcacctataaccctgctacctactgagaattatttttacattttgatttatactcctgctgtcttctttctgcacatatatacactgttaagggccccattagcctgtgttttcacataaggtcataatgacattaacatataaattataaagacttggtagcttttacctgttaattagcgggatgtccttttctacctttcccatcccggaagtatttctgagagcatggtctcaaataagtttgagaatgaatgtgtgtctgctggaagctcctattcttccgccattttccagtcctccagaagtttcctgatggtccatgtctgaattagacacccctcttctttgttccagttgcacctgtaattcttcagcatagtacttcttaaactgtttttaattgcctctcctccatgctaaactttcagctcttgtagagcacagaccctatctgctgtgttcatggtttttctttatgtctgatatctgtgtgtacatagcaggcattcagtaaatatgtgttgaattgacttttgttgaattttaatactcgattggagagttagacaccttcctatttgcacactttcccatcatacatccaagtatatgtataatgtcaatttcttttatctttttatgattttcctttatggtttgcctttgatgctattaattagtttctttttaataaccagaaagataactttttgtatcctttatttgtagtacaataaagtttgttttccatgttggtattcctgaaaaatctcattttagtattagagtatgctggaatagacaatataaatacctctaaactctcacttatagcagcctaaatctgcacgtgctgtaaggaaaacatttttaaataatttgccattaaacaatttctaatttaattgtcactttttttttttttttttttttgaggcaggatatcactctgtcacccaggctggagtgtagtggtatgattacggcttactgcagtcccgacgtcttgggctcaaggaatccttctacttcagcctcctgtgtagccaggaccacaggtgtatgccagcatgcctggctaattttttaattttattttttgtagagatggcatctcgctttgttgtccagggtagtctcagtctcctgggctcaaggagattcttccacttggcttcccaaagtgctgggattacaagcataaaccacaatgcctggcctcactttttataatggacttaaatcagtttggttgttttaaaagtaccctagcatttagcacatgaatacatctcattttgattagtggccaaagtatttttgggcattgtgagcattgtactactcccaggctgcttatggtatgttatagtatcagatacatctctttggatccatgctctaagtagaattgtgttgtataccttgcttaatccattaaatttttacctgtctgtttgagtatcaccaaaagaaagttgctatcacaatgtactttctactttttaatctactctactgattcattagtacacagccatggtgagacacttgagatgttctgctgaagacaattgttacatattgggattctggaaggacagcaagctagataaagataagtcatgcttttaagagtcccatggaacatcagtcattgtgatgtgaagaaagtgataaggtaatgcatgaagcagtttgagtcactatgatgtggatggtgggaagtagccctcttaatcaaagctttaagaacgaccaagaacctaaggaatagttacttataccaccagattatgcagataatgttaataacaacaaactcatttatatatatagatatatatatatatatatatttcaaaagaatgtagcagtcccataggttttatatatagaatcagcatagtatttgattataattaatgatatcatcttaaggacttcatctaatatacttattttgaaaataagatgcaaccatatatttttgacataaattatagttatttttcttcaattcaatgctttgatattttattctgtatccctatcagttaaatgtatatattatttaaagttaagagtatacaagttaaatatctcttattcgaaatgcttgggaccagaagtgtttcagattttggtgtgttttctctttattttggaatatttgcattatatttaccagttgagcatcccaaatccaaaaatcccaaatctgaaatgctccgatgagcatttcctttgaacatcatgttggtgctcaaaaagttttagattttagaacattttggattttggatttttagatttgagatgctcaacttgtatatacagtgcattctgtacttgcatttgaatactatatttggatttgtgggtgtttttattccaaagagctcaaattcccttagtatttaaagcacggtttcctaacatttttagagatagcattgtatggacacttttataataggacaacctttaagtaattttgaaataaaaggactagtttccttttacctcctagggcttgggttttataatcttaggattagaaagggctttaaggttatctgacccagtgcattacagatcttgtggtctatctacagtgccccattaaatggctcttcagcttcagggccttttatttatcaatttaacaaataccttttgaatgctgccctggggcaggcactgtgttaggtgctggacatattacagtatatcagacatggttcttctttttagtctagttggaaagatataagtaaatacataagttgtaaagcagcacagaagaggccataaaaaagcatgaaaaaagacagagccacttaatgtcacaaagtcatttcattttacacagttcaaagtcttagaaagtccttttttctcttgagccaaatactgcttctttaggtctaaataccgcccttctccagtgatcatctttcagttatttcaagatagttaagttatatttctgattggtattgtttgtatgttaatttcttttatcttgcttaaaattggcctaaattacaatttgttaaatatttttggatcttccttgtacaaaattttttctcttggggttcatatagtgcttctagggccaggtgtggtggctcacacctgtaaccccagcactttgggaggccaaggtgggcggatcacgaggtcaggagtttgagaccagcgtggccagcatggtgaaaccctgtctctaccgaaaatacaaaaattagccgggcatgctgctgtgcgcctgtaatcccagctactcggcaggctgaggtaggagaatcacaactctgggaggcggaggttgcagtgagctgaggtcacaacactgcaatccagcctgggcatcagagtgagactcactatatgtatatatatatagcttctgtggaataaatatgccaccccaaaatacactgctttggcatattttgagatggctattcagaaaagctacagaaagaggaatagctctgaaaagctgtccatttgtgggggagatttgcatccctggtagaaatccacactaggaaagtaaacagcagacagaaatggactttctttgagaatcccttatctgccttatttggatttaggaaaaaactaactcaggaaaagagactgaaggtctgacactgttaaaggtgtgacagagaaactttttcaacaggctaccatctattctttctgagggctgctacctgagagatttcatttgtaatacaaaatagcttttgttcagcttgcatttcctcccctcacccttccacaacctgtaagctatcttcccccactctggagctccaagcccctgactcttttctgtattttctgtatggtataaaaacttcagtcatttgtcccttcttagagtctcatattttgtgtggctcccctgcacatgtgcgtgtttataaatttatatacctttttttttgtttgtttgttttgagacactgtgtcactctgttgcccaggctggagtgcagtggcgcgatctcagctcactgcaacctctgcctcctgagttcaagtgattctcctgcctcaggctcccaagtagctgggattacaggtgtccacctccatgctggctaatttttatatttttagtagagacagggtttcaccatgttggccaggctggtcttgaacgccatacgtcaagtgatctgcctgcctcagcctcccaaagtgctgggattacagtcatgagccaccgtacccggtcttgaataccttttcttctgctaatctgtctattgtcagtttgttttatagacacaaattatcaaaccttcagaagggggaggaattaaaattttctttgctcttgtatgttactttttcccccatttgcgtattcttatatgtatctatctctgtctcccaaccctctgatggaattttaaaatatctctcaagtacaaacacctcaaataatccatcagatatgtggtttcctcagaagcttctcttctggattctttcattattctgctcaagtttgcattggtttcctctcttggcatactacctagctctcctctttatacttccactttttgttattctgggaatctcttcaccagtcttctgtattacttttcaattcctgattctttgtatgtgacttgtttttctcctcctttgcctttctctttggaggcctgtaggattttctttttgtccctggtgttctataatttcacagtgatgttgtggtgtggaaatctttctcattttttgagctgtgtctttgcttatcttttttccatttgggtaacaatctagatgttttgttgggagatcaaacaaatatcagtatctgcatgttttatctcttgggccaattggttttcttagagaagaacctcataatctgctcagggagttagtttaagaccagcatcattgtgggagcccagtggtggaagcaggaatgatgtcctcaccatttggtgtacaggttttcacataatgcctctgttttcagtaccactcttcagtcccacctttagctgtttgtagtatctgtctcattccacatcttcagaggttgaacctttagtcttctgcttgtgtagaaaagggtggctatcttgctggctgtgcagtggcatagagtatatatactttttccatgtcctcctgtttttaggagataatttcaggatatacttaaaatctaaaaccttttcacagttttaagggtaaagtttgaacttcaagctaagcctataaagttctttgtgatctagtccttcctttctctattggttcaacttggttcttccccttctggatgaactaagaccacaccacaacatactatgttggctacagcccgttgaacttggagggatacaaacgcatcacatttcacatgtgatgtacccctctacctggagtgccttcttttccttttcttccacaatttcttattcttaattgttgttttctctcagtagccccgctcactttcatctactgtctgatttaaatatcttttacctgtattcctttaccacctcaaacttatctttgatagtgttaccagaaagggatattgatccaaaccccaagagaggattcctggatttcacgcaagaaagaattcctggtgagtccacagattaaagtgaaagcaagtttattaagaatgtaaaggaggccaggtgtggtggctcatgcctgtaatcccagctctttggtattctgaggtgggtggatcacctgaggtcaggagttcaagaccagcctggccaacatggtgaaactccatttctactaaaaatacaaaattagcttggtgtggtggcccatgcctgtaatcccagctacttggcaggctgaagcaggagaatggcttgaacctgggaggtggaggttgcaatgagccgagatcatgccactgcactcctgtctgggcaacaagagcaaaactccgtctcaaaaaaaaaaaaaaaaaaaaaaaaaaggaatagaagaatgccactctgtaggcagagtaggagcatgggctgcttgactgaggatacttaacggttatttcttgattatagaaactgaacaaggggtaggctattcgtgagttttttgggaaaggggtgtgaatttcccagaactgaatgttcctactctttttagactatataggacaacctacaggcattgccatggcatttgtaaactgtcatggtgggagtgtcttttagcatgctaatgcattataattagtgtgcagtgagcggtgaggacgaccagagttgacttttgtcattatattggttttggtgggttttggttggcctctttactgcatcatgttttattagtgggggttctgtgacctgtatgttgtaccaacctcctatctcatctgtgactaagaatgcctgacctcctgagaatgcagcccagcaggagtcagcctcattttacccaacccctgttcaaggtggagttgctctggtttgaacacctctgacaataatatttatctatattatacagtagtttttgatgttatttctgtgccttttccaataagccttcagatttctgaagtgtacttgaccaagtatacttgttgagtaagtttgaaggtaacaaaaagagacaaaattgtgtcttaacatttcaaataatctgtaaatctgtgcctcaaaatatattacacttgaagcatcagagcaagaggatattacaaactgaaaaccgtccaaacattcctgcttctcctgtttccaccttttctcacagagtgtacctgtagactgttgacagaatactttgttgcagtcgatgaacttgtcaatttgagaatgagtattgtgcctttgtgtttcatatgtgctttaaaacattttggaatttttcagaacatgaacacattgtgttcttatactcaataaattttctaggtcatttaaaaataatgttaaattttaatcaataccagaagtttggctccatctgctacaaaagtacaaactcactgaacacatttaaaaataataacatttaaagcttccttgcccttgaggcattttcttctgaattggaatcaggctacctttgacattggcaacttagttggatatgtattgatcgacttaagaatgttgcttctgtgtctgttatcattatgagagaacatttattaactgtctgactacatactgccctgattctataaacgagaactatgtggatgtatttggtgctttttagggacttattttaagtgtatttatagagcacatctagcagcggacagaaaatattaaactagggtatgaatggacagtgaaatagtttacatcagcatcagagtatttggtttttctagcaaatgcaaataaggaactaaagctaaatacaatagactatacttttaattgaattaattttcatctaaatttaacagtgtcaagttatcatcccaggtgaacttcagaattcaaactagaaaaatagaatacatgtattcattatgggattgaatggcatgagccgaacttgggcctataaaaccagaactttagagttttaacctctctttagcataatccgtttatggccttgggcagattcttcacaaaaacagaaaacagacaatcaaaatgagaatgacaaaggtgtggagagatctagcttttaaagcatttggatctgagaagagcctcctaagtggttgtttcttctagctctttagcaattctgttttaaacccaatttctctgtcttttatattctgccttctgctatatttatatccattttccttacaaagacacaccattgtcctttggaagcaggttttataaagtaatagatgtattggcctagaatttgaaaaattatacaaagtaaaattctttttacatacatataaaagatatttctttgataggtttattgttcactaaatcgttaacttcacattttagtatgagacatcattgaggaatggcttatgttcattgacatttggctcatatgaatatgagagattttaaatttgtgtttgtagtttatttattggagaatgacctggattttgcatcactttagtgcaggacttgttttagttatttgtgtaaagatgtgtaatccaaggatctggccaagtgatttttagatgggaagtagagaagcattttgttttttaagactgttttttgagggcagttttagggtgacagcaaaattgagagagagacagagtttttccatgtgcccccttgaccccacccttgcatagcctcccctattgtcaacaacccccaccagagtggtacatttattacaattgatgacctttcattgacgcatcataatgacttacagttcatagtttatattaagatcattcttggtgttgtacattctgtgggtttggacaaatgtataatgaccatgtatccagcattataatatcatacagagtattttcactaccctaaaaatctctgtgctctgcctgttcattccctgccaacatgtggtaaccactgatcttttttttttctatctccacagttttgccttttccagaatgtcatatagttggaatcagtatggaatcagtatgtagccttttcagattggctttcttcacttagtaatatgcatttaaggtttcttcatgcttttcatggcttgacagctcatttatttttaatgctcaatggtattctgttatctggatgaccccagtttacccattcacctattgaaggatgttttggttgcttccaagttttggcaattatgaatgaagtttctataaacatccatgtgcaggggtttttgtggacatgcattttcagctcctttgagtagacaccaaggaatgtaattgctggttcatttatggtgagagtatgtttagttttgtaagaaactgccaaactgtcttccaaagtggatgtgttattttgcatttccagtagcaatgaatgaaagtttctgttgctttatatctttgccagcatttggaggtgtcagtgttcgggattttggcaattctagtaggtatgtagtgatatcttgtttcaatttgcactttcctgatgacatgcaatgttgagtatctttttatatgcttatttgccatctgtatatcttgtttggtgaggtgtctgttagtctttggcccattttttaatcaggtttttaaaattattaagagttctttgtatgttttggctaatggtccattatcagatgtatcatttataaatattttctctctggcagtggcttgttttctcattctcttgacattgtttttcatggagcataagtttttaattttaacaaagtctatcttatcaattgtttctttcatacgagtgggttctgcctttgatattatctcagaaaagtcatcaccatattcagagttatctaggttttctcctgtgttatcttccaggattttaataattttatattttacatttaggtctatgatccattttgttaatttttgttaagggtgtaaggtctgttctagattcacatttttgcatgtggctgtctagcaccatttttgaaagggctctttgctccattgtattccctttgctcttctgtcaaaagcgagttgagtatatttatgtgggtctccttctgggctctctgttctgttgcattgattggtttgtctattctttagccaataccacactgtcttgattactgtggctttataggaagccttggagtcaggtagtatcagtcctccagctttgttcttcagtattgtgttagctattctgggtcttttgcatttctacataaagtttagaatcagttcgttgataaccactagacaatcatttaaaatttttctttatctttaatgatcctaatattagtctgtcaaagaaaaacattgccaatcatatttcactggcccttggaggaatgaaacaatgtaggaatgacgcttttgaattttgagtaaattttatttgtaaatctgttttagtactatcaaaatatgcttattttctttttctaatattattcataatctactcatatcttggaagataaacttaactctggtagcatttgctctgttttcagctattatcacaatgacaaactatgatttttaaaaaaccatcatactggggcagttccaagatggccgaataggaacagctccagtctacagctcccagcatgagcgacgcggaagacgaatgatttctgcatttccaactgaggtactgggttcatctcactggggattgtcggacagtgggtgcaggacagtgggtgcagcgcaccgagcatgagccgaagcagggcgaggcatcgcctcacctgggaagcgcaaggggtcagggaattccctttcatagccaaggaaagagatgacagatggcacctggaaaattgggtcattcccaccctaatactgcgcttttccaacggtcttagcaaacggcacaccagaagattatatcccgcgcctggcttgaagggtcctacgtacacggagcttcgctcattgctagcacagcagtctgagatcaaactgcaaggcggcagcgaggctggggaaggggtgcccgcccttgctgaggcttgagtaggtaaacaaagcagctgggaagctcgaaatgggtggagcccagcgcagctcaaggaggcctgcctgcctctgtagactccacctctcggggcagggcatagccgaacaaaaggcagcagaaacctctgcagacttaaatgtccctgtctgacagctttgaagagagtagtggttctcccagcatggaccttgagatctgagaatggacagactgcctcctcaagtgggtccctgacccccgagtagcctaactgggaggcaccccccagtaggggcagactgacacctcacatggccgggtactcctctgagacaaaacttccagaagaacaatcaggcagcaacattggctgtttagcaatattcgctgttctgcagcctccactgccgatacccaggcaaacagggtctggagtggacctccggcaaactccaaacggacctgcagctgagggtcctgactgttagaatgaaaactaacaaacagaaaggacgtcgacaccaaaaccccatctgtacatcaccatcatcacagaccaaaggtagataaaaccacaaagatggggaaaaaacagaacataaaaaactgaaaattctaaaaatcagagcgcctgtcctcctccaaaggaacacagctcctcaccagcaacggaacaaagctggacagagaatgactttgacaagttgagagaagaaggcttcagactatcaaactactctgagctaaaagaggaagtttgaacccatggcgaagacgttaaaaaccctgaaaaaagattagacgaatggctaactggaataaccaatgcagagaagtgtttaaaggacctgatggagctgaaaaccatggcacgagaacttcatgacgaatgcacaagcttcagtagccgatgcgatcaactggaagaaagggtatcagtgatggaagatcaaatgaatgaaatgaagtgagaagagaagtttagagaaaaaagaataaaaagaaacgaacaaagcctccaagaaatgtgggactatgggaaaagaccaaatgtacgtctgattggtgtacctgaaagtgacggggagaatggaaccaagttggaaaacactctgcagaatattatccaggagaacttccccaatctagcaaggcaggccaacattcaaattcagaaaatacagagaatgccacaaagatactcctcgagaagagcaactccaagacacataattgtcagattcaccaaacttgacatggaggaaaaaatgttaagggcagccagagagaaaggtcgggttacccatgaagggaagcccaccagactagcagctgatctctcggcagaaattctacaagccagaatagagtggaggccaatattcaacattcttaaagaaaagaatttttaacccagaatttcatatccagccaaactaagcttcataagtgaaggagaaataaaatactttaaagacaagcaaatgctgagagattttgtcaccaccaggcctgccctaaaagagctcctgaaggaagcactaaacatggaaaggaacaaccagtaccagccactgcaaaaacatgccaaattgtgaagaccattgaggctaggaagaaactgcatcaactaacgagcaaaataaccagctaacatcataatgacaggatcaaattcacacatgacaatattaaccttaaatgtaaatgggctaaatgctcaattaaaagatacagactggcaaattggataaagagtcaagacccatcagtgtgctgtattcaggaaacccatctcacatgcagagacacacataggctcaaaataaagggaaggaggaagatctaccaagcaaatggaaaacaaaaaaaggcaggtgttgcaatcctagtctctgataaaacagacttttaaccaacaaagatcaaaagagacaaggccattacataatggtaaagggatcaattcaacaagagctaactatcttaaatatatatgcacccaatacaggagcacccagattcataaagcaagtccttcgagacctacaaagagacttagactcccacacaataataatgggagactttaacaccgcactgtcaacattagacagatcaacaagacagaaagttaacaaggatacccaggaattgaactcagctctgcaccaagtggacctaatagacatctacagaactctccaccccaaatcaacagaatatacatttttttcagcaccacaccacacctattacaaaattgaccacatacttggaagtaaagctctcctcagcaaatgtaaaagaacagaaattataacaaactgtctctcagaccacagtgcaatcaagctagaactcaggattaagaaactcactcaaaaccactcaactacatggaaactgaacaacctgctcctgaatgactactgggtacataacgaaatgaaggcagaaataaagatgttctttcaaaccaacgagaacaaagacataacataccagaatctctgggacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagagctgaaggagatagagacacaaaaaacccttcaaaacatcaatgaatccaggagctggctttttgaaaagatcaacaaaattgatagacagctagcaagactaatacagaagaaaagagagaagaatcaaatagacacaataaaaaatgataaaggggatatcactaccgatcccacagaaatacaaactaccatcagagaatactataaacacctctactcaaataaactagaaaatctagaagaaatggataaattccttgacacatacaccctcccaagactaaaccaggaagaagttgaaactctgaatagaccaataacaggctctgaaattgaggccataattaatagcttaccaaccaaaaaaagtccaggaccagatggattcacagccgaattctaccagaggtacaaagatgagctggtactattccttctgaaactattccaatcaatagaaaaagagggaatcctccctaactcattttatgaggccagcgtcatcctgataccaaagcctgacagagacacaacaacaaaagagaattttagaccaataaccctgatgaacatcgatgcaaaaatcctcaataaaatactggcaaactgaatccagcagcacatcagaaagcttatccaccatgatcaagtgggcttcatccctgggatgcaaggctggttcaacatatgcaaatcaataaacataatccagcatataaacagaaccaatgacaaaaaccacatgattacctcaatagatgcagaaaaggcctttgacaaaattcaacaacccttcatgctaaaaactctcaataaattaggtattgatgggatgtatctcaaaataataagagctgtctatgacaaacccacagccaatatcatactgaatgggcaaaacctggaagcattccctttgaaaactggcacaagacagggataccctctctcaccactcctattgaacgtattgttgaatagttctggccaaggcaatcaggcaggagaaggcaataaagggtattcaattaggaaaagaggaagtcaaattgtccctgtttgcagatgacatgattatatatctagaaaaccccattgtctcagcccaaaatctccttaaactgataagcaacttcagcaaagtctcaggatacaaaatcaatgtgcaaaaatcacaagcattcttatacaccaataacagacggagagccaaatcatgagtgaactcccattcacaattgcttcaaagagattaaaatacctaggaatccaacttacaagggacgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatcctcatcaagctaccaatgactttcttcacagaattggaaaaaactactttaaagttcatatggaaccaaaaaagagcccacattgccaagtcaatcctaagccaaaagaacaaagctggaggcatcacactacctgacttcaaactatactacaaggctacaataaccaaaacagcatggtactggtaccaaaacagagatatagaccaatggaacagaacagagccctcagaaataacgccgcatatctacaactatctgatctttgacaaacctgagaaaaacaagcaacggggaaaggattccctatttaataaatggtgctgggaaaactggctagccatatgtagaaagctgaaactggatcccttccttacaccttataaaaaaattaaatttggattgaagacttaaatgttagacctaaaactgtaaaagccctagaagaaaacctaggcaataccattcaggacatagacataggacttcatgtctaaaacaccaaaagcaatggcaacaaaagccagaattgacaaatggtatctaattaaactaaagagcttctgcacagcaaaagaaactaccatcagagtgaacagccaacctacagaatgggagaaaatttctgcaatctacttatctgacaaagggctaatatccagaatctacaatgaactccaacaaatttacaagaaaaatgtaaccccatcaacaagtgggtgaaggatatgaacagacacttttcaaaagaagacatttatgcagccaacagacacatgaaaaaatgctcatcatcactggccatcagagaaatgcaaatcaaaaccacagtgagataccatctcacaccagttacaatggcgatcattaaaaagtcaggaaacaacaggtgctggaaaggatatggagaaataggaagacttgtacactgttggtgggactataaactggttcaaccattgtggaagtcagtgtggcgattcctcagggatctagaactagaaataccatttgatccagccattccattaccgggtatatacccaaaggattataacacatgctgctataaagacacatgcacacgtatgtttattgcagcactactcacaatagcaaagacttagaaccaacccaaatgtccaacaacaatagactggattaagaaaatgtggcacatatacaccatggagtactatgcagccatataaaaggatgagttcatgtcctttgtagggacatggatgaagctggaaaccatcattctcagcaaactattgcaacgacaaaaaccaaacactacatgttctcattcataggtcgaattgaacaatgagaacacatggacacaggaaggggaacatcacacaccggggcctgttgtggggtggggggaggggggaggtatagcattaggagatatacctaatgttaaatgacgagttaatggatgcagcaccccaacatggcacatgtatacatatgtaacaaacctgcacgttgtgcacatgtaccctaaaactttaagtataataatttaaaaaaacccatcatatttacccaaagtactaaatatttataggtatgaattgaattcagatgggatatatacacacacaatacagtattgtattgtagaaatattgatatttacattcaacaggttatgtttgtattaatcaggtttaaatgtagggtaagataaatgtcctttattacaacaatttttatggtacattaatgtttaataatgccctatctttaaattagtttataactaattctctgtggaagcattgtagaatctaaaaatctgaattaagatcagaattaacacaaaaaaattgcatctgttgccattttatgtttttgaaatggagtctcgctctgtcacccagggtggagtgcagtggtgtgatctcacctcagtgcaacctctgcctcccaagtttaagtgattcttgtgcctcagcctcccaagtaactggggttacaggcatgtgccacctcacccagctgatttttgtatttttatagaaagagggtttcaccatgttggtcaggctggtctcgaactcctggcctcagcaatctgcccgcctcagtctcccaaagtgctgggattgcagatgtgagtcactgtgcccagccttctgttgccattttaaaactaagagttaaaagatgcttttgtataattttctagaaaatatcttttatacttattttcttctaactacatttaaaatacattttaaaaagcagaaagcaaaaatgaagtctaagcaaatttcccgtgaatacatttcttttacaataaatgtatgccagttattcagtgttagaattgaatatagttagattcttgagattctgtttttaaaagacaccacagtattttgtttttatatgaagtattatggtaaatgtgatcattaccttaaatatatggcatcaggtttttaaagtggtattttgtggattttgttaaatctgtctcaaagtctattttctcatgttatgtttgaagtatgggtatgatagtacccagaaaaacaggcctttcaaaacaaaatactctacttttatgactccataaaaaatacaatctttattattatccatagactgaataaaacatcttacattttatgtttcattttattcaccataatgcctattttcaataaaattacaggtgattttaaatatgactagacttttttttttaatagaaagatcacataatggcttaagtatattccattaggagtagtatttctcttgtctttttgttcagccattggagtcccctgtgaccttgggtactttttccataggcgaactgatgcttcatgacgttctgtgttttctggtagcttgcctgttgcctgcctctgggttcgtcatcccccttatgctgacttaggcaatatttcttcagtctcttatcttggggctttgatgcatatgttctgaaggtggccacagtgactttgggtagcagcagatggtaaaccttcaggctgccaccagctaaactggtgttaagttggaaagttaacgtttgatgaagaatcagtagtgcatatgaaagaactttcactgctgaaatatcttttaattaaaaattagcatactaaaacctttgtgaatgtctgggcatttaaagaaatctacaattagttgtgttcttatagaagtatttatttaccagtttagtcttatgttacttgctcttcctaacctggttctttttcctctgtttctaccccagtttgttggtagttaagataaatcagataactacataaattgaaatataggttgtttttaggaatcttgggtgtttgcataaacaaagtatattttgaattatggcattttggattttaataactaagaagagatgtggattttaagtacaatcttcatataattctggtagatttggtctgttttcttctacctttgaaggtatttctggatcaaataggagcctgaagaactcaacctgcctcaaagagatatttccttttgttctaaattagttggtgattcttgactctgccgttcttaactttgttaactttgcagaaattgatgcagcgacttctgatgagctaaagctgtaggcacaacatattttgcttttggagttactgagcagtgggtacagggaacattgctaacctttttggattatttgttcacttcatgataatctgctatgtgggaagttctagcacaaatgaaacattggtaaggctccaaaggattttctttgttacccataaatcttgggtaccttatatacttttctcaattgaaaatgtatccttgagagtaatagctgaaaatatcttgtagactagagttataagtatccctgtcaaattttactctttatgcttgaattttcatcagtggaaaacttatgaaaccaaggacagattggtttcatggcataacatgagagaagcatctctgcatggtctgttcatgctaatgctcttgatggtgcagcttctgatggactgaagctgtaggtgcaacatcttttgcttttggagttgctgggcaatggtacagggaacattgctggccttctgatgccaaagaaagagaagttagaccccagttgggagaattgttgatattaaagcccaccgagtactattccttgttttctagtagttgaatttttataaagatgcctcatgagaataaggtgtggaattaagagtagaaacacattttggatgttttaagaatacaaaatgagatttattttagcagaaaatatgaataacatttgataattatgcatggtgttaggggaggaaagcaaagttttaatgctctaggtttgttgttcaaatccatttctatagaaggataacattaccagctcttgtaaatttgcccatctggttaaaaattcagatctaatactagtcaagtatggattacctttgaaagagagtgtagcaagtacaatcatgttcacatgaaagtatgttgggaaaaacttatttgcaaaatcggtctagtactattttctctagtttctttattgtgttgatctcattctttctgttgtcattatttatatgtgaattacggggagcatgacttacacagttgatatctcatccagattataagcagcaaacacaaatccggttatatgtgacaccattaagggatgctctgtgtttgtcctgtagtctttttgtttcttttctttttttcaatagtttttggggtactggtggttttggttacacagataagttctttagtggtgatttctgagatttaagtgcatccattactcgagcaatgtacactgtacccaatacgtagtattttatccttcacccacctcacaaccttccctcctgagtccctgaagtccattatatcactcttacgcctttgcatcctcatagcttagctcccacttacgagaacacatgatatttggttttccattcctgagttacttcacttagagtaatggcctccaccttcatccaagttgctgcaaaagacattatttcatttctttttatggctgagtagtattctatggagtatatatacaccacattttctttatccactcattggtcgctgggcacttaggttggttcggtatcattgcagttgctaatcgtgctgctataaacatgtatatgcatgtgtctttttcatataatgacttctttttctttgggtagctacccagtagtgggattgttggatagaatggtagttctacttttagttctttaaggaatctccatattgttttccatagtggttgtactaattttctatagacttaagcattattttaacttgtattaattgttctggagtcccatgaagtaactggcactaaagtagagacagacagtccctgaaattacccaagtaatctttcttttaaaaggaattggagctgaagttattttcagggacttccagacttccagtgtcaacatttaaattaaatatctaaaaagattcatgaatggggagacactgaatccccactgaagggaactctccacacttcttcaccacagtcgtagtgccttcatagtagcatatctcttttctcttctccatattatttttctttatttgcttaaaaataatcatcatttgatacttttggtgtaccccttctccctcttttctttgcaaagatggttgcctacttaaatattagtcctttcttaattctagttaacaaatagactcaaacctgtaatcagttggagcttttcctactactattatgacagaaaagtgggaaaagtgaaacttgtggaattgaagaacagatgaggctaatccttaaggaataagttgcctgctttttcttttttttcccccagttaggagcagttatttcatgtattagtatgggcaaagatgaagtaatttcttctgttagaccatatgctaatatagggctgataagtaagtgtgaaaaatgaaagggagaaatacattaattgtattctttcaataaggtatgctatccaaggtaattatttcatgacagttttagttatagtacttgttttatcatgaaataaaagattgttttaggagccttttattggaaagacaattgtatcaagctagtacaaattagatttttgtctttataaaggtgagcaaacccatgagcagtttttaaattgatgtgttttagtctacacatgaacaaattctgtttgagggttaaagaagctattattttgtcctttatgctgacagtttcattacagattggcctactgttggcattaaaaaaatgtttggctccttatgatctttgtgcatgcaactataatattaatgcagcaccatagcactgttcattaagaaatgactttaaatgaggttgaagcgtgtaaatttggaaagatacagatgttaaatgcagtcgtttctctttgtgtacagctgtatggctaataatttccaagcagctaaagctcttgttagcaggagtgctggtgtgttaagaatggctctataaataactttaagaactgaagttgaaggtgcttcttttaaagactattgttaactaaacattattgccaaacagatggaaagcattcaccagcctgatgtttttgggtctaattatattatcaccagccctgtacggctcagttgaagaggtatatccagaggccaatttataatcatttagccaacacctgtttgggagaaattgacagtcaaagggcacatttttaaaaaatcacatatgttcttgtgtttattgcctcaatgtgaacgttgtctagttgcacacaaactttgtaggagaagaaagtaaatataaacaaagcagcatttcccagccatgtttatccatcttaatttgcttttttttttggagatggagtctcactcttgctcaggctggagtgtggagtggcgcgatctcaattcactgcaacctccgcctcctgattcaagtgattctcatgcctcaccctcccgagtagctgggattataggtgtccaccaccatgcccggctaatttttgtatttttagtagagacgaggtttcaccacgttggccaggctggtcttaaactcctgacctcaggtgatccacccaccttggtctcccaaaatgctgggattacaggtgtgagccactgcgcccagccggtttggcctttttatctgatctgcttcatgcttcatgactaagtgagatcagtaaggaggtatcactcctgatttgtgcaggtatattttgttgagtcaattaaggggcttttaatagggagaagttctttcctttggttatacagcttccatgccttttacctagtgagatgtgttctactttatatagatatgtcttgttcaaatagaattggctttctggtaagtgacttaaaagtcacacctcatgtaagctgggtgtggtggctcatgcctgtaatcccagcactttgggatgccgaggcgggcggatcacgaggtcgggagattgagactatcctggctaacacggtgaaaccctgtctctactaaaaatacaaaaaattagctgggtgtggtggcgggcgcctgtagtcccagctactccggaggctgaggcaggagaatggcgtgaacccgggaggcagagcttgaagtgagcggagatcgcaccactgcactccagcctgggcaacaaagcaagactctgtctcaaaaaaaaaaaaaaagtcacacctcatgtaaaaacaaatgagacttaaggaacactaaatgtcttcacagattcaacagatgttcaacagatatttattgagctctcctttgcagaaggaaggccatggtgcctccttttacattcttgatatgttgatttaactcttaaagttcacaaatgtgttttcatgttttggaggctcaagatttgtgttcattgtaactcaaagggcagctatggagagaataagtctatcctatctgaaaaataataaaagtcaaaccctttgtttcaactgatgataccactatttcattttagtgtttttccttcttctgacagactttactattgaaaggcttatatatgtcacctctattttcttatcactcattatgaactctgtgcaatctgcttttatcctcagttcattgtacagtgaactgtacaatgctgtattgaaagttacacatgacttcctaactgccctaaccagtgatggtttctcagtccttattcttcatggcttctctctgttgtttagcatagattacactcatcttaagcattctctttctctgtcacctgaaccactatgttttctctttgtacttttctcattacacttttggttattgtcttatttactcacaatatttcaactatgtatattttcaaaattcagaaataaatagtatcgcttagcaattaaagaggaagaaacctggagccagactaccctctaccacttattatctttgtgagtatggacaaagtcctgaggttaaagaagttccagtgtttcagagtgcactccagagagtacaatcagttttatgcttatttccttatctgtaaacttgattaataaaagatacctacctctttggattgttgagagaattacatgatttaattccttaaagcccagcacagtgcctgatataaaggaagtgtcccagtgggattcattcttgtgtctttagtttttatctttatggagaatgctcaaatataaatcattagtaccgacttattttctaagctctattcccatgtcgtcatctaccttacaaacttttagagttgaattcactaaccgtatgtttattaaacatttactgtgtgagaacagtgtgttatgtgatagaataatttttatgctgttggttttctgttgctgacataacaaattaccacaaagttggcagcctataacaactaaattattaaagttctataggtcagaagtctgacacagttactgggttgaaatcaagatggtggcaagactatattccttactggaagctcaggagaggaatctgcttccaagctcattcaggttgttggctgaattctgttcttttcatagagttgtaggactgaactctgtttctttgctggctgtcagccaaggactgcgctatactcctagaagttgcctaggttccttcttaggcttgctatgagatcctagaagcctctctccagttcttgcatgtgggcctttgccacctgagagccagcagccatgcatccctttcatgctttgaatatgatttccctttcagccttatcatttctgtgctttgcctttcttttcatagacgatagttctctgtttttgaaatggattcatgtgatattttggaacccacccagataatccagtgtaatctctctgttttaaggtctgtaccttaattacatctgaaaaggcttttttgccagtaacataacacgttcacaaatgttggggattcttggggtatgaacatctttggggcccattatcctgcctttacagcatgcccataaagagctcgaagtctcactgggagacagacccccaaatcgaagggttagagattctataatagatgttggtgctgtgtaaaacagcagaagaaaggaagaaagtagtcagtgttactgagagctagagtgacatttgtgctgcatatggaaagatgcatacttgtttgataagtgcctgggggaatatttcagggaaaaacaagcaataatagtgatagcagtaatagcaactagctgtacttttataagattatcttactgaaatcctcacaagtgttagatactgttaccgactattatagcttctacataataagaatgccttatgtccataagaagacatgtctgtagtgtcttctaatgtagaataggaatggtaaaattatttcactgagccagacctggtgacttatccctgtaatctcagcactttgagaggccaaggcaggaggattgcttgagcgatcgcaggagttcaagatcagcctaggcaatatggtgagacccctgtcttacaaaaaaaaaaaaaattatccaggcatggtggcacatgcctgtagtaccagctacttgggaggctgaagtgggaggatcgtttgaacctggaaggttgaggctgcagtgagctaaaaatcacaccagagcactctagcttgggtagcagagtgagacccagtctcaataaaaataagataaaacaaaataaaataaaataaatcattggctttttgggaggattaatattgattacacctgggtaaagtatagcacatagtaaatgcttaaaacatggcagattagagaatacagggtggataagagaagtgcttaggaggtagaattgatttgattgatttagaattgattctaaatacttggtattcagaaggtgctcagtgtataattgttgaatcctggatcagtcacttgttctgaaggtgggagacaggagacagttcagagtaacttagaccacgtttagtttcagagcatgcatggaagatggtcttagtactataggaggagcagcaggctgtttgtttgtttggtgaaggcagggccttgggaagaggatatgaggtacctgtgagaatattgtattgaaattaatggaaatttaaatagtgtaggtcaaacagaagacaaagatgaagttgtcactattttttcaactttaatatctaaaatggaattttccatcttctcgaactggtttcccatctcaacttccttgtttcttctcaccttttaaaaattcttctatttttttcaagcttaacatctttttttttcatccttaaattctgtctttccttacccagtggtgggctggtaaatgtttgacagccagctctctggtagggggaagaaggctcatttgcagtgtttgctgatttctgtagtacaaatcctcctcccatggccaatttcagtctgtggctgcttttgttctataatgacaaagttgaaaagctgtaacagagactgcataggcctgcggagcctaaaatatttacagtctggccctttaaagaaaaagtttgccaatctttgctacagtagtttttccaaaataataaagctttaatagggtaggataatttcatacttctgttaatttattttatccatcaagatgaggggtgggaatgagtagtttaggggggcaatgtgtgagaggttatgaagggtcttgaggtcattttatgggcttaagctttttctctcagtgagataagaagagtgccatgttctaacttatgttttaaaaagaaaaccctggccgctgttttgaggatagacaacagggcagcaaagatggaagcagggagatcagttggaacactgtagttacaagttaggtaagagttgatctttgcttgaatcagagtaataactgtggaagtggtaaggtgagttcagattctggatacattttgaagacagagctgacaggatttgccggtggtggaaaggggtgttaaggtgaatccagggtgaagagataccaaaaggatgccttaggctagagcctgagttattgagatcacattatagcaagttgctacataggagattttaggaagaaaattgagacttgaacaattttttttgaaccacttcctgttgatcatatatgttccaagaggaaaaactctgtttaaaatagtatttcctttacttctaagaaatacattttaaaatactttaggaaacagtaatgtttctaaaatacggcatttttagaaaaggaaaccataataaaacctattttggataagattattttgatcctataatttgctgacttaaaaaaatttattcagaaatgaacaattttggggaggggattaaatttcagccctgccctactcttaaagtttagtttaaagctaagagttaatgtttcattgtattgttaataaattattactcgtgtcttttatgtaggttttacttgtaatggacacaaggacagaacagactttcattttaaaagtaagtaaaatttgtagccaggcgcggtgcctataattccagcactttgggagactgagataggcaggtcacctaaggtcaggagttcgagactatcctggccaacatggtgaaaccccgtttctactaaaaatacaaaaattagccgggtataatggtgggcttctataatcccagctacccgggagacttaggcaggagaatcgcttgaacccaggaggcagagattgcagtgaaccaagattgcaccattgcactccagcctgggcaacaagagtgagaccctgtctcaaaaaaaaaaaaaaaaaaaaagagtaagtaaaatttatatgtttaatgaatttaaaatttgaatttcaaattatgcttctgaaagaaaagttaatattttagttaatatttagttaatattaactaagtagttaatatatcccccccctaggttttgaatgtccttttatgttgtttctggtgatgtttatttacttttctttctatcctttcatcacggttgatagcatgcatttaacaacattgtttttgatacagagtatggaggaaataatttggataaactgaagaaccattttgtgttgtttgaatgtgtagtgtgttgtttaaatacatctcaagaacattttgtttaattgtgaagactacacacagtctcaccttcgattatcactacagttcttaagagctaaaattttgccttaaaatctagttacaggtattttgggaaagtgtatctacattcctggtcctctatttgatctaaattcaattttgattctatacataatgcaatttataactaaatgaataaggagagagagaaccctcaattttgaaattttgaaattgtatttggaatggactgtgatagtacatattctgaaaatatcctaatttaagcatttccacagcattcagaaggtgaatttattaattttatatttctttttctgttgctttttcttttgctgataaggcatggcagtaggtcacattgacacatactgaaacacattttgtgtgtgtgtgtgaatatactttatcattgacatttctttaaaaacagagtatgacaccagaaaatagacaaaccttattccttgtaagaagacttaatattgtttgtacttttgggggataggattttaaaattgcctgcttaatctaagaataccttttgtgtctcaggagtttgcattggtcttacaatgtctactgctttaaagatatagataagtaaaataaaacttaagaaaaggtcacagagaaataactgtgtgtcatcctgatgacttagtttgagagcatctctaataaaaacactgacccacgtaattgattttaatggcagctttgtggcatcttccttctctggattcacgccagatgccatcagcagagcctccagggactggggggcatagagcagcagatgagtggtttctctgaagcccagagtaactcggatagattagtttggttgataaacacagagcacagcaggctccaaaggcaactgaggatgcaactgaggatacaactgacctttttgttctctgtcagggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggttggtttgtagtttggattgtttatgcagtgaagaatgtcacctacttagcttccagtttctctctgtcatttcatgagcagatagaatatatgaaacacgtttaagaaaccatttcctattcctctgctctacctccctactttgagttgtgagggaaaatgaaaacccaggtgaacaacagatttcatgtgaactatggtaccatttgtagatttacttcactacttactttctcatggaatttacctaatataatgagaactttaatatgaatgtgtgctaagagagctagattttattttagtggtattttgttcgcttgttccctgctaaaaggatacattatgttagatgactaaaatgaaaagcatcccctgaagaattaattaattacctccttcttttagaaggcaagggtgttggcttaacatttgacattacctagtcattctgatctgagtttttatgaatacagccattggcatcacatatgggtacaaagcagaggcacagttctctgccttcaaactatttatgaaatttcagctctttgtagagggaacaggtggcaaaaaatataatgttttgatttttttttgccctttaatacctgaatttaaataagtagtcttttatttaggatgactgaaaacagcatataaatataaattcatttaatacatattgccatttggcttttaagaggtgttcgtaaaatagtaaaaaatttttaaattgttttccgtatctcgtgaaggcattgttatttttgtataactattgtactttactaataggcataacatttgtatttaatataattttttaggaaaagaagtcattgctttctggaatgaggtctcatgataatgaatgcaagatttttgatgggggcagtaaacaattaatattgtttattgtgaagtacagcacaagataactacagatggagggaagacctccatatgcagtatttaataggaaattcaaaaggggctctgtggtctctcaggtattaagagagttaattgtgtgtgtgaattggataactaattcacctttgttcagacattatagacagcttttatctgaggataccagtgcattacagacattattgaattagaggtcatgtcatctgatagcgaaatacagccacctctggtgtggaacaaaataacttgcgtagtaataatccataataatttagaacaaggtcagtaggatgaatgtaattatagtcaatattctattacccagtgtggattattcatgttggagattatctatggcaaaattttcagtcttaacttacctgttatttgtagcaatatcttcctcttcttcctcttccttctccatatcatttttcatttttttctaccatcttctcaccatcccatatacctcttgaaactgatgtttcaattgattttacttgaataatgtagaaaatttgtataatctcttaaaatcatagacttacgacttttaaattttctactattttagatccttctttactatcgagcatacctgactttgaatgctcacatgaccataaaatttgtctcttttgaccattcattttaggtgtctattgtttatttttaagatggttttataatataaagatagtaaattatagtgcaaatagggactctggattaattaaatattcagcaaatttattgagcatgtactgtagagtaggctcctttttaggtgaacaagacaagaaaattctctctctctcttttttttttttttttggttggggggtagttagggtcttgctctgtctcctaggttagagtgctatggtacaatcatagctcactgtaaccttgaactcttgggctcaagtgatctcccacctcagctgggattacatgcgtgcaccaccacatctggctaagttttaaaattttttgtagagattgggtctctctatgttgcccaaattggtcttaaactcctggcctcaagcgattctcctgcctcagcctcccaaaatgctgggattgcaggggtgagccaccacgccaggcctgaaacttaaattcttgttgtgaaaagtcaaacagaaaaacaaaaagcaagagaacattggataataaaaggaactatacagatctttaacaaagggagatctaatagataacaactgggggactatgttgaattaagtagtagagggagccctctctgagaaggtggcatttaagagaagttctgaatggcaaaagaaacaatcatttgaatgtaagatacaggtacagggatgagtataaaaacaaacttgggatgtttgatgaccaagaaaggtatcatttggttggaatggagcagagtgaggacaacgtgaggcacatgttggtacgtgaggctgttggagaagtaggcaggagccttgtacagcagagtaaggactttgacttttgttcaagtgcattgggaaaccattggacttcttaaggggtgacagaatctgatttacattttaaaaaggtcactggctcttgtatggggaatgggttgtagaaaggcaagaatagaagcagtaaaaaggctaatacaggaggctagtgaaaaggtgctgctggcttggccttctggggcaccagtcgagatgtttgagggtagagtaatgggacctgtaatggatttgagattaggaagaggaaaatctacagtaatttctcagatttggcttgagcaatgcagtgaactggatgatgaacagtgtgttttcttttacacatcagtggcacctccgtagattaggaagttggcctgtgtcatagaaaagtaacttttcatatgtgtgaatagttattactgagaaagcaaaccttgaacagttgttttctccataacatgaatgctttgaatacttacgatttgtggctttagctttccactgcttacagaactactcatgatttatgtgagtctcttggactctttctttccatttttaattcatttcattagaaatgtattgagtgcttgctgggacacagacatagttctaatttggcagtgaacaaaacagaagactttgcctgcatggagcttacattacattacattatagaggcagaacagacaataagcaaatatttaagtaaatatatgacagatggaggtaaatatgctatggagaaaaattaaaggaaaggggaagggaatgccaaaggggtgagaggggtggtttgctattttatatagggtggtcatcttattgagaagggacatttgaccagagaccttcaggaagtgagagagggagcattgtggatatgtaaggaaaggatgtcttggcaagagaaaacaaataggtccacaggcttagaggcaggggtgtgcttggtgttcaagaaacagcaggatcagtgtggctggagcagaacagaaagagcagtaggaggaatgcttagagaagtgaggaggcaggcaggcagatcctgtatagcattgtaggccacgttaagaactggacttttattctaaatgagataagatgttattggggcatgctgagcaaaggagtgatgagatagggatcattggcctgctctgtggaaaacagaatgtaggagagcagaaggaaaagcagggagaccaatttggaagttgttgcagcaccccaggtgaaaatgctgatggcttggacaaggtattagtgtgtaggtcaggggtctccgggccacagacgggtacctggaggtgagtggcggacaagtgaacattactgtctgagctccgcctcctgtcagatcagcagtggcattagattctcataggagcacaaaccctattgtgaactgcacatgcgagggatctaggttgcacactccttatgggaatctaatgcctgatgatctgaggtggaacagtttcaccccaaaacactttctacccccacccacacccctgtccccatccacggaaaaattgtcttccatgaaactggtccttggtgccaaaatggttgggaactgctggcgtaggtcgtaaagaatggttattagagtctgaatgtattttgaaggtagaacggcatgattctgttttacatgatttcaaagtttttggctcaaattgaaataatggagtttccatttgctaagctgtgggagaagtaagtttagaaggaaaatcaaggattccattttggacatgtgaatttgagattcttattaaatattcaggtgatgtttagtagacaggctatatcagtcaggattttaggagagaggtttaaaatatttactattgcttttaataaagccctttcttaaactatttgagagagaaaggtggggaaacaaaatgtattcagtcaaggccatgagagtttaagtttctaagattagggattatataatattcatcatatgtatgatgaattagcaaaatacttggtatttagaaggtgctcagtgtataattgttgaatactgggtcagtcaaagatgaaagaccaaattaaaagacagaagttgcaaaagtctctgactgtggatatacaaaacagaaaggaggtagaaaagaatttctctccaagttacttaaggccccaaggagtaaaatgattcttttattaattagttttctaaaattataaaactaatttataaaataaattcaaacaaaatagaagtctataaagtaaaaataaaaattatccctccctattcactttgttgcccagacctattccccagaaataggtactcttttaacagtaattatatatcttccaataactttctatgtttataaacattcactccctatctgtctgtttttaaaaaacttaaatgggtgttacatattgccttgagcttgcattttttcccccatctcaaaagtgtaccttggacgcctttagtatatctttatgagtatatttaggtccatattaagagaggcatacactatagtgattaaaaataaggactgtggagccatgctatgtgaatgtaaatgctggctcaccattactagtgtgactttgggaaagttatttaacctttctgtgtctcaatttcctcatctgtaaaatagagataatattaattacctaccttatagggttgatgtgaggattaaatagttgtatatgtaaaatgcttagaatagtacctggtacatggtaagcactatgtatttgcaaatggctattattaattgatatttaaattgtttccagtactcatataaatacatgtataaacatgtatttatacatacatgtttttgttgtattttttgagaattatatgtaggacagatttttttcaagttgaattgcttggccaaaagatgattttgattactgtgatagcagtgttttatcgtacatatgaaatttaagtcctaattctgaccaagcaaattaacaaacttactttgcaatcttatagaaaaacaatagacttaaaatctgaggagagacaaagagttttaattaaacattatgaattctaatttttaaatcttaaaatggttcaatatctacaattttatgtgcttcaaaaagacttagaaaagtatcatttacagtcttagagtgttaaaaattagacaaattttatgtaccttagcaataacaggttttttttaaggttaatatatgtctttggaagaacgtacggcccccaaaatgacattatacttatagatccttatagattcttacttatagattcttttccttgaaaggttttcaaaaaatttgtacagatgttatctttttataactcagtttaataaatatttaatacctgttttacatgctagatagaatcctctgcctgcagctattaagactttacagtctcatgaaggagataataaaagcataaaagtaatattaatatgatgtaaatgtcataaggagtatgaaggtggatgatagaggattgagagaatgtatatatgatgtccagttaagggatacaaagaaattggtaaaagagaacagattctgaaggaccttcaagaataggtaagattttcacaagtggatactggggaaactattagaaaaaaacattccaagtgcaagcatggtatggggaaaagcccattatgaattctttgttgagtagggggagaggaccaaatcatgggttgataactgtattactcaggagttcaaatgcctatgcggagttggtatatgattcagtagatggagggaacttggcttcttgaatgcagaaatggcataagatctgtgctgaaatagaagattaattaggcagcaattagtagggtagagtgatacaagagggacttaaagtaaggatctagtcgtagttatagcattatccccaaaaatgaagactttaagtacattgaattttagatttcagtagtttattcaggtggaattggcctaggaatgaatgaagcttttcttagaactttattaaaaggtaccatttcttgctggtcagtggaactttatggattgcttatacggtacatctcatcatctgatttaacaagcagtgacttttatgtcctgcacattgtgtaggcagtagacatacaaagatgaaaaagacttgatcctttcctcaaagtagtcatcatctaggagaattgaaaaccacccaaatcattttatttggattgcatacaagaatcttagttttaggttcaagcattgttagagtgccacaatataggtatttgtggtaagagaatgtgagtattgttgtcaatagactaaagaatatagactcaatgcatagctccttttaaacttcagttgaaatatggagaaatgtgaaacactgagtataaagaggacagaaagcattagctaagaaaaaaatgagaggaaaaagttaaatgccataatatcctgtaccactaactggtatcaaaatggggaagatgatacaaaaattagctgggtatggtggcacacgcctgtaatcccagctacttgggtgactgaggcaggaggataacttgaaccgaggaggtggaggcttcagtgagctgagatcccaccactgcactccagtctgggctacagagtgagactctaagaaaaaaaaaaaagttaaataaataaaatagagaaggtggttaactagatcgctgctacaaagaggtgtatgagaatcctaggattaatattatgacaattagcctttattgagcatttattctatgctaggtaccatgtcaggtgctatgtgtatttattgaatttctcaaaatgaaatgtgaagtaggaagaggtatttttgatgtttccgttgacttttttacacatgcaattgactgtcagtggttattttccttaaggtttaggtacccttggcatatgatgcttaatgattacaataaatatgtgctgaaaaattgtcttctttatatgaatagagggatttatttttaacacattattcttaatttttcatttctttgcaactacaattctgtctccgcaaagtatacttctgtagttactgcttttgagatttctggatcaaatttaattaattattctttcttataatactgtttctaatcactactgttatagcaggtttttggtacttagccataattgtttaacgtaaaagttataattgacaaagggattgaggtgttttaatggttaaaataaaagaaaactatggtgaaataataactacaagtattgctgataaaatactggattttttttatttctctgatttacatgaaagtgatttttatgattttagttttaaagatatatgtcagaatacacagtcggaatttccgtagcttgctttattaatggttgcccaattaattttcctcagtagctttacttatataacatattacatgtaaggctgggcataaaaggggaaatattaatatgtcatttataaaggcataattatataccacatgccaaattcctccaatcctggactggacattttcaaaatggaataatattgttgatttttccccccattgtagtatacaattttaaacagcacttatttatgtatttccacttgaccaaggggccatgcgtgaaaaaattattatataaacagaacagaacataatcagatgtttctaagactaaatgatatttaactttagagtagaattttagctgtgaaatttcatactagtatgtgttataactaatttcccttcaaaggaagaaataggttgtcacttaaaaaaaaaattgatatcaggagatatgcttgaaaccgtactcaccagtcagcaataacaagcattttattaaatatgcttatcttatggcacacgatattaatggatattattgacttgttttgattgatttttaagatagtttttgtttttctaatggcttaaataactgtcaatttggagatcttaatacttttgtttgttttgttatacttgttcacaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggtcaggaacttttgcaaatgcatttctttttattcgctgttgcttccaattaactgagtaggcgttttatcttgtaattagtatcttcatttcctgtctagagcttcattatcagtgcagcaaattcacccccagtaatagcttctagtacttaatgatgccattattcttaatgatactgtttttagctacaaaaggagtaattacagttcacttctgcagaaaatggaagagaaaaatgttttgatttctcctgtcgttttgtttttaggacacattcagctaacgtattttagcaggtggagtgaggttgaagattcctgtgacagcgatgccatagagagaatgtactgtgccccaggttagagcaatctcctaaaatgtttcacttgaaaaagtggttcggcagctctcatttctttatagaagttgtatttttgtattgttcactagcagtttacatatgtgttggatttggttatctgtttaacccttcaaaaaagaaaatttggggctaaaccaattaagtaattcataggtatatatgtgtatatatgtatgtgtgtccacatatttattattgttaaatgagtttaatacctcattaagaactgcagtgaattcttagaaatgtcttaacttcttagtgtttacaaggacctttaaataccctgaccctctttagatgcatgatttttttctttctttcttttttttgagacatacctcactctgtcacacaggctggaatgcagtggtgctgttatgtctcactgcagcctcccaactcctgggctcaggcagtcctgttgcctcagcttctgagtagctgggactacatttgtgcaccaccatgcctggctaatttttttaaaaagcattttttgtagagatgaggtctttctgttgcccaggctggtctagaactcctgggctcaaggtgctgggattacgggtgcatgccattattcctggctaattaaaaaaatttttttttttttaaatagaaacagggccttgctgtgttgctcagactggtcctgaacacctggcctcaagcaatcctcctgccccagcctctggaatagctgggattgcaggcatgagcccatggtgcctggcacaatggaggttttaaaaatgcaatatgattttagtgatgtgccaacctggcattttataacaaatttttatagacaaaacagttttatcttgcctttactgtattgtctttattttttaaaaattagagatttattctgtgggtattagatcttttattgacaattataggtagcataagcatatgaattgcatttgagttggtttttctcagtcatcagtgcagatggggctgtattatgaatccaaagtttgttcaccttttgcttaccatttagcctctttggatggccagagtcacttcacctgttgccccattggccttcaaaggagtttcaagctgatttttttttgatatagtctgcttaggtgttgatcaatatagtatttaatacttaacagctaactagtgtattgatgctaaccttgtttctctgcataatgggaagtgatgataataaggattaaaagagctagattgtttctagttacaactttcattgttaagaattatttctgcagtagagaataccaaagttttccaacctataaaataaatatcctaaaacgttcctgaaagcaactattagggttttcttttctttcctccttcttccttcaaattaagactgtttggtttttgtttattgttagagacaatagagcacacttacatttttttttctcaaatagataatgtgatgttatgttttgaaatcatgttagtaaataggataaaaaattgcatgttgaattcactttattacagttactcgattaaaaaaaaaaaccagatcctccccactttctaatttgataagaaataacattttaggttccagtgtacttagaaatatatttgttaattataatgaatttggaagttttagaatcaaacttaatttgggagtttttttgagtcaagcctgttacatgctaaagtgaagtacagtgggaaccatataacaaaacaaaaccacacatttatggaatattgtttaatatttgtaagtagtttcttatttcttatttttgttgttactttcttttttttctcctggttcctagtaagtgtatatattgttacttattggaaactatctgtaaatttgtgcttgaacattctagcagattatttttctttattctcaagcacagtcatatttactttaatatccataacatgttggtatcctgagagttttaatatatgtggaacagaaccatattacattcatcaacagatacacactttcaatttcatatactgaaataccgaatttaatacagatcggtttctaagttctaatttttaagccttgtcccagaaattacaattctcttagttgaccagcaggtggcagtctaccattaatggattttgctgtcctcttccaggttgtccttcactagcatttgaaaaaagctgtagtctgaagaggtgctttgttgtcattatttgcataaaagaattgtacttccaagctttgtgagttgcaaaagtgttctagtgttgtggcatgctttgtgaacaatgtggaaaggctttccattcattgggcctgttaattttagcaaccaggtaaaacaaaacgagtaatggccttaacagaaaagtaataccagtgttcttattaagatgaccttaaatctagagagttatagaacttggttaagtctatgtgctcgtaccccttacttataactcaagggaaattggagcaaaaatttgtgaattactgtttgctccaaaagttcataggcagtgctactgataaatcaaaactacagataggttttcctctcctcaaaggatggaagcaatgataatatgttaatatttcaatacttaaaaatacaaatcagtaactacatgggtcatagattgtttaaccaccttttgatctacccttaggaacactaaaggttgaagtaatttcctttcatgtgatcccctccctcttacttcccaagtctaaccttagtattattgtccaagtaactctaaagcatgttaagcagctgatgtttggttagaaagaaaagttgtcacaagattatgatgagagcaactcacttctgtttaaacagtgtgcaccctctaccctgccacttcacctcctgggaatccttatcacatatttgtcctgaaaacattatccacctgccctgtgctttataatatcagcagtatatctttttatcttgtggatgatgtgcctttatattttgagaaaaatttccagtaacagatttgatttgcatggacagaaacttgagcaaatgccaaactagcaggggggccattattctgctctataaataagtttaaaaaagaaaaaacacacacacagaaacctgtgaatcaacatgttttggtctaattgaggggaaaagcaagacagataaattttgaaatgcaaatgatcaccttctgttatttaagtatagtttctgccaacttagtgatcctagattttaaaaagtcataattatttcaacaatgtatactcccaaggatgcccaagattcacaagtttctataacaaaactgagaacttttaaaaaagttgccacttttttatattaaagaaaacaaatccaacaacaaaaagacaaaaaccatggagctttctctggctacatctgtgaaaaagccagcgcataaatggctgcagctgcagacccatcaagagggtcttgagaatacgaattcactgatcaaacccagccctgttttcaaagtagaagccattccttttaggttcactttgtatccttagattatctaggatgattctctagaaaggttttattttaaataaacatcattcatggtaaatgggttcctttcataccacagaaacacagaatggagttcaggaagagaaaaggcaaaagaaatagtccacaaagtaggaacagattgtatagcatgacaatataaatataacactgtctggtttccacattaggagacttgtagatactttattaggatacttttacacaggttcttctgctttttttgttgtgagggattagagaataaaaactggagtaaattggttatttttctctggaggactttcttctggttactctgattttatatctgtttttacacacatacacacaaaagttttagccaaaagattttatgtgctttatcatttgatttattaacttatgataataaagaataaacctttgtttatagtgttttaagtataaaggaaaaataaaatgtcaaagtacttttttttactactttttttcttgactcttatcattcaaaaacagctagaaaatagaacctgtactactaagcatataaaatacaaaaaaaaaactgagtctgaggtgggaggattgcttgaggctgtgagtatgagactgcagtgtgctatgatcatgcctgcgaatagctactgcactccagcctgggcaacatagcaagaccttgtctcttaaagaaaaatacaagaaaatgatatttgaaagcttaatatacaatctgagacaagtgcataaaattatttgtgttagttaacctaatatagtcacttaagtttcccattctagtcttgaacaagttgatatggtatcctatcagtgtgtgtccttcacttttattttctgccctattatgagtctttaattttaaatgcttgaaatttacattgatatttgtcattgaatacttttcacacttgagaatttataggtgcatatgtgtgtaaattgaagaagtccaaaatgcttttcactgcagcccgatctccatgctcccagatgtcaaatgacagctttgcttcctctcttaggcaatttcacacttggaaacagctcacagctgacggtgaaaagtgaaacatagaaaaatcatgctgaaaactatctgtaaaaattcagttttagagcatgacatttattgactacctttctttgctctcctagcctgactttatcaaataatccatgaatatattttggggaatagtttcccctgcccttctccataaacatgctttccatggcatttgtttctttttaggcatggagctccatgtaatagttatgtatctgataattaaaactaggactcagaccatggatggagtttaaaatatcttgaggctatcagaagtttttaaggtttagaacatttagatggaattgagaactaccaaacctgcatattgtcccagatcatgtattaactgattgcttgacctcgggaaatttatttaagactttctaggcctcagtttaacagtagtaaaatagatttgttggatataagtaaaatcacagatgtcagatcatctgacatcctccttacacaaaatgtactcaaaattgaagttcatcatattaaggcaggattttccccccaagggtaaatattgatttcttatctaatgttagtagagttaaaaaattatttcattaggatgactgagtatatatttttactcatttatagagtttgtacataaagtatatcatgtagaaataagggatttatggaaaatactttcatttagaggaatgaagccaaaacaacttttgtttggggtgaaagttgaatgtcaagattctcaacaaacaaaattgtttaaataagaaagaaatatttagatgtgataatttatgggacctgggtaatttcagcaaacatgagaaatctaattttaagaatgtaagattgatagagaaagcaaataaatatagatgtatatttcaaaataataatgacataaccaggagatactactttttttcctaaaacagaaagaaggtggcagcaagagggaactataggaataattttgagtaaaatatttatggttaatatttaaatattatgtttcagacagtaactgttttatttacccttaagcaaaacttcagcaatagctagctatcttgtacatagtattttaatgttttccttgaatgattaacaagtatgtttagtcctttgccctcagttcttatcgtcataaaaaccaaatctatttattcttcaggagaaccagttaatttttcagtttgccatagaatagtgagacttttccactgaagaaaatttcttgatacacttcaccactgtatatccatgaaacttgtaacgtgagtttagagtacaagcaaaaaaggcctcaagttaacacaagtcttaccttgtctaggcaaggcccttgtggtgcaaagaagattaaaggatcactttaggaggacttgagggtctagaatgctggaatccatgggccagtcaccatcacatctcagttaaggttgctccatattgaaacagactattctgaaatcatgattctcctatcaagccagaatgcgatttgtctctagtggtgagaatgagacaaagtaagagcaaagaattcagtcccagttatttggcatcttagcaaatgacacattagcacatcccaagagaagttcaatgaattgatgttttgatacagaagaggtgaaaaacaatgtctctgtacatttcataatactacctgatatttggagtgaagggtttatgtcaagctttagattattaaaaataagttaatcttaaccttttatttaccccaaaccttttttcttgatgatcttgggcaaatttctttttcagaagaggaacatgagactagagacttatagtttaaagtattagctacagtgtaatgctttttatttttcgtatctcagttgacttttgtcaactattcagtaattggcctcaccactgcattattataaagaagaaagtgaactgtcttttgcctttgatgtttaacaaagatgtaatactgagtcttaaacattatataccagagcaattggctaactatttttatcaaatcatcagtttctgtatcccataacattttgtaaattttaatctccattaggttaccaggtcttattccttctgagcagttcttcacaaattcttccttcgaataaatgtttaaaaatgctaaggtttttaaaaatgagtgaggataaggcaagtaggatttctgaagctcctttaatagccatgcgtgtagctctctgcctaacacagcagcagagcggcagagagagagcgcaagcaagcgagagagctatgcctgtcattctcacaattttcagttagcctttttctcatcaatcaactgtaatggctttggttgggtaacactgtgacacctgatggctactcagaatggagttgttgtgatatgatcaatggaaaatggggcatgctgttggttttttcctactagaaatacagggtgagagagtaagcaagattgtttacagctcagaattataatcggtcaaccagaagtcatgtggtagttactcgtttcttattttatctcacaagaaaaccgtatagtaatgatacctataaactcccttgaacaagtaattcttggctctggagtgccgaatcaagtgaaattaaggagttttgacttaagttgtacagataattgcaggaaagctcagaacatggttgccaggtcaccacgacaacaagaaattcagagctaggtagtgggagaaaagtggaattagacatgtagccaagcctagcctgaactagctgagtgtggtctgcactcacgtccagttccccacaatacagcaggcccagggattcaggtaattgaattacctaaaaaccaactgaataaatgatgaggtggtggcaggaagcgaggctagagactgaggtgagccgaaaaagcgaatgcgtattagggtggagcagcaccacatatcccctgtcaccttgcagcactgggagaagagtgggggccccagctgctgcagacttctctctctggaaagtgccagtctctgtcattggtcttctctggataatacgctaattagagtaatgtgattccaggaactttcaaacagttcatgtaccctgctcaacaaatacagcatttgaataagcaattgagtacaatgctggaggactttatggaatatagaatggataattaggcagtcaatgttttctgaaatagtataaaataagaaaaaaggagcaaaatgcccatttgaaaggatgggctaggaaatgaaaattccaggctctagttagtctatcatgtaagaatgaagatctgcctcagaaatgtgagactatagggaagtttcttctgtctgacttgactcatttcaagtacaaggtccctgtgaacagctttgcgcctttgaacttgtaaactttaagctattaaactttgatgttttagtttataactattagaggagcattccgaacctggaattaaaatgaaattttattctcatagttgctatggcttttagttttgctttcggttgtaacattttccattgtcatatacaaaaacttaaaaaaaattgtctctgtatttaaaataataccatggctaggtagtgtagttgtcctacaatacatttaaatgaatttgtttttgataacatttaaaaaatatttgtaattgatacaaatgatctcaccagcccaccagccaaatagaaccagcttacaaatttgtggcacattttatggaattaggtgcctaaattcctttaattgaacagggatagaaaaaaccttgagttatctcccagtcctgtcttctttattcgcccaggtttttcagcttttttttttttttttttttttgagacagagtcttgctctgtcacccaggctggagtgcagtggtgtgatctgggctcactataacctccacctcctgggttcaagcagttctcctgtctcagtctcccaagtagctgggattacagatggccaccaccatgccctggctaattttttgtgtttttagtagagacggagttttgccatgttggccaggctggtcctgaactgacctcaggtcatccacctgcctggtcctctcaaagtgctgggattacaggcgtgagccaccgttcccagcccagctttcttttcttgatgtagcacacgccacctgtgccagagcaaactgtaccttccagaggcagtcattgtgctttgcatggggagcactggaaggtgtccattccaccacctgagtttaggctgccttcatctcttgcctggaatagtgcagtcagctgactggcttccactctcaccctctaatctttgtttcttcctgctgctgagtatgctttagataatgttttaaactctttagcctacaacttgtaaaagtgcaaaaggacttgatgtagatctgcatgctcaatggaacttaaagaaaacaaatgtgatgagggctttggaggtgctttgaatgccttgaatggacagtgctacaaaatacaagattgatatatttattcaacaaacatttattaaatgcctcctgtgtcccaggcactgtgcctaggagccagaaataaaagacataattggtataatattgacagttacttttgaagatttacatgaaaaggagtctacccaaacagaagaaatatacaattggttaactaggatgttaatagacctttataggtgaatagttgtatttatagaatggtagttttctgagcaaacaaaagacatgcttagctgtcccccttcccacagtttagttccatatattgttggatacaaaaaatgctttcttctgtgtttctttctctttgctctttagtcatcggctgcagtggaagactaatgctcagcccctgcatagaaaatctttatacacagcaagagctggtgagagaaattgactaggattttgtaattctagtccctttcaattagcaacagatgctgcagggaaagattgtctgtgtaggaacacagtactaatgtttctgtgccctagctgacatggaatgctcattgcaaaaagaaagatgttcttttccttggtcgaagttgtcaccaatgacagattagatttttttaacctttctctactcctaaatccattaatgaagtctgattcccttggaagaaagttaaattcttgaccaattgtaacaacatttctaattgaacacttaaagaatttatagaaagtttagacattccagctgcctttctgatagtataaaggtatacattgtgcttaattttaaggtttgtaagaatttgcctttgttcttatgttgtcttatttaccagagatctttttttgatcctgaaagttaatatatttttgttccttatggtttttttcccccaaagagaactttggaatccttaaggtcagatatttaaagtgaaaattttttattattttgagaaaaaatcctgtggcattagaaaactatatttatctttcaccttcttccctagtgtatttactactgattatcattttaatgtgttgtatggatcttgtggccttaaaattggcctatcattctgctatttggataaagcattatgttacttatgtgataaattcttccagcatctaactattggtttattttgagtattacataaacactttatttacaatgatggctgctttttaattaaattttctatgacttcttaataacagttccacagttgctataactttgagagtaaaaagaaatgagtcttttcatttaaaaaagcctagttaagaaaaatagtttaggagttctaaattacaatagaatttctctataagtgaaattctcttctaagaagattctgaacatactgtatttcctgctgtatcttggggagagaagatagcaacaacagaatatattgccagaaggaggttatggacttgtctctgggaatttttggaatggggatgggtaactatattgttagtaaaggtaaagtgaagaatgagatgatctatgtggtgctcctttagtggaaaaaccagggaactgagtcagatggcctcaccagtctgacggtgtgtcttaacacatatctgtaaatgtggaatatcagatttccttattaagcattttaaaagtgatgtcttttaaagaaaagtaaattctgaatttgggatattgaaggccccacaattgcttaaaatgcaagatggttcatgtttttaaaactttatggaaacgttttcgattaaagcttgagtttaacttgcagtttctagttttctcaattttcgattcaatttccagtataatgttagatctgtctttggttatttttgcgtcatgtctttgacaaatccatgcagtttaaattgtataatcttaaaaggcaaggcctgtacccttagataaacgtatgtcatgaagcatacatcatgattttagtatgttggaatcacatagtctctccaatgtctttcagacttcctcaagtctgagagtgtgtactgttcttctttcctttcctttcccatcgctatatagacatcttatggttgagtccaagctttctgcttttttgctcctttacttttgggagccaagcttattatagttgcagttctggatttagggtaaacattattattttggctgtaagagggagacttggaagactctgaatatcataaggactataaaactttgttattctgtgttttagcaagctctttggcaatatgggctaccaagacagcattatttttctgaaaaatatcttggcttattgaagagtgttctatgaggtgttaaacatgagtaaagcaaaggtaggcaaagcacattttatgttttgatatctttgttttatttaatcttatttattcacttgtgaaatatcatagtttgaatcattagtattaatcagtaagagtctatattgtagttagaatatcagaatactgaagtgaaatttctagaattttactaaacagtttgcacatgtttgatgtcctttaaaatttatggatgagttgaaatttaatcaggagctgattctgtgtctccattacattaaaagatgataatggttagatttagtgaccctgattcatttcacttaccaccaggtaattaatcttttagggaaagagaggagtggctatgtatagaaaggagaaaaggaagaagattgaggaatgcttgctcatcttagcataatccactttttgggcatcttaggttaatggagggagaagaagttatgagaaaggctcatgagtgcttttgaaaacactttcaggatcataaaattacagattataagaggctgaaagaatgttagaggtctggctgttctcattttcagagaagcatagtgatatactcagccaagctcaagcagcagcataaccagagccctggcaatacatctgtttgacttaaggacaaaaatccaggattctttgatatcaccatctctttttgagtttttgtgggaataaactgagaaattgttttctgaggtaatagtttgtttttctctgatcatgtttcttaatgcctgtagtgtgccactacacttgtggagaataaggatactgttttaccaagcctagaaattgcaattatagaatgtagcggtagggaatggggcatgcccagaaacttaacaccttgtgttttataggaaaaatgttttgaaaattggcaaaaaaaaaaagtggtagaatttatcctttaaaatatttttctaggccaggcgtggtggctcgtgcctgtaattccagcattttgtgagaccaaggcaggagaattacttgagcctaggagtttgagaccagcctgaacaacatggtgaaatcctctgtctacaaaaaatagaaataaaaaaattagccaagtgtggtcccatgcctgtggtcctgggacccatgcctgtggtcccagctacttaggaggctgagatgggaggattgcttgagcccaggaggtcgaggctgcagtgagtcatcatcctgccactgcactccagcctaggtgacaggatgagaaccttaaaaaaaaaaaaaaggaaaagaaaacaaaatgtttttctacttgtttctagagatttttcaaatttgaggtaggagttaaaggggatttctcaaattcactgtgttagtcttttaaaatagcctcagagacttacatggtatttcttttcattctctacttttgattttaggtacatatacctgatgtttatagtaactatcgtgttgctttatatataaatcagtgttgttggtttatgcttagattttttatatagagtttgcaagtaaagtagttttgatagccacacaacctcaggcttctttttggcaatacagtttcagtgtgtatcttaaaatttttaatctaagaattactgatatttaaggatgttaaaagggcaaccaaataaagtcctttgttctgataattgaaagaattttttttctgttttaacacctataaagaaattctacaactgcttaccttcacctgttctaatatttaagcttcctagctgttaggaagttcttctttatatcttacctaaatacagcctaaatgcagaactctttgtcgtagcttagagtcatgtatgaaaatcaaggacagttggtcatgttaccaatttcacattaattaatgaatcactgcttgatataaagtcattttgaacagtttcaagctgcattgttaaggggatggatttaaaaattattcaatgtcttcttttctggtttccatgaaaaaccaatttacctttttacagttcttatccttctctactactccagtcagattaaagatgacattcagcctagctgccttcatagtttcaaaagcagttttccttagatgggaccagcagtgtctttaggcctaagtgtgttagaaagctgaactaatcatatctgagaggaggcaagaaagaaagtcaatggggaagaaatgaagcaggctgtccgtggaagagaggagatgaagatccaggaaagatggaaaatggggagtgaaagaggtagactgtggttgacagcttagctaaagtgtctccagcagttatctcaggtgccacttcgtgtcttggactagctagcaagcccactgaggagtgggaatgtaagtaagctttgcaggggtgtccaatcttgtggcttccctgggccacattgaaagaagaattgtcttgggccacataaaatacactaacactaacgatagctgatgagctaaaaaaaaaaaaaagtcgcaaaaaaaatctcatgatgttttaagaaagtttacaaatttgcattgggctgcattcagcccacaggttgtgggttgcacaggcttcctctaggggattcttaggtctcttgctgctgtctgtgttgcctcccattcagattggggctcatcagacactgtggcaatccacatttggagcagtacattggtcattatttacctgttatggaccctggcagaagattacttagggatttcaaagcagcataaagcctacttcttagactctgcagttgagcaagttcacagaaaccaatacaggaatccaccttgtctgtcttatgaagtgcctctcaaatttttctgcttatgtacttgactgtagaggtgatacgaaatgagtatcccaggggaccagtgaaataagattctgaggtttctttgaagtctttttatcttgcaaatccatgcaaattttacattgtgttccataataggtctatttattttaaaaaatagtaatagtaaaacaatactccatcccctccccacatacaaaagtctctgaggctcaggaatatggactgtgcttatcttgtggcttcaagaacacactctccctcggcctccccactaacacatttcatctggggtgcgtgttccctgcagtgctgtggaaaacaaacataacatgtagcttttgaggatctaggctacgttgttggtggcactttggaccttttgctgaatttaaaaggtacctttataagtatgttagccatcgattagacagacccatctgggcaatcctctgctcagttttaacgaggaacctcatgagcagagacttagaatggggctttagtctagagctccttagcacatgttattagaccctataaaccatctcattaatttttacatctctaagctaactggatcagatgtcctgcttcttcctgggcacataaatacaatattctctcccaaagtcaccatacccaaataagttcttccataaggttgcttagagattgtaaataattcatgtaaagtattaaacatggtttcttacatgtagtgagcagccaggaaatggtagctgctattttattattgctgctatcattattgcaatgtgtacctactgtgaacaaagcagcattataaatggaaagtaaagctggttggtggcacattcaaaactgatggctgacagataactttggatcttgaattgtaaacaggtaaaactttttttttttttttttttttttttttttttttttgagatggagtcttactctgtcgcccaggctggagtccagtggtgtgatcttggctcactgcaacccttgcttcctaagttcaagtgatcctcctatctcagcctcccaagtagttaggactacaggtgcacaccaccacacctggctaatttttgtatttttattttttattttttttgagatggagtctcgctctgttgcccaggctggaatgccgtggcatgatctcagctcactgcaacctctgcctcctgggttcaagcaattcctctgcctcggcctcccgagtagctgggactacagatgcgcgccactacgcttggctaattttttgtatttttagtagagacggggttttaccgtgttagccaggatggtctcgatctcctgacctcatgatctggcctcccaagtgctgggattacaggcatgagccaccgcactggcccatttttgtattttagtagagatgcggtttcgccatgttggccaggctggtctcaaactcctgacttcaggtgatccttataatactaagaagtatacactgcttgtgatatgattaaagaaaatggagcaaatgaaattcttgaacaaaaagatatttaagaaataaaaccactaactatactaggggaaaaactgattttagcttcacataatttaacagtgtggccaaagcatagaattctatggaggaatagtgcctagtacagtgcctaatttgtgctgcttcatgtgtgttggttgaatgaatatgatgggttgataccttattatggaagccgaattgtatatatatacctgattaagcaaggaatttgaatgttatctaatggtcagtgagaattttgagcagggaaatgatgtcattcatcgcttgttttagactggaaggaaatgtacaaaaggttatattttatgatagaactatgataaatttcccttttactttgctaacatttctaataacacacaccctttataaagtctaagagtacacttccaaaggtgatagtggctccctgtgaaatgggaatgggggtgagggttatgtatttgaatctgggaggggtagcatatgtactttgaaagagagcacccagggatatgtccttcatgagtatcattattttagagaatccttgagtatcaaatcatagagttcctagagcccctcagctctaaccctcatgttatagatgacatcaagtgaattccttgactcaacccaggactcctgattcctagttcattgttctttctcatgcattaaagttgtggaaaaaactatgcagatgaacagaagggaggattggtttacgtagtttttcttccctgctccagagtaacttttccaacaagcctgaatgttttcatatcatcttgctgtactttaaaaatttaaacatttgtgtcaattacatattcatgtaggtaataaaaaaatctcactggccgggtgcggtggctcatgcctgtaatcccagcaccttgggaggccaaggcgggtggatcgcctgagctcaggagttcgagaacatacagggcaacatggtaaaaccccgtgtctactaaaaatacaaaaaaaattaactgggtgtggtggcacgcacctgtagtcccagctacttgggaggctgaggcaggataattgcttcagccccagaggtgaaagttgcagtgagccaagattgtgccactgcactccagcttgggctacagagtgagactccgtctcaaaaaatactcaccaccccagaggcaaatcagtaaaacatcttgtcatgttttcttaccagtcttttttctaaatgtgtacttttaaaattagaattgtattgttttatagctttttatatgtttatatatacaaacattcacttaagtatatgtaggtgttgtttttttaatttttttttttttttttttttgagttggagttttgctcttgttgcccaggctggagtgcagtggcctgctctcagctcaccgcaacctccacctcctgggttcaagcgattctcctgcctcagcctcctgagtagctgggattacaggcgcttgccaccatgcatggctaatttttgtatttttaatagagatggggtttcgccatgttggccaggctggtcctgaacctctgacctcaggtgatccgcctgcctcagcctcccaaagtgctgggattataggcgtgagccacctcgcctggccctatttaaaatggttatgtagtagtaatccatcatacagatgtgccacaacatatatgattaaatctctattgttaggtagttctcaatttttcaaacaagcaactattttataaatgcaaatagttctaagaacgttaggagacttcgagtcattcacatactagttcgaattagttaatatctggtttctttttactacctagttgagagcagctagttggagaatggaaattgtgatttggcatgaagcacttcaggaagagggtgggcttgggaagggctgtgaaggggtagagttccatataggctgtttgaacctcagaaaaagggatgtagaaaaaggttgctgaatggagtaatttcagtgttttgcacaggaatggctctttttctttttctggtccgtatgacttttgctttaagactattgctcaagctattttgtaagtttggggttctcccacacaagtacattgactaagcattggttaaaaggctaggcacctgagtaccacttacatgttttactttccaagttccaacctaactacttataaacttgaaagtagttatgaattgtgggttacctatagtcaaatagtagggtttttttttttttcagtcaattggaaatgaaagggcaggtattggcaaggcttcgggactaatttaatgccattaggaaagcacaagataatgtaagggctaaaagcctcaaaaaaaaaaaaaaaaaaggtgaaatgaggagttgttgctgattggtgcaggaacctgaaagatgacacctgaaaactcaaattacatttcaggaacttgtgctggcgagagatagggataacacagataaaagtgtaatttgtagatattctaaaatcccttatcttagccaatagtttcagccgtggcttaaaacaatatatctatctgtactttagcaaaatgggtggatttgcatttcacatgctcctcctttggttgaaaacaactgattacataggaaagggaagatgatactataaactaggtcttcgttctcctacaatgtgacattggacaaggcatttcgtctctctggtttctaacctgcaagtaaaaggatgattaatattggtttagataatttttaaagttcctttagaacctgaagggtctttatttctacaacaaaaaaatcacccatgaggtagaattggctatacattctcaaatgtaaaaaattaagcaaaatgctgatctagtaggttcacataacttttaagtaaagcatcttgaaggtgtccctctatcaactgaagaacaaatgtctgagtttaatatatgactgcatcaaaaaaaaaaatatatgcaaccgcagtaggtgaccaaagggataagtaactttcaggaattttgaaagcccagtagtatttagtatatgctctctcagcattaaaaaggtcaccttgctaatacatgttaattttgaaagtttaattgacctttggaattttaatatcaaccttttttggtgtggttagaggttggagcaatcactgaagaaactgaagcctgtgattggtggagtttgggtgctgtcctctttgaacttctcactggcaaggtaagcagtggcctggacgtttaataaatttactcagatgctaccttgatttcaaattaagaacattagccttcacccttagtttttaaatcagggactaagcaagaaaaactttgatatcgaaagcaagtagagaaatgcaagtttatcaagagtccagattttttttaaaagttggattgcattacattgaataaattgatggtaaagttattttatgtcacaatatttcatagtgaaatatgactaaaacttttttcttttaattttccatgattcagctttaacagggtcaaatctgtaaggtttatgtaaggatgtattaaaattctctggatgttttaaacatattgtctgaaaccaggagagaattcttatttaagaaaattaacgtagatattaaagttaacattatctttttctcagtaccataaatttttcctatctgttctagcttaaggacagaaattatactctcagatgaatgacttttgaatatgatgtttgagttagtagactttaataaagtattgtgcagattgcctcctgggaagaaaatgaaggaaatgaaggaaatgaacagttacacttttgtaaatagtcatctacctacgtgtgtagataatactgacctaagattgctggggagtttacaaatcacctttacatacatttaaactgtaaagtgctatatatgtatgtaaagtattatgactaacaaattctaaactctgtagggtttttaaaacattaaaacattttaaaggtatcaaatctctttttagttttgcgtataatttaagcttttctataatattctgagccattaattttataactaaggacgacgggacagtagcataagcttatgatgtgatcatggtgattgtcttcatttcagttaaaagttctataggctcacagccctcatcctaaactgcttaggcggcactgtgttgattactacacttccagttaaaatggttgttgagctctctgtacttgctgtccataaatcctatgatagaacaaaatatgatgttatttgggataagaagtgtacctgattgattgtttcagactctggttgaatgccatccagcaggaataaatactcacactactttgaacatgccagaatgtgtctctgaagaggctcgctcactcattcaacaggtaatttaactgacctattggccaggtttatcaaccatgcagattagcagagcccacaactccaaaaccttaaaaagagattagtttggagcaagaaaaacccatttaacgtaaaacaaagacacgttcagaattaatactgtatattttcaggctttgctatcatcaaagtattgatggggtcagagagtatagttaaaacttcttggtattaatttttttcccaaaaatttagggctcacagtcatttctgtatatttgtgtaactctgtgatttgagtattgcttttagcttgtctgaggctgctctaattttgcagttacattttgtaaccgtatatgaatggctattttcaatttttaattcttacttataagtttactcaggtatttataaagctactcaggttgcttaggagagacatattagaaaatcttgtcaagttagatacttcatcattggtggaacttgggcattggtgtcagtgattatatttctggtggctttgaagaaagagaccattgataattaaagttcagtatcccagagacaggcttggaactccagtgaacttcttagattgattcctcatacttaaattactcttctagtttcgtgtagtgaattttgctgatattgagggttgttagtactctggtgtgacaggcccattgctgggctatcagcaggaacaagaaggcctgggatccttatgcttttatgaaaaatataatggaaaaagttccttgaaaaatatcaagaactaaaattatgtaatgaaacatggatttaaaaaaaaaagtcagggaaaacaaaaattaaaagagggcaggggagcatatattaggaagataattgactagtattctcttgaagagtgattttgctttcattcaacaaatattatatacaaggcacagtgctataagctacaaaggtaagacaggtaaataaccataccacatggaaattgataaaggctgtcaaagagttttaaaaaatactgtggcaagtcaaaagaagggggcggatataatccgtggagtggtagtattaggggaagtttttgtggaatggatgctacttttgctgggccttaggatttcagcatggcaaggatgtggggagaatagtcttggtggaatgaatggtttgaacaaaggcaaggaaggagtctgaaagacccaagtttaggaaacaaagtttgatttatctggaatagagagataaataaaggtatgggtgataggtgagcataaaaaaataagttggggttttcttatggggttctatcatcacaaacacaagagtaatgtgataatatttaattcattaaaatttgagatttggagtttgtggagaagagtaaacagtttagagttgtacttcaggaagattaatttgcccagagtatgcaaactataaagaaacaatcaggttggaaatgttgagatgagaatacctagagcactttagattaagaggtaatgaagagatacataaaacatttcattctaatggagaaaaaaagaacagctattcatttgatttcatcttattcgttgtggcacgagataaattccaagtattttttagtaagtagtttaggaaagactggcaactgctattttttgtttctcttccttaaagaagtagtcattattatataatattaaaaatggaattcctcataataagttaccaagttctgcttttgtctttattagaagttaggttgtaaaggaatctaggcttaagatatggtaagtccccaaactcagatatgtatagcttatatagtaaatcagcattgtgtcattggcctgcctaaggaaactaccactcatgttgaggaaacatcatcaggaaagggaaaaggggtctcttggcatgattagcaatttgtcattttgactttccttttccactacctcacaggtcatagaggtcactttaaaaaaaaatcacaaaatgatttatatggaaataattctacgtgggggaaattttctcctctttggtcttttagctccttgctttgttcttagatctcataatcccctgtacccctggttcagttatctgtccaagtcaagcaaatggtgccaaagtaaacataattacattttaaatgcaatcttaaaaaagtccctcagagcatgtatgtttgtgctttagcatgtacattagttaattatgacacagttgcttggtcagttttaagaaattatgtgaggaaaagaccaaaacaaattttcatgccctcattgctcagctctgttgcctattcttcaggagaaaggaggttggcagctgctgtcttggattcattaacttgaatgtgccactggctgacattttcttaagcagtagaatctttgtgtgacctctcttgaggtgtgctatagcctttaaaatggcagaataagcaagatagtcatagttaaaacaattatacttttgcctatagatttatacttgcagatatatagaggagttcatgaactaattaaattgactttagtaaaagtcaaaatatgaacctttagaatttcacatttaaagtatattttagaaagaagccagttatttataatgaagaagaaagaacttacatgtttatgtgtttcctgaaatactaaatataattgtcattgcagttaattcttaaaaatatttgaaatgttagatttatattaaaatgtttggtgccttccacattttagtcagtagacataaattgtctgattgtgaaagtggatttgatatatgtgggatattcctgtgatgtttgttttataacaatagcttttctcttaacaaatcgtagcaactactaatataaaaattctttgagcaattaggtttaatcaacagtgtagtatggttcaatttgagtgctagaaataatttcaggtaaaagactgttagtatagtcttttgaagtgtatgtttcactccccttatggatttggtaatacccaagtgaagtaatagattcttagcatttgcagatctcacttttgtgaggcagtgtaatgttgttgttaagacatggattctggaatcagaatgcttgaattcaaatctttgccacttactacctgtgttatcttaaacaagttacttaatttccctgagcttctgttttctcaactataaaatggagataatagtagctattcatagagttgtgagttaaatgagttaacctatcataagcacttagaataagtacctggcatgtgataagtgtcgtgtatatctttgttattattattgataggacagtgacgaacattcatgacacagtaatttgcaatttgatgaagcatatattggaattatagggctactaatgaagaatgaggctattgctattgacacaggtcaacaaaattccaaaaaagtagtggactggcatataataggcaaacaattgatacttatacaaataattgaattatgaatgaaagaaaaattagaaataatgaaaaagagaagaaatagaagttttggttaacatccaagagtggaatttcctatatattggactacaaatgttgtaaataaataatttaatatttcagttgcacttgactactttctgtggaaaaaaaatatgtactgtgagtattcttaaatttgagtggctgtggcttcatgagttagttggcagagtttctttcccccaaaaagtatgaagttagacagatttggtaaaaaaccagtcatttcagtgctctggaaatggatcaaaggatacaacaatctgaaaggtgtttatgcttaaaaaacagctgaactggccaggcatggtggctcatgcctgtaattccagcactttgggaggccgaggcgggtggatcacctgaggtcaggagttcgagaccagcctaatatgatgaaaccctgtctctactaaaaatacaaaaattagtcggtcgtggtggtgggtgcctgtagtcccaggtacttgggaggctgagacaggagaattgcttgaacctgggaggcagaggttgcagtgagccgagatcgcgccactgcactccagcctgggcaacaatattgaggctccgtctcaaacaaacaaacaaacaaacaaacaaacaaacaaacaaacaaaaaacagccgaactctgggcaagaacagtgggactcttgactcaggcctgctttcaatctccccttcctgcttggtcaggtgcaaaggttctgccagggtagggtaaaccatgaggactgatcctgaggctgtataaatgtgcacaggaacagggagtgggcccagcagaaagtaaaagccagggcagatgtggttttgtggcctaaactttgaatgtgttctgctatgcgttggcagagaacagaagcttgaagggctgagatatttgaatacaacctctgttcagtcactggttgacccataggctatacagacacaggggtgaccccgagaaagccaactttaaaaagaaaaaaaaatgtggaaagttgtcagcagctgcacattacaatgcagtgggaaggggacttagcagctttacagatctaactgaaacaagttaccaaacaaagaacaaacaatccaacagcaatgataaacttcatggggaaaaaatcagactctagagttgctaaaatatactatctaaaatgtcctgttttcagtgaagtgtagtgtaagacatacacaaaaacaaaaaaagtatgtcccatattcagaaaaaaaatcagtagaaattgtctctgagtgtacccagacacaggatttatgaagactttaaagcagctattgtaaatatttccaaagaactaaatgaaactgtgtttaaattattaaaggaaagtatgacaaaaatgaatcaacaaagagattctgtaataaggagacagaaagtatatttttaaaaaacagaactaagtagaagtcacaagttgaataatacaatgactgacatgaaaaattcactagaaaaaaaatgactgaagtggctaacagcaaatttgagatagaggaagaaagaataaatgaacttaaattaatagaaattattgaatcagaaaaatggacacaaaaattgaaaaaaatgaacaggactatggaaatctgtaagacaatagcaaatgtaccagtatacatataatgatagtcccagaaggagaggagaaagggaaagggacagcaaaaagaaataatggctaaaaacgttccaaatttgattaaaaacattaacttatgcatccaagaaactcaacagaccctatgtaggaaaatacaaagaggtctacactgcaacatatttagacatatccacacttaaccaaattgttgaaaggtaaaaacaagaaaattttggaaacagtaaaaggaaaataacttacatagaaggaagcagtaatgtctaactaattatcaaaaacatggagatcagaagatattggaatgacacagtcaaagtgctgaaatcaagaagcagcagtaaaccaagaattcagcaaaattatccttcaaaaatgaaggtgcataaagacattcccaaatatagaaagactgggaggatttattgctagcagaactgccttacaagaaataccacaggaattccttcaggctggagagaaatgacacaccaggtagtaacttaagtccaaggaggaaatgaggaacactgaaaattgtagatatgagttcatagaaaagacaaaaaaatatatattttatttatatataatttatttatatatttatatattgtatatataaatatatattttttatttaaaagacataaaattgcatgtagcaacaattataaaaccatgctattgggattaacatatatagaagcaatatctaaatatgacaataatagacaaaggaagggggctatggtagagcaaagtttctaccttttgctaaattaaagttactattattttgaagtagataaatgatcttataagataagtgatatattaagtgataagatgcatattgtagggatacagcaaccacttaaaaaaaaacctaaaaactaaatactaaatgaaaattagtagagaaactaaaatggtacagcaaaaagcatttaacacaaaagaaggcagtaaaggaagaacaaataagacagtaaatctagaaaacaagtagcaaaatagcaaatataaacccaccgtgtcaataaagtgaatatctaaacatgccaaaccaaaggcagattctgttaagctggatcttctgtgcgtgagagacacaccttaaattcaaaaacacaaacagattgaaagacaaaggatggaaaaggataaaccatactaacagtaaccacgaaagagctggagtggcaatattaaatatcagacaaaatggatattaagatagatttactaggatctgacacatgtttcatagtgatagtacaggggtagctgtaacagttacaaatgtatatgcactaataatgacctcaaaatataggaaacaaaactgaactgaattgaaaggaaaaatagacaatttagtaatagtaagtggaggctcaataccccattctccatgatttatagaaaattagcaaggacattgaagacttgaacaaactgtaactgacatgtatagaacacttcacccagtgactgcggaacacacattcttatcaagtacacacaaaacaatctccaagatagatcacatgctaggccataaaacaagttttagcatttaaaggaattgaattcatacactgtattctgaattacattgtacactgattataataaccataacaatcaaagtagaaatcaacaagaggaggagatctgctaaatccacaaatatttgaaaattaaaacagtatacttctaagtttaaatgcctatatcagaaaaaaagggaaggtttttaatcagaatcttagcttgcaccgtaagaaactatgaaacaaagctagatgtggttgtgtgctcctgtagtcccagctgcttgggaggctgaggtgtgaggatcacttgagtacaggagttcaagaccagcctgggaaacacagtgagaccctgtctctaaatttaaaaaagaaagaaactatgaaaagaaactgtaaaaagcaaagtaaatccaaagcaagcagaagaaaggaagcagaaatcagtaagatagaaaacagaagaataagaaaagtaaaaccacaaggtagttctttgcaaagatcagcaaaattgggaaacctttagctggttccaaactgtgcataaaaaggcaaaggagctataatgtccaaaacaattttgcaagagaacaaagttggaggacttacactatctgatttccacaccaactataaaaccacgatagttttaagaccacagtgtttttctaacaaatggcactgggaaattgaatatgcacatgctaaaaacaaaatgaacttagacccttcatactgtttgcaaaggttaactcagaatagctcatatatttgtatataagagttaaagccataaaaattgtagaagaaaacaaaggagaaaatctttgatgttgagttaggcaaagaagtattagatgtgataccaaaagcatggtccataaaaggaaaaattgataaagtagatttccttaaaattaaaaacttgtgcattcaaaagtcaccattaagaaaatgaagacaatagagtgggtgtggtggcttatacctgtaatcccagcactttgggaggccatggtaggaggacctcttgagcccagaagtttgagactagccttgacaacatagtgagaccccgcctctatgaataaataataaaaatataaaaattttaaagaaggaaaatgaagacaagtcacagactgggagaaaatatttgcaaatcatgtatctgataagggacttatattcagaatatataaagaactcttgtaattaagtaagacagacaattcagttttaaaatgggcggaaagttagatatttcaccaagaaagctatttgaatggctaacgagcacatgaaaagatgctcaacattattagttgttaggggatgtaaattaaaaccataacaagatactactaacatcaggagaagggctattatcaaaatgacagtaccaagagctgaggatgtagagaaaccgaaatcctcatacataaaggtttgtgggaatgtaaaatggtacaactactttagaaaagtttggcaattttataaaaagttaaacataagctcattatgtgacccagcaattctgcttctagcaatgtaatcaagaaaaatgaaaatatatgtctacacaaagacatgtacatgaacgttaatagcaacattattcattatagccccaaactggaaagtctaagtatctaaaaactagtgagtggattaatgaaatgtggacatccaaacagtggaatactaagaaaaaggaatggcctgttgatacctgctacagtgtggatgaatctcagaaacataatgataagtgaaagaaggcagcgtcaaaagactacatattttattattttacttatatgaaatgttcagaaagggcaactttatagagacaaaaggcaggtcagtggttgccgagggctggggatgggggtggggattaactgtagatggcatgaggaaactttttagggtaatcaaaatgttctaaaaggccgggtgcggtggctcacgcctgtaatcccagcactttgggaggccgagacgggcggatcacgaggtcaggagatcgagaccatcctggctaacacggtgaaaccctgtctctactaaaaatacaaaaattagccgggcatggtggcgcgcgcctgtagtcccagctacacgggaggctgaggcaggagaatgacgtgaacccgggaggcggagcttgcagtgagtcgagatcgcgccactgcactccagcctgggcgacagagcgaaactccgtctcaaaaaaaaaaaaaaaaaaaatgttctaaaactggattgtgatgctagttgcacaactctttaaatttactaaaagtcatcaaattgtacacttataagggatgaatttatataaattatccttcagtaaagttgttaacacaaaaatttgacattattaaaccacaaaatttttttttacttattttacacatgattcctatttctgaagaaaccaaaacttgtttcattcattatattaaattatttcatttgtgtcaactatgccaaagactagtgattttggaatactaatcagcttattcacactttaggtaaagtttagtctcaatacatacatagttgattaggggtcgaaagatttactgtgcttcccaaattttctaatcatgaaggaagtaactggctatctcagaatctagtgcaatatctaattaatgtcatggtgtacttttggggtaggaaattgataggtataactatcctattatattacatgaggatgagggaaacaaagtaagttactcaaggccatgtttcccatcagttgaaaagccataaactcagttcaggtgtctctcacaccccacagctagaatggtattagacatagctccctttcaagaaaaatggtcacttggctattaatcaagactgcttgttaccagggttgaatttagaagttgtttcttttcaaatattggttttcctttgatttgccagttggattcctgttactcactaagtccgtctttttttagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacatta

SEQ ID NO: 2420 - DNA, 222222 bp, Homo sapiens; identical to SEQ ID NO: 2419

SEQ ID NO: 2421 - DNA, 305497 bp, Homo sapiens
ggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcggtaagtggccgcccggcgtggcattaggagagcgggacccggtccccggagggcgccgacctcgcggtgccggaggagggcgcgcggtctccgggcgcgtggcgcgggtgcagcccggcaagggcccttctgtcctggctgccctcggcccttgcagtcgcgagctcggcgcggatcataatccagcgtcccgggccgtcgcgggggccgcagccaggagaggcaccccgcgtttccgacgcgcggttcccaggcggaggatgtaactgagccacacgtcacgccggcctgactgcaagggaggctcgcttctcccccggccgtctgcaggagggaagtaaaactgcctttctccaaatcggtctggaggggacccaggcttctcttggtcgggtcccgggcaaggcagccactccagctttccccgctcagtccctgaaggagagggtacccgattctcaaagactggccctgggcgggacagccactccggcttccctggataggtcccttcaggagaagggactttggcttctccctaaccggtcccggggtgcgggaaggaggggcagggacagcctaaagctcctcgaaagggtccttggaaagaaccccaaattattctctcgtggtcccagacgagatagagtatcttgggtttccagaacaggttcccagtggggacagggtcctcaaagagcttggggtaagctccgagctgcaaggggaattggatgaagatggaaagagaagccccgatgcccgaggcctgctccctggaggccggggaaccttggctccggcagctcggagtctccacgtcccagggatgtcgcgcctacgccgctcggctgagagtggggtttcgggagctcagggaggaggtgtccaagcaggtgagagcctcctaggcgggacaggcagttcgaccagcaccgatctgaagacgcctgactctgtccccacgcccgccacctcgctcctcagcagggtcatctccccagacatcgtttccccgtgcagcagcagccgctctccgggtgggggacaggtaaccaggaagggaagcgagcctgtctggcctcaccttagctcccgccagggagcgtgtcctctcaccctcgccccttcataagtcagctctggtgctaagcagggatgagcgggtcactggggcacctggtggggcaaatgggctcccagctgctgtactttcctcctcgccttcccagttccccagagagccttggacggaagcggtgggagcaacacaggagaaagtctggggcagcgtcagcgggcgccagggtcacgccggagaccaaagccaggggccacccttcttggagcgcttttccccctttcccgggtttgtgtccccgactttctccacccggagctacccaaagccggctccttggtgcccttggcaccttggcgtgctgagcactttgcgaggaacagtctgaccccggcgcgcagctccgcgggatcctgggtactccacgaagaaagattctgggcggagaacaccccgcccagcccgggagggagcgcgcggcttggcaccgcggctagagcgagccgcgccgacgggcggcgactgccactcggtgcagccgggaggcggccgatcctccctgtggaccgcagggaagcgggtatgacttcagtggcctattcggccctccccaaaactgaggacctgagttcacaggggaaactgtccccgctccacgtagcagagaaagaagtggctctggagtccaacagacttgggtttactcgctgtgtgaccttgtgcaagtcatttaatttctctgcacctatttcctagctggaaaaaaaaaaaagctgtttatccaccctctcttggtggtagggagtaaatgagtttacaaaggtgagtgtgcctgagctaaaagagattcctaataagcctaacagttgaatgtgaggcctttattggtttactaatggaggtaggttcttgatcagatttttgtttttgaagagtgttgtgcgtttgaaagcaggtttcctcagctctcctccagtcccattcatctaccagtggttatttgggtcctcatgaattaattgaatgaatgaatgaggtattttttcatatcaggagccttgcctaagactgttgctaatgcaagcccaggaagattttttcagtgacttagactagtctgaggttcaggccaagtgtacccagcgtctcttttcacactaatcctccgtgttttagttgagcattggcagctggtggccctagcactgggaaggagatacagctggtattcacggggccaaagaggtttcagaactacctaaacgtccagggccagcaggtggggaactgggactggatagggagtgtcctggactttcaccctacaggctactcctgcctaaacagccatctggactttgacaccccaactcaggctatagattgggcaatcatcttttctcccttcttatggctaaaagaccttggaagagatcttgcaggaaccatgctgaggttttccaagtaaatatcctgcaattagcaaacctgattctgccactcaaagtccgaaagaaaaggtactggcctagtttgtgacattttctgttggctccttctttcttagaataattatgttaaaagtaactcaaacacattctgctcattgtcctgacttaaggctgtgaagctggcattcccctggtgttctatttgctttttaattttttcatgaattaggattcctcacaatccttggaatcaatgacttgttttcctgcctcaaatctttgtccacagtattccagttcatccccaagcagcttctgttctttgtgcctgctgtctaagtacagtctttaggtactctagaccggaataaaatggtcactattaaaaaagactgaaacatggagtttcttccccaaaacctgaatccagttgagatcattattttgtcttttccaagttgttagtattatattgatttccttttctttcccaccacttctctctactctccctccctcttcccacagtcccccctccctccaacggcaataattgtgctttagaaagctctgaaaggcctgctctgtttctggccagggcctcctttgaaaaggagattacagtgattaaaaataacaagttgaggatcctcaaggggcttcccttatacaggaggacaattcgcaggaccagcctttcccagatcacaatttcaagccaaacagaagaaaatccactgaaatattcaagaattgattgaaaataaaagaggctcttttgtcttactggaggtctgtttattaggaaaataaagtcagactctggctaatgagagtggcttttcctagatgtattttaaagagacatttcaaggaacttgatgggaaaagaatgtccagtagaggtttcaaaagctggtccaacttcaagcataattgaggggtttatcctaaactgggaggtttggagacctccaaagctgcatggtttttcctttgtcccacactgagacacacactgaccacaggggtggacacctcagcctggtggaaagcgcacaggctttgatgttgggtgggttggtttcaggtcctccttggtcacatattcactgtgtgatctcaggaagccacttcacctctctgagccaatttctccatctgtaaaatgagggtgttttgattttttcccagcattcctgtgagaattagaaataattcatgtcaaaagaaattgtcacacagtggttgctaaaaaaatatgttatgagatgattattttggaaatagaaaaatacttagcagcaaagccctggataagatattgtgttaagttcttccgactcatctcacttattccttacagtactttgaggaagtttctgatcgttactgttttatggatgagaagactaaacctcagagaagtttattccttatccatggtcacacagctaataatcagcagaatcaggatacagtctcaggtctgtctgactcctaaatctgtgctcttaaccagtcttatgtgctgactcaatgaaattagttgggaatagaatgaaattcactcagctaccctcagccttctggatggtgagccttccttcaaggaaaacagaacaacaaatcaagatagtaactgacatctctcaggagaattactttatattactacaaagtaatataaagtgataaatccttattcacatttgctgttttctcttattggcttcagtgttgcatttccccataaactagaggattaatttagaaacatgaagaaccttgtcagcctttggccaattccttttgtttgtggggaaacaaaaacaaattggataggaaaaaaaaaacccagaaagaaaaaaaaaaaaagaaaaaacagatttgactgttgttttgtttttacatacagatgttatatgaccatgcctgtaaaattatatgtttggaaaggacatatttaggctctaagaaatttacacaagatgaggtcttttaaataaactatttcctggatggtggagtttttaaaaacttaagtgctgctgatgatattataattaagccacccctcctacctctcttcccttttttgcaccattccctgcttttttgttatgtaactatttctaaccattacttaagtatttagttcaaactgataataaaaattagaaaatgcaaacatagctaatgcttaatggttgtggagattgtttattgctctgagttttaggaaatgaaagaaataaaaacatacaaaaaagcatatcaaaatggaatttttcaaggtttaaaacttgagtactcccccatacacagataagctgtttcattacagctgactctttcagttgcatcaagaagctataatcactgatacgtttaccactatgggctggtatatcaggagcttttcactctcacactgtccatttgcttgttatacagactgtcacatatatataggtcaatatcaatttctgttgtgaggtggggggactcttaccatgttatattagtcatagtacaggctaagctcatgttactaacagaatccaaaacacagtgttttaaacaagaggtaaatgggagatccagcatgatgggaggctttgctccataaggccatccaggaaccaggctccttctaccttgttccctgacatcttcttgcactctgctgtgtagttggtggctacttagccgtgtgtagctatgaagtacttgaaatgtggctattctgaatggagatgtgctgtaagtataaaatacacaatgactgttgaaaatttagtatacaaagagtaaactcattaattgtgtattattacatattaaaattataattgtataaagtaaaatacactagttaaaactaattttgcctattttcacttatgttaatggatacctggtaacaaaattaatttcacccagcttgagcttatttctactaaacagcactgttttaagttgctgttctcctcagcaccgttacagccgaggagaacctctgcacacctgtattcagtcagcatgcagtggactggggggagaggaagtagaggacttcagttttcttttaataatgtgacccagaaactgcacccagcacttctaaacacactccgttggcaaaaattcagtcatgtggtcatacctagctgcaaggaaggctgggaaatatagcatttagctgggtagccacatgcccagctaaaacttgaagaatttatttttcaaaaagatgaaacaaagtaaatttctaaggatcatattaacggtctctgtcacatattttcatgcatagtcatgtaaaaacacaatatatcttactttctcagtgaaaggtcagctaggtgggtcaacttgacaacatataaactgatgttcctgctaagaatcagcagaggaagccagatgcagtggctcacacctgtaacctcaacactttgggaggctgagacaggtggattgcttaaccccaggagttcaaaatcagcctggacaatatggcaaaacccatctctacaaaaaaaaaaaaaaaaaaaaattagctggctgtggtgtctcatacctgtagacccagctactcaggaggctgaggcaggaggatctcttgagctggagaagttgaggctgcagtgagtgaagattgtgccagtgcacccagcctgggcgacaaagtgagaccctgtctcaaaagaagggaaaaagagcagaggcaggagtgctggggtgtgtatgtgcaagcttatgttgtggcttgttttgtctcattctcctttctcaataaaagaggaagcagcaaagaatgaaaggaatgagggtaaggtaaatcaagaaaacaaaggggtggtgtgggaagagaaaaagaaaaatgaaaacccactggggtatacattcagaatgaaaatgaaagaaaatatttgagtatggcagagtcccattaggatgggactacagggctagatacaagaagagccatggaaagcaaacatcacataagtcaaaattagtcctttgaaattatacgtaagatataacccagataccagcttcaacctagccttatctaaacaccctacccccaatattcctgtaagtgaggaatagaaacgaattggcatgtatcaataagtctagcccttctagtttccctccagcattggaagagagcaatgtttcctcagttgagtagcagataaacccttggtttgctctgacatgcaagtacaaaatcttcatcatgtgatggagtaagggagctgagaggctcatctcatgctcactcaggcacatgcatgcattgaatggagtagcaagtggcccaaatcatttaaagcattacattctctgttttttctcctccaatagtgtgcagttgtgtttgatttttaccaaatgcacctctcttggagcatctatggtgtcaggaagcttgctatatcacataaaaagctttttgtgatgcttgtcagctcctgctggtataaaatgccccacttttacagaatgttttggcagggatggagttggggtgcagataggacagggcaaggagttaagtgagaccactagaagtcctttgtgaggtctatgtagagcaggcttctacctttcgcagaatattcataaattccatgaaatgttcaggaaaacttaagggacctacccacatccactgattttcttgaggctaggagacccataggaaataacttgaaccctctctacagttgtggttgagatatttgccaatatgtctcatggactgggtgagagaaacagggaagagttccaagaacaagtcaccatctgtggggcaggagtgtgggcaggtgggcacagtcacagcaggatgaaccaaatggtgattctaggtgctacaggaagctcttttctcctcctcttcctcctcctcctccttgtcctccccccaactcctgccaacactatcctttgaattttccaaatacactaagctcattcgctccccagggccttcatccttgctcttcatgcctgggatggttgtcctcagatctttgcatggctgactccttgtcttttaagggaatctctttaaagaggctgctctcactaccaatttatgtttcccgtcactttcgcctgattttgttttcttcatagccttaaacactctctgaaattctctcgtttattgtctgcctcctacagctagaatacaagctttatgagagcaaagactttgtctttcttatttgccattttatcttcaattcccagaacagtgcctgggcatagcaggcattaaatcattatttgttgaaaaaaataaagtatcattgaagccccaagaaccctggtgtgagctctctaagagagctggatggaggaaggggaaggtatttctctctcagccagagagaaaggtgagcacccaagggatggcagacaggaggcaaggagctccaggtggtggcagcagagagaaaggatgccagtgccacaggggcgttggccagaggctgagggcagatggcctgtgtccagagtgcagaccactgggagggaagagagagcagttgcatcatggtggaagctgaaacgctgctgctgtggcatgaaaagcagagcaacagcaggcaaaagggcagaggcaaggggctgccaacctcagaaactggctctgagaaactggctctgagtatctggagaagtaggcctgaggggattattgagccatcaaacctagacatcaattattaaagtgacattccctagaaccagcacattgtggagtcatttgtagtactttccaaacctagctatgcctttggagagtgtaaaaactaaactaaaatttaatttaataaaaaaacttcctgggccccaccctaacaaaaggctggattccaggaatcttatattcttctttcttttttcactcttttaaaggaaaatgatgagacacaaagaaaaggtggcccttttcctatgagcatgcttccccatcaccacctctcctagccccagccccagcctcccacacactttagcacctggtcacatcattgccctatcctgttactatgggacacactcatttagtgaccagtggaatatcctcaaagccaacatgactgcaacatttcccgcttggcagtagggtgatggggagaagagaaccatgagttttccttaggtggccacaatcacagactggcgaagcttgagccagggctgacttgcttgtacttctctgccaccaaagtctgcctaccatgtaactttcacacatctgtccaaggttctgtcctttggaatcaaggaaaataaggtctcccctgggccatatgtcagcccttgagatgtttgtgaataaatagctgtcatggcttctcttctgactaaaatgccccatttctttaaccattctttgtgggttgcagttgcttgctcccttgtactttgtgccccagatgtggtctgttaggggcaggacatgatagaatgattatctccttgtcctggacattgtggttgtgtgaagcttgccaggtcttgtgtttgctattttggcagctgtgccgtagtctggaatcacactgagcttgcagccaactcaaattcttgcaattttctggaaggcctgcttccctctttaacctagactggtgaaaatggtccttgaacataaaatttgacatggtttatcgttagatttaatccagcatgtttggatccatccctgtagctgtcagccattcatgaatctgtatttggtccctgagtgatttattcacataatctaattttggattatgcacagtgttgataagaaggtcttgtaagtctttatcaatgaagttgataagaatattgagcaactcagagtctaggatagagccctctgacattccttagagtctttctctaaagctgatatttagctaaatagttttgaagtcaagagatctgctgtcatcccaatgacatttacataccaactgccacccccagcataagccacctcagtttagttctgaatactgtttcctgagcctgctggtgattcttgtagtttaggcagagtgttttctttctttgcttcaaaattagtcaggactctttccactgcaagtgataggaacaaagtcaacctaactaaagcagaaaagggaatgcactgattcccatatttgcaaagcccaggggtggctcttgcttcaggcataaatgggtctagtgactcaaatggggtcattccatctctctctctctctctgtcccccgttccctccttcgctctatctttttgtccctcgcttctaccttctctgtcttgctccttccatcctcaatctcttggctgtgttttgccctcattttttcttactacagataaactttctccaaatgacagggaggatagctgccagcaaccttcagtgaaaatcctcttagctcatcctgtgactaaaagaaaagcccctttccttctaactacaaactgaaacatcccagggaagattgtgattagtccagtatgggtcacatggccagggcaatggcatggagatagactggatctggatcacagtcacttttgtgacttgatatttgaggaaggaggatgaactgtgattggaagccccagtgaccacagggtcagagtaggggcagcagtgggggtcccccagagcttcctgccctcatccacattcccagctacgttctcttggctgacacatctctacctccccagaggcatccttcccattattcctcctgctatccacgtgttgttcagctcaggacccattcatctggctctgagctgttccacgacgaggtcacacaatggggaaaggattaacttttattgagctgctgcaatgtgcttcattgcattatctccttgaatcctcatgacaaatccacgagatgataattatgatccttatttcacagaggagactgatttatttttaatatattttattgatttagcaaatgtttttatatacttcctattaccaattcattaattgtcatgatgacaacaggaggtaaatactattaaatattactgctgttttacaggtaaggacatgtagacaaggagagcttgagtaacttgcccaaaattacacataataaacagggaaatttgaaccaagtctgttaactacgtctgttatagaaaaatgacccttacaaatttaagtatgcatgatcttcagtttgagtgggagaaacttcatctctgcctggggatgctgagagcactggctgaagaaggccatccaggggaacagcataatccaaccccaccatcctcacctgctcacttttggattctcagtcttgccttccagtcttccaggccatcaccagcaaatcttttcttgcctgacctggctaggtggcctgaattactgtgccaaatttttaaatagaaatatatgagttgcagctcctcagagctctggaagttgtgcagaatagaaaggggagcactgtgactaacttaatgtcccaacagtctttataactccatgttataagttaaagcagaagctgacgcgcattgtggttgaggtgtgtagcaagactggggcatttcagtaacacatagcaggtggatggcaggggctggccataggatggagctgggactcagggtcttctcattgaggttggagttctattaataattctgaaacccaagagacagagtgcggaggaagatggaactggacaagatccagtgagggtaataggcatagaagatgaatttgggtaatagtttattagagtttttgttagaaggttgacacaccaacatttgaaagacccagaaagctatttggtaattaggtagggtaagtgtacccaaggatggaaagaactctgccctgggtcgggatttgaggccaggctctagtgtgaaatatcagtcttcatataaataaggcaggcctttgttactgatgtggcttttagggcaaagctgtaattcaataattacacaacctccagcctgatcttcctaaaccataaatctgaatatgaaatgtcctagcgcaagcccttcagtactgcctcatcccccctccccagggtgatatccacacttcttatcaaggcattgaaggcctttgatcatcttccccctgcttatcttcctcaccaagccttttatcacacccttcctcccagaatgcaacttatgaaatacagaatcagttctggtttccagggccaagactggcccatcacacatttctgctacatgggatgctgttgattcccttgtccactggataaactcctattcttcattcaacttacaacacagatactacctcctccttgaagcctcttcgaattcacccagatagacgcagatgttctctcctctgcaaccccagaacacattgttcatacctccataacacactttacatgttataaaaaatatctgttgctatattttttcccccaggtactagactgtgtgctcctagagagcagacgccatgtcttttttactctgtgtctccagggatgtagcactgagctagtgtagaccaaatgctcagtaaagataaaaggatgagggaggttgatgtattgctcaaggtaacccatgggaactttggaaaagggaccagaataggaatgagaaaactatgcatttaagacaaataaaaccttttttgttcattcattcaacaagtatatattgagcatttactatgtgtaaagtggtatgctagatgctaaagatgcagtggagttcaagacaatttgtttctgcactcatggagagtacaggttattaggggagacaagcatttaacaaatagtttcataaacacgtatggaactgaaattgggtgagaggtattccagaaaaggggtattgtgtggaggtgaaaggggcagggaggtcctcacagggcactctgagtgtcatgggctgtaggaagccttgctttattataaggacttacccaaatctctccataacctgaacttgtaagaatcgtccccaaagccaattctctccattgcaatccttccagtggtccttcattggcacctactagagtttttctttggaggttcaatcattgttcctgaggaccagctctttgaaacacattgttgggtaatcagcctgatgagcattatgatcttttatcataatcacaaatttcatcataatcttcatccccaatatcaccatcaccactcaccaccatcaccatcaccatcataaatactaccaccatcattatcatcatcatcccttaaaattcttgaacagtttacatgttccaggcactgggataaatatttatttaactctacgttcctataagaaaggcgatatcatcaacctctttttaaaaataaggaaatagattaagtaatttaccagagatcacataagtggtagctctgggattctaatcctaaatgtttgctgttaatcagttccccggatgtactcacaagatggctctgaatggaattccttttttttaatccttcataagcatttttctttaatttcttggatctcttaatagcctctcaggggaggcaattgggaggagtcattagagagaagattctattatttactgccaagcagtcattttaggttattactgggactcagaacacactgcacatttgtacctttcagaaggaagttgtataatgaggttctctggaaagatagagtctcctctattccttcaaattatactgtgtaacaacatcatcaccagtgataattatggattaaaaccccacactgagttcagcttccagagccttcatctcatgtgttatatttaatagggttgtgtacaaccttagctttctagaacctacaggaatgcagtattatgggaagctgagtttatgattagccctttaagcacactgagcagatgtacaaaagttgggatatttatcattcagaaacattgtttaggaatcttttaatcaaaatataacttacataaggaaaagtttacaaatgatagagtgtggtgaattatcacatgttgaatatactcatgtaaccagcacccagatcaagaaacagatcatgactagctcttcagcagcatcccttgttctgcctccatgttgcactccctccctttcctgtacatgttactactgtcctgacctctagcaccatgaattactttgcctgtttttgagctttatgtaaatatatataaatgtaatcataccatttgtattctcttgtgcctgtcttctgtcacttgagattacgtttgtgagatttatccatgttgcatgtggcagtatgtgttcattttcctgcctgtgaggcatttggttatatgaatatgccacaatttatatacctattctagggctgaagggcatttgagtatttccacttggatgctactacaaataatgttactactaatattcttataggtatctttggtgcacatatatatgcatttctgttgatttaagatggtattgctgggtgatagggtaagagtatgttcagcttcagtaaacactgccaaagaatttagcagcaaaattgctaattttcacttctatcaacagtgtgtgaaagttctagttaacatcactggatattgttaattcttttaaatttagccaaactgttagatacgcagtactatttcattgtagatttaatttttatttccctattgactactgaggttgagagcctttgcatatgtttattggccattgggcaccttcttttgtgaagtattagtttgtgcatttgtctttcttatttttcttctgttgagttgtctgtctttttcttattgatctgaaatagttctttatgtattttagataaaagtcagtttctggttatatggttgcaaatatcttctttgacactgtgacttgcttcttcactcttaatggtatcttttgatgagcaaaagtttgatatcaccccatttatatatcttctcctttattgttagtgcttttttatgctctatgtaagaaatctttgttactccaaggtcattcgcattttatttcatgctgccttcttaaaattttgttttgcttttcacatttagctgtacaatctatgtggaatttactctgtgtatgatgtgagttaagggccaagatttacctttttctgcatggtcattcagttgtcctagcaccacttactgaaaagattatcttttctccattgctctgatgtattaggttggtgtgaaagtaattgtggtttttgccatggcaaaaccattaatggccaaaactgcaattacttttgcaccaacctaatacatcctttgtcataaaccaagcttctgtatatttgtggaactttcctggaccctaagctgatcaactggcccatttttcttaccttgctatagtccactggcttagtttctgtagctgtgtaagtcttgatatctgggagtataagcccttcaattttgcacttctttcattaagattgtcttggacaatcttggccctttgcatttccatataaattttagaaccagcttgtcaatatcacaaagagcatactgggattttaatttagattgatgaaacctatagatcaatttgaggataattgacatctttagcaatactgagccaaccagtctaggaacactcaagtaaatttaatagcacgtcaactccgcactggtcactgtgctgagcttagatgggttcttacccttgaacgtcttacaaatgtgtaaagaaacacataaacacaaaatataatctaattcgatactcttatcactgataataatgagttcatatttactaaggactttacacatattacttcatttatagcttgcactgatactttgaggtaagtgctgttactatgcctattatgtaggtatttttaatttcagtagggtccaagagaaaaggcatgcaggtctttatggggaaatcagaggaaacatcacacaaacggtggagatttggctgacttttgaagtttgcagaatggaggagcttgaccattccaagttatatgagtagctcatgaaaaaatacaacagggcgacatgacatggattttcaggaaacttctagagagtgaatccaaggattgaaatgtagtatggcaggggaatgggagcatggttagtgaagctggagaggcagagcctgagggcttcttggtctgcggagtttgagctttgtcctaaaggcagtggctgtggagcagggattatctgtcttggctggggttccccggaggctgattgtattcatttcctaggactgctgtacaaattactataaattgttggcttgaaacaacataaatttattctctcatatttctggaggctagacatctgaaatcaaggtatccgacggtgttttcttctggagggctctgagagaaagttggttccatgcctctcgcctggcttctggtggttgtcaacaggccttagctttctgcggcttgtaaatgcatggctctaatatctgcctctgtcatctcgtggcattcttccctgtgtgtctctgtgtcttttcttatagggacataagttgtatgggatttagggcccacctgaatccagcattacctcatcttaacaaactgcatctgcaaagaccctatttccaaatgagttcacattcccaagtatggattagaacttcaacatatcttaaaccgtaacacaagcctcagatgaggattcagatgaaagtgattcttttaaggaaatgctcccaggggaaactagtaagagagtaggggaagcaggacagcaactgggaaggtgtcctgccagcctgtgatcccaggcatggtcccttcaggtagtttcagtcagatcctgcggggccattttggagtgtaaagtgcctctaagaattgtcctcacctgatgcaaggcagctggacctttcatcttaggcagagtaggctccagtaacctgaggaccagggacacaagagccacaggggctggccacgggaagcagaaatatattagtgccagggtcacattaaaatgtaaaaaggtatttgaagaaatctggatgaagtatccttagtgtttgttactttgtcctctgttccctttcctccagaattgtgtataatggccttgaagaccacccaccctcaccctagagagtctaagactgctttttggctgtctgtctgtccttcagagattcccagctctgtcccctgacagcataaccaccattttttttgcttgacactgaacactacacttttcttactcttctttgctttattgtgctttttttcccctcattccttctttttttttttgacagagtcacgctctgttgcccaggctacagtgcagtggtgcaatctcggctcactgcaacctctgcctcctgggttccagcaattctcctgcctcagcctcgtgagtagctgggattacaggcatgtgccaccatgtccggctaattttttgtatttttagtagagatggggtttcaccatgttggccaggctggtcttgaaccctggcctcaagtgatccacccacctcggcctcccagagtgctgggattacaggcatgagctgccgcgcctagccccttctttctttttttctatctgatcttttacagacatcagtagctcctttacttttgtgggataaccggccaatcacagcatgtcatttaccttctttatgtcttagagttctttgctgtgtcattctgttggtggctcaagagcagccactacattatccaagacagtggttttatttgttggagttttagggtacttctttttattattattattatattttaagttttagggtacatgtgcacaacgtgcaggtttgttacatgtgtatacattagggcacttcattttcaagactaaaactagtttaaggaatttggaagactaaatgcccctctttaacaggaggctgcatatcatactcacaaatattatatgtcaaatgaattgattttttaaagtttaaaaacttaataatcagtcaatatttgtggaagatctataacatgatgaatatattcggtttgtgaagccttggatatagtgttaaactggggagtgggccttcaaatctgaccctaagttgcccactggatgattttatgatcttaggtgtgtctgttgacctttctatgttttactttcctatccgtgaaattggagagctgaattagaagatacttgagatcccttgaaggtctaatagtctgtaactccatatctaatgtccaggatcttagcacttttatgcaggcagtaaagtaatttaaatctcaatttacatcaatttaaagaaacttgaattgaacatctattagatgccaggctctgtgctaggttctggggataaaaagagaatgaaaacccagcccctctcctgtattagcacagcccagtggagaaggcaaatcaacaaagaattgcaattcagttcaaaaaaatactgcaataaaagatttccatctcaggagactgggggtccaatgggatggaggaccatgattgccatgttgagaagatccttgagctagattttttttgttgcttttgtttttgttttttgagatggagtctcactctgtcactcaggctggagtgcaatggcacaatcgcggcttactgcaagctccacctcccgggttcacaccattctcctgtctcagcctcccaagtagctgggactacaggtgcctaccaccacgcctggctaattgtttgtatttttagtagagacggggtttcaccgtgttagccaggatggtctcgaactcttgaccttgtgatccgcccacctcggcctcctaaagtgctgggattacaggcgtgagccaccgtgcccggccgagctagattttaacggaaaaatcgtttcctgggtagatgtaggaatgaagagtataacagacttataattccagctgctgtaacaggtggccctccacaacataagtttatttccagctcatgcgaagtacagtatggatgtttctggtcagtaggtgattttccgtggggttgtttaaaatccccagtttccttccctcttgtggttccacggccctgctcctgggacatcagagtcttctgctggaccctgcattaagcaggcaaaggcaagagagtgagagtgcagggtcatgtggaaagcttgtacaggtcaggcttggaagtagagtatagcagtactcccttatccgaggttttgctttctgtggtttcagttacctgcagtaaactgtggtccaaaactatcaattggaaaattccaaaaataaacaattcataagttttaaattgcatgctgttttgagtattgttatgattgtgtcttattagttattgttgatttcctactgtgcctaatttataaattaaactttatcatatgtatgtatgtatgtatgtatgtatgtatgtaaaggaaaaccatagtaagcatagggtttggtactatccatgatttcaggcatccatttggggtcttggcatgtgtcttggccttatctgcagggggctactgtatatcatgtctgtccatgacttccactggcagaacttggttataaagctgacttaactgcaaaggaggctgggaaatgcagtgtagctgtttccacaagaaaaatgaaatatgttttgaagaacacacagcagcctctgccacaaaggtcatcctacaggattttgtgctgtgaaggactagttttctcttgggccagtctaatggaagtgtaatgttagacaattgtgaagattgagtttctgaccagggactatctttatcaaattgtggttattgggagagagctcaccacacccctggttgggtcaagaatccccaagtaagatagcagctcagatatttaacaggttctgaaatgtaagagggagctgggtgaagagggtaagagttctcacctcaatggatgaaggcctcaacactgtccacggcctctgtaactcacaggtctgggatatcgatggagaactcaggtctatcccatttgacaaatggacaataattgattcttatacttaaaacctgcttttttctctctctgcagtaacactttcagctgctcctccctcctacttcagaggattcacattaattgccctcagagagaacagagagggtgataaggaagaagaccatgctgggaccttccaggtaagaccctgcctgggcttattcagtggccctccctgccctaggaggtagaggctggagaggtacaagtgtctcaggtggcttcccatgcagtcccttgaccgttggccaacgggggcaggtccatttgaaagggtcatcatggagcaagcagcaaatgccgcacacctatctgagcaaggttggccatggggcaggccttgttttgtctcagcagatcacggggctcttctctgggcccacagtgtccttcagcagccaagcgtggggagagcacttggagccctggctaggcctggctgttttgcctgcacaggcatttcgtgattgactggttaattctcaaatgtaaacggaacaagagctcgggaccgccaggctggagggagttcaaagcacaggagaaggactattaagggaatgtagagattgatttatgagggaagattaaaagaattaaacatgcttttcttggccaaatgaacagggccgagtttaagaggtggtaatggtctttaaatgtcagtcctcacagaacaacctcctcaaggggaagcttcatttgactttgcatgaaagggcacactaagacaaaagtgggtcaagaaaagaaagggaatcgcacagacaaggaccccgacagtgagtcatatttcactgtggaatattcttccaagggaagtggtaggaacgtcatcccctttcagaggtttagaaaagagccggcaagttgtcagaacacatcccagaaggactggagtgatcctaggaggaggcctggccaaatttgctgtaattacttctcatctcagatttccattgttctggaattcatttttatctggcatttgcaaattaagaagaaaaaaactcagagaatacttatacccatagctggctgctggagactctggtgcaatctgtgggctccgtggaggaccctgacccaaatacctcccttatccaaaggcatcttttaatccttgtggccaggttgtaatttttaatcctgtgatttaaattatttttctgctctctgggattctaggttttgggcctggtgagacttaattccacgctcaccgtaatgtccttctatggcaaagaacctcttggcatgtatctgaaagggtgacccaataataatactagcaacagccaatatttgttgggtacataccatatgccagacactatgctaagtgctttactttatcttagtttatcctgtctttgtttagtttatctttgtttaattctcaaaacaaccctagtatgtaggaactattatccccatttttggaccaggaaattgaaactagagagattaaatcacttgcctaagcttgcttattgcttgttttagtccattttgtgtttctctaacaaaacacctgacactagataatgtataaacaatagaagtttatttcacttacttgacatgagactgggaagtctcatatcaaggtacctgcatcttatgagggccttcttgctgcattatcccatggggaaaggcagaagggtaagagaaggtgagagcaagaggggtccaaactcacctttataacaaatccactctcaagataactaatccactcccacgacaaccacaatccattcacaaaggtagagccatcacgacttcatcacctcttattaggccctacctctcaacactgttgcattggggattaagtttccaacacataaactttgggggacacattcaaaccatagcagcactgttctggctaaattcagtaagttgatagtcttctctgactcacagttgtttctgcttagcttaatccttgttcttgcaactgattggtgaatacagggccctgctcatagtgggcagcgcataaatatttgctgaatgagtggataaacatttgactctttctgctagtgtccagacctcagtcctatttggaactgttgttgaactcctatctctgtatgcatcctcccttcttcctcctcttagagcttcagacatcctctcttgttacacagcagtggttctcagaatgcagtctcaggaccagcagcatcagcaacacctgggaacttgttagaaatgcaaaatctcaagcccatccagacttactgaatcagaaactctgagggcagggccctcacaacctgtgttttaacaagccttcagggtgaatctgatgcatgctcagatttgggacccattattctaatgagacatagaccagccctctaacaggatgtcgtccatcatcacgtcaacacatctgtctgttcctatctattctctcattgtttccaccagccctagagggatcaaagtgggataagaatatgaaaatgcctagcatatgataacgacaatagctaacacttaaacagtgcttgtgtgccagatactgttctgagtggtttatatttgttaactgagtttatcttcagagtgacatgatgaggtaagcattattatcctattttccacagaagagaaacttgtggcaaagaacaactaagtaactttcctaagatgcccagctctaagtgataaagctggggttcaaacccgggcagtctgtctctgggtacctgcctgtgaccactgtgtatgccatctctcagtgtatacctgttaaatgaaaaaataagggcccactatgacttttatgacagtctctgtgccaggtgctttatatgcattagccttttcttttttccccttaattcttgtagcaaccttgtgtggtcagtattgttatcttcatttttcagatgatgaaactgagtccccaaggagttcactaagttgactaagacagtccagcatctcaagggtccaaacactgtgccagtttcttatttctcaaaagttatctcctcacccctgccctgccctacccttgtgccatcaaaatgcacactccgcttgggttccaattgtctcagagatttgggggaaggaatcatagcccatgcccctcatcttacttcacctgctcctgtgatatgtggcccccatgctgtcccttccaaatctatcatgaaagtattttttctctgtaccaaagctgttatctttggagtccttgatttattcagcagcatttgttgagtgcctgctgggtgctaggcactgagttaggcattggggatagggtggtgagaaaaacagagatagtcctcatgaagcctaaggagtcctccttgtcatcatcccataaactgacctctgttgctgaaagtcaacaagtcacccattgaaacataagccaacaatcagaaagaacaaatgccattgtaattaaatatatatatatagtgatttaacaaatagataaagacttctgtttaacaccttcacttcaaatatgatgactttgagggcttaacaacaaccacaaaattctaatactcattcattgatacataatatttaacatatttgttggatacgtatgatattgttatatatatagaatgtgtaatgatcaagtcaaatatttcaggtatcccgtcactttgaatatttatcatttctatgtgttaggaacaattcaaatactctcttcttgctactttgaaatacacaatacattgttgttaactatagtcactctgaatattcttttttttttttttaagttctggggtacgtgtgcagttttgctacataggtatacatgtgccatggtggtttgctgcactcataaacccgtcacctacattagatatttctcctaatgttatctctcccctagcccccgaccccccgacagaccctggtatgtgatgttcccctccctatgtccacgtgttctcattgttcaactcccacttatgagtgtgaacatgcggtgtttggttttctgttcttgtgatagtttgctgagaatgatggtttccagcttcatccatgtccctgcaaaggacatgaactcatccttttttatggctgcatagtattccatggtgtatatgtgccacattttctttatccagtctattattgatggacatttgggttggttccaactttttgctattgtgaatagtgccacagtaaatatatgtgtgtatgtgtccttatagtataatgatttataatcctttggatgtatacccagtaatgggatcgctgggtcaaatggtatttctagatctagatctttgaggaatcactacactgtcttccacaatggttgaactaatttacactcccaccaacagtgtaaaagcgttcctatttctctacatcctctccagcatctgttgtttcctgactttttaatgatcaccattctaactggcgtgagatggtatctcattgtggttttgatttgcctttctctaatgaccagtgatgataagcatttttttcatatgtctgttggctgcataaatgtcttcttttgagaagtgtctgttaatatcctttgcccactttttgtttgtttttttcctgtaaacttaagttctttgtagattctggatataagccctttgtcagatggatagagtgcaaaaattttctcccattctgtaggttgcctgttcactctgatggtagtttcttttgctgtgcagaagctctttagtttaattagatcccatttgtcaattttggcttttgttacctttgctttggtgttttagacatgaagtctttgcccatgcttatgtcctgaatggtattgctcaggttttcttctaggattttcatggtcctaggtcttacatttaagtttctgatccaccttgagctgatttttgtataaggtgtaaggaagaggtccagtttcagttttctgcatatggctagccatttttcccaacaacatttattaaataagcaatggggaaaagattccctatttgtgtcaggtttgtcaaagatcagatggttgtagttgtgtggtattatttctgaaggctctgttctgttccattggtctatatatctgttttggtaccagtatcatgctgttttggttactgtagccttgtagtatagtttgaagtcaggtagcatgatgcctccagctttgtttttcttgcctaggattgtcttggctattgcgggctcttttttggctccatatgaagtttaaagtagttttttccaattctgtgagcaaagtcagtggtagcttgatggggatagcattgaatctataaattactttgggcagtatggccattttcatgatattgattcttcctatccatgagcatggaatgtttttccatttgtttgtgtcctctcttttgtccttgagcagtggtttgtagttctccttgaagaggtccttcacatcccttttaagttgtattcctaggtattttattctcttactagtaattgtgaatgggagttcactcatgatttggctctctgtttgtctgttattggcgtataggaatgcttgtgatttttgcacattgattttgtatcctgagactttgctgaagttgcttatcagcttaaggagattttgggctgagtggttttctaagtatacaatcatgtcatctacaaatagagacaatttgacttcctctcttcctatttgaataccctttatttctttctcttgtctgattgccctggctagaacttccaacactatgttgaataggagtggagagagaaagcatccttgtcctgtgccggttttcaaagggaatgcttccagtttttgcccattcagtatgatattggctgtgggtttgtcataaatagctcttattattttgagatatgttccattaatacctagtttattgagagtttttagcatgaaggggtgttgaattttattgaaggccttttctgtatctattgagataatcttgtgttttttgtcattggttctgtttatgtgatggattacgtttattgatttgcatatgttgaaccagccttgcatcccagggatgaagctgacttgatcgtggtggataagctttttgatgtgctgctggatttggtttaccagtattttattgaggattttcatatcgatgttcatcagagatattggcctgaaattttctttttttgttctgtctctgtgaggttttggtatcaggatgatgctggcctcataaaatgaattagggaggattccttctttttctattgttgggaataatttcagaaggaatggtaccagctcctctttgtacctctggtagaattcagctgtgaatccgtctggtcctgaacattttttggttgataggctattaattactgcttcaacttcagaacttgttattggtttattcagggattcagcttcttcatggtttcgacttgggagggtttatgtgtccaggaatttatccatttcttctagattttctagcttatttgcatagaggtgtttatagtgttctctgatggtagtttgtatttctgtgggatcagtagtgatatcccctatatcattttttattgcatctattgattctactctcttttctttattagtctggctagcagtctatctattttgttgatcttttcaaaaaaacagctcctggattcattgatttttttgaagggtttttcatgtctctatctccttcagttctgctttgatcttagttatttcttgtcttctgctagcttttgaatttgtttgctgttgcttctctagttcttttcattttgatgttagggtgtcaattttagatctttcctgctttctcttgtgggcatttagtgctataaatttccctctatacactgctttaaatgtgtcccagtgattctggtatgttgtgtcttcgttctcattggtttcaaagaacatctttatttctgccttcatttcgttatttacccagtagtcattcaggagcacgttgttcagtttccatgtagttgtgcagttttgagtgagtttcctaattgtgagttctagtttgattgcactgtggtctgagagacagtttgctatgatttctattattttgcatttgctgaggagtgttttacttccaattatatggtcaattttagagtaagtgtgatgaggtgctgagaagaatgtatattctgttgatttggggtggagacttctgtagatgtctgttaggtctgcttggttcagagctgagttcaagtcctgaatatccttgttaattttctatctcattgatctgtctaatattggcagtggggtgttaaagtctcccgctattactgtgtgggagtctaagtctctttgtggtctctaagaacttgctttatgaatctgagtgctcctgtattgggtgcacatatatttaggatagttagctcttcttgctgcattgatccctttaccattctgtaatgcccttctttgtctcttttgatctttgttggtttaaagtctgttttatcagagattaggattgcaactcctgcttttttttttttttttttttttttttttttttttgctttccatttgtttggtaaatattcctccatccctttattttgagcctatgtgtgtctttgcatgttagatgggtctcctgaatacagcacactgatgggtcttgaccatttatccaatttgtcagtctgtgtcttttaattggggcatttagcccatttacatttaagtttaatattattatgtgtcaatttgatcctgtcattatgatgctagctggttgtttttcccgttagttgatgcagtttcttcatagtgtcgatattctttaccatttggcatatttttgcggtggctgataccagttgttcctttccatgtttagtgcttctttcaggagctcttgtaaggcatgcctgttggtgacaaaatctctcagcatttgcttgtctgtaaaggattttatttctccttcacttatgaagcttagtttggctggatatgaaattctgggttgaaaattcttttctttaagaatgttaaatattggcccccactctcttctggcttatagggtttctgcagagagatctgctattagtctgatgggcttccctttgtgggtaacatgacctttctctctggctgcccttaacattttttccttcattttaaccttggtgaatctgacaattaatgtgtcttggggttgctcttctcgaggagtatctttgtggtgttctctgtatttcctgaatttgaatgttggcctgtcttgctaggttggagaagttctcctggataatatcctgaaaagtgttttccaacttggttccattctccccgtcactttcaggtacacccatcaaacatagatttggtcttttcacatagtcccatatttcttggaggctttgtttgttcctttttattctttttttctctaatcttgcctgctctctttatttcattaagttgatctttaatcacggatatcctttcttccacttgatcaatttggctattgaaacttgtgaatgcttcaggaagttctcgtactgtatttttcagctccatcaggtcatttatgttcttctctacactggttattctagtcagcaattcatctaaccttttttcaaggttcttagcttccttgcattgggttagaacatgctcctttagctcagaggagtttgttattacccgccttctgaagcctacttctgtcaattcatcaaacttattctctgtccagttttgttcccttgctggtgaggagttgcgatcctttgtaggataagcggcattctgatttttggaattttcaaactttttttgctggcttatccacatctttatggatttatctacctttggtctttgatgttggtgaccttctgatggggtctttgagtggacgtgctattcctttctgtttgttagttttccttctgacagccaggcccctgtgctgccagtctgctggagtttgctggaggtccactcctgaccctgtttgcctgggtatcaccagtggagactgcagaacacaaagattgttgcctgatctttcctctggaagcttcatcctagaggggcacctgccagatgccagccagagctctcctgtatgagatgtctgttggttcctactgggaggtgtctcccagtcagaatacacgggggtcagggacccacttgaggaggcagtctgacccttagcagaacttgaatgctgtgctgggaggtccactgctctcttcagagccatcaggcagggccttttaagtctgctgaagctgcaaccatagctacccctttccccaggtgctctgtcccaggaagatggggtttttatctataagtccctgactggggctgctgcctttttttcagagatgtcctgcccagagaagagaaatctggcagtctggccacagcagccttgctcagctgcagtgggccccacccagtttgaacttcccagtggctttgtttacactgtgaccataaaactgtctactcaagcctcaggaatggcggacgccccttcctccaccaagctcgagcgtcccaggtccatctcagactgctgctgtgctggcagcgagaatttcaagccagtggatcttagtttgctgggctccgtgggggtgggacctgccgagccagaccacttggctccctggcttcagcacccctttccggggggtgaacggttctgtctcgctgctgttccaggcaccaccggggtatggaagaaaagaactcctgcagctagttcagtatctgcccaaatggccacccggttttgtgcttgaaacccagggccctggttgggtaggcaccagaggaagtctcctggtttgtgggttgtgaaaaccgtgggacaagtgcagtatctgtgccggagttcctcaggctcagtccctcatggctccccttgtgtaggggagaaaattccctgaccccttgctcttcctgggtgaggtgacgctccatcctgctttggcttgctctctgtgggctgcacccactgtccaaccagtcccaatgagatgaaccaggtacctcagttggaaatgcagaaatcacctgctttctgtatcaatctcactgggagctgtagaccagagctgttcctattcagccatcttgccagcctcccctaaatattctttaaatttggttaaagattgcatttgtggctctaaaagtgactttgagagagggttactttgcttctttatgagtgaatccttatacagagaacacagactcacaaaatacaaacacaacaaaagcaaattttaatgctgtctttgcacctccctagacttagtggcgagggaatgggcttcctagtaccagggaaagtaagaattacagctctcacctctccaaagaaggccgaggagaagggggtggggctacctgctctggccccaacagcgggttccagcacaacagcattggcacacactagatgtcagaaaacacagagcctctctttgatgagatagctgattcggtgaaagtggcaaggaactcagggactcaattgcctgtacaaaagtaacccaccaatccttaaaaattatattaccaaaaactgctccctggaatgctgtggcccagccagctgcccagctcactctcttgtctccttcaggtctctgatcagcggtccctttccagggagccctgccctgatcgtcttatcaggcacttcattcctcctcccaccctgagcgaggctctttctctctctccccaacttagtgtttttccattgcagttattgccacctgccatgctattttacttattaacttgtgtgctatctgtcaccttccactgaactataagatctacagggcaggattttaatctatctcccttcagagtatccctggcagcaactatgaacaggacagagcaggcacatgaatatttagggacagaattttaagcacagcatttgcactaaaatttaagctgctaatttataatactattcattgccttgttttatttttaatttaagtccttcaggcatcaactagtttaggtaacactctgccaatcaaaggaaaaaagtctcaaaacaaaaggatatttgtctgagaagagcagatcaataccatgcaagcaagtatcttttaatagtcttttatattcataatcacctgtttttaaactatttttgtgatctctacattaacaataaatatttagtggcatttaatgggttctgagccacgttagaacctaaaagggcttttgacacacttttctaaaaataaaatgctattgcaagcttgttctcaggaattctctttgagttcataggaaaacctgctctcattacactaacctaagcttaatcagtccccttataagatgttaggatttttaaaactgccattcactattataaataatggagtagaaacagtttcttgcataaaactttttctcatttggtattgttcactaggacaggttcctagaagtataatcacaaatgcaaaggatatggacattttttatggttctaatatgtattgccaagatgatcccccatccccacacacacacacacaaaacctgcactcaacaaaatggaatatgggcattccatcatggaagtcatggccactgatgtgaagggaaacagacatatgagatcaggactgggaatcacaagatttgagcaggttaaatcgatagatcaaatttagcaagatgaaagctaatggaggaagagagaaacacagaaaaccacctacttggatccaaataaccaattgcacgagtacaagatgagagatttggatttatggcagcacatgaaacaaacaacaataacaagaaaaatactctagaactttcagttgccattaagtaagttaagaatgaatcatccatgagataggaccacagaaaactcatgaggtcttaggatgtatcataggagcatagtggccagaacacaggattttgattttcttatgagattcttatgccattctgagagagcccacaatattccctttctttctctatatagtataactttcagtgaatgaatattgaaatataaaatatacagtgttttctttctttcattcatttgttcattcaagtatttccatatcattcatagtacccagttctttttcttcagagtagttattgaaatttataattatttgtaggattatttgtttaatattactctgttctaccaaactgtagggcaaaatcatgtctatttaattcactgttgtatttctaaccactagcactgtgagtgttacatagtggacactcagtaaatatagtaagtatttgctgacatgaattaatgaatgcactaatgaccagctatgcaaaatgcaacatactaggctctgtgatatggagatgaataaataagacatggtatgttagtctgttttcacactgctataaagatactacctgagactgggtagtttataaacaaagaggtttaattgactcacagttctgcatagctggggaggcctcaggaaacttacaatcatggtagaaggcaaagggggagcagtcaccttcttcataaggtggctggagagagagagcaagacaacaaagtgccacactttaaaaccatcagctctcgtgagacctgactcacttatcacgagaacagcatggagaaaaccgcccccatgatccaatcacctcccaccaggtccctcccctacacatggggattaaaatttgagatgagatttgggtagggacacagagccaaaccatatcatggcccctggtattaggaggtcaaagtctacagaagaacttcccagttcagtattttatgtacactggtggatcacagataggttgaaggagaacccagatgtgtatttccctagatattagggtggcctcctctgtttaccctagggaaatattaccattttctatatgtgacatggagtcaagagacctgttagaaagaaccatattgcagcctgctagatgctaaaattgctgcatctgtgcaaataagaaaacaatcatttgcagaaagtgggtagtgagtgctgatttgggagcacagaaaggacatttacagagacaataacctttgagctatctcttagagtcgttgaaatttcaactggacaaggagtgaagagtgtgtgtgaagaccactctatttttgcctcacacctctattttaaaatttgccatattttaatgttttactatatcttctttaacaagcacctagagcctcacaagggcctagtaaaagttttttttttttaataagaaatgaaccaggggataaatgacattctgtcccttccccttcccttgaggagctcacttggtgtaaaatgcctctgcagagctataatgcacaaacaacacattttaaaagcgatgtcaacacctcttgcttaacacttagttttcttgcttaaaattgccgtgtgaaaagtcatttgtaagaagcacaagaagcaatgtgcactgtgagtgcctggaatggacattgggtcctcacacttctgcagccctggtctctagtgcctgctgccagaaaagatgaaaaatcattttccttcccagcaagaaagcctgagtctgggaaccagaggtattattaagacttaagcatcactcctctcaacagagcacacttgtgttttgtgttataaaatacagaaaaggataaatacagagaaagataaaaaagaaataaaaatatgtcattttataatctagagataatcattaacatttgggtatatttccttccaggttatatattatatagaaaacacacctatgtgtgtatatatatatatacacacacacctatatatataatttttgaacagaatattggaaccattctctatatagggttttatatcctgttttatttttatgggaacattatattgtgaacatatttcaatgaaattaaatgttccacatgatttttaatggctttgtaatactccatcatactgttgaattataatttattcgaagattcctctattattggcaagataggtggttctaattttcttttctttacttttatataaaacactgcagtgaacaccgtaacacataaatctttgcacctgtatttgcttatgataaaagcaaagttttatgcatctgtatttgcttatgataaatgaaattatagggtcaaagtaaagtttctctctctgtacatactcacatgtatgtatgcacacatgtatatgtatatatgagctctatttctggaggcagccgtttgggttttgacagtgtcagtggtgggcacacaggttagcatcacagtagaaagtattcctattttcaggctgctctaactactcagaaaggaccatgcatctagcttagctttgctatttaaaatatacagcgagtatgtggaaagactttgggttttggaatcattagatcattggactaggagtcaaattctgccctactagctaagtcaagaagtctctgaatttatctgaaacttacttagtcccttcatctacaaaataaaaatgatcaaaataaaataatgtatgtaaaatgcccaacacagtgcctggacataagggaccctcaatcaatgcctcctacttctgagccagcagcctagggtgcattttccacatttctgtttacagtgaatcataaactccattcctctgtagatttgggcatttgtggaccactaaggagcacatctgaatcttgtcaaaggtgtaactactagctatctttccaactccacaggtgaggagagagacagtcttctctagttcattctatctttattgtaataggattgggatcgctgtaaaataaaatgaaaaatttatgctatggatacatgatgcgcaaacaaaatctgttcaatgtgggtggttggctgggctctcaattgctggttttatgaactacttccatatagcagcttcaccaaaaatggaatttaaattataccttggcaaaaggctccgcaccagaggtatgaatggatagcggaaaccacactagatactattctagttgcttcgtatactttaactttcttcctcttggctggaagttccatgagagcagagacatctttctttcacaacaacacacacagtgctgggtgccatgctgaacacataatcaaagctgagtaaatattagtcacataaataaatgtattaacccctcttcaactcagattccactgcctgcccacatacacacccatgaagtaggcactcttattattattcccattcacaggaaagttaacactgagggaatcagagcattgatcgatggcacagagccagtaagtggcagtgaacaaagactaagccaccaaaggcctgtgtcattttctctattctgcatctcttacagctctggggagagatgtatgggagagacaagacagaaatttactgctaaacccctaaaatcctttctgggttattccaggggtcataccaggtttacagcttcacagatccaccaggtctcttccaggcctttgaaatgccatctcttctgtctttcctgacattcacattttcctttcatcccatttggaatctgtgcaccctgcctcctctctgagatctcaaacacttggcacatccctttgttctagttcttcgctcactgtgttaccctgatgagttaaattcccattcccctacaagattctgcaaagaggcagacaactgggccatgtctgtctctgtattcctgtggccacccctgtactcccctggcctcaccaaggcctggcacactggccaggtgataagtgctttccaaattgatggatatctgctgctggaattgctggccttacccacttgtttgcaaacgttaattggtctcctactttcttgcatggaactagcattgtttccacatctattttctaaaggtctagaaatcattttcaaatacatgatagacttctttaatagacaatacataacttttatgcaaaaaagaactttttcatgtatctattaagtagttttttaaaaagccaataagttcctgtggccttgcaatcctctcatctttaaaatgagagtgatgagcctccattccagatctaactactttatgggatagctcttaattctggttttgcaaacacttaaagccgttgtgtttgttttttaaaacaggtaaaatctaaagagtaaatgggtcatagtttactgaaacagtatcctattgtaggatatttagagaatttttaatactataaataatttagcagtatacattcgtataaagaaaaccctcttatttcatttatgagtatataaatgacactgtcgtgtgtaaggcatgttctaggctctgaggatatagctgacataacagacaaaaatccctacccctttggacattatacttctatattttagatcatttccatgagatacagtcccatgtttctggatcaaagagtttttaggctcttgatacacattgctgtatcattttctttcttttttttttttttgagatggcatcttgctggatgcagtggcatgatctcagctcactgcaacttccacctcccgtgttcaagcaattctcctgcctcagcctcctgagtagctgggactacaggcacccgccatcacacctggctaacttttgtatatttagtagagatgggggtttcgccatgttggccaagctggttttgaactcctgacctcaggtgatctgcccacctcagcctcccaaagtgctgggattacaggtgtgagccaccgcgcctggcctgctatatcactttctatcacacctgaccaagtaggagtttgagtaggaatctgactcagagcttgcttttagagagtatataacctttgccaagttactttgtcttggtttttcccttggacacaaactttctctccagttggcccccagctggtaccttatgtcctatagtcctttgtgttcaggaggactgggtgttggctggaggaagtaagtttggctggaggaagtaagttcccatccttctaccaggtggttactaaacagatcttgcaaatcctgttctcataaaattacctctttggaataaagttcaataccttagatttttgccctgacaaattaattattcaacatggttcatctctctagcattccaaggtttttctatgttagacatcttttatccgccatggttgatcactgtcttcacagcattatgtcatctgcagagtgaacaggtctgtctccctaggcatggatatatgcctcaaaaactctatttcctcatccctctacctgggatgctctcaggtagccacaaaactccctccctcacttctttccggtttctgctcaaatgtcacttttatcagagtccatttctgaccatattttataaagcaataccctcatcattctaaaccccatttgccttcctttattttattcatctgacttatcagccccagacatgttatatgcttgattgcttattagctattacccctactgcaatgtgaactccacaagggtattgctttgttcagcactgcatctgttcagcactataatagggcctggcacataataggtgtttaatatatagctgccaatttattgggtgtgcttttttgaaatcagcctaagaaacaagttgttttttcatcatgaaatgacactgacttatggtattgataaggattctggcccccaccctcagcccattttccccccaaagtcagctgacaccctcaggacttcttcacatggaccaatatgaagatacatgtgcatcacatgcacagccacacaccccctggcccctccaaaacagcttgtacttatgtggctgcctttctgggccctagcattgggttttacctgaatcccaattttaccattttagtgacaacatagccactccacccctcattaactatataagcttggccacttaatttaaacttgctgagtttgtttccttgcctgtcaaaattggagtaatactaagtcgaagagttgtataagaacttctaatgtctactgtgacatgtgaagagcttagaaatcatcactcctgtcctcatatgaaaaaaagctgaaaaactgaaaatcaacaactctaattacttccatcagagaactgaggtcatgaggcaaaccttcgccacctccttcctcctccaccccccaagaaatggagagacaagtgaatactgaaaatcacagattctcaggagctgctggaaacagtaaatggtaggaggacttaaaggctaactgatgactagctacaggctgagtgtagactgcttggagagttaaactcctgggagcccaatcctgaagggactcccacacttttgtgaattttaaccccaggagccctcatcaggttctcacggtgaaaatcagagaaatctcctccagcttgaggcatgggaagggaaaaagaacctttttgaaatctggccagatgcttctccctaacaaggtctgccctcaaggaaactactttaccagagtcttatctgatccgaagaaagaacaattagccaggtccagccctgtctagccttcctgtctcatataaaggaagtaaaaaaaggctaagaaacttttctgaagaccacacacaaagattctgccccaataaaatattgagatttaatcaaaagatagaccgttaccctttcccaatatgttaccattacatcaacaaggctcagtataacaacagtggattacaacagagagggctgcaaggcataacctctacttaagaaggagtttctagggaaaaccaaagacaaaaatgagaagaaagaatgacaaacaaacataataaccaagaactgcaggaaaattacaaaagatgtaacatacgtataatgggaatatcagacaaatagagaaaagaatagaagaaatatttgaagattagatgaaataataaaagggctattatggtaagtagttggttcatactaagtgatcaataaatggtagtcataattactattattaattgatcaacatatcagaggagggaagaagagttgaatcaaaggcaactgtttaaacaggacttagtcatgatcaggcacaggagggaggacatctttcttgacatggggaaaacaagcaaaactggtaaaaatatacaacaatttgatgaacaagaaggaaagtgagagtagataggattacacaggatgccctccatataattctgactttaatagtaatatcttccttatagaattactgagaaaattaaataatttataacaatggttttcaactggtaatgaacatcagaatctcctggatacttgtttgtaattcatctctctgggccccaagtcagagaatctgattctgtgcacctaagggggtgaggaactggggctgcggaccctgcatcttttataagcatcttatgtgaatctgacacaagtgccccaaagagcaccttaagaaacacataagcatgttgattagtgactgacctgaaacacagtcaacaaatgtttttcaagtagacagaggcaagctgatctgcagagggaaaggacagggctgaagactggggagatggagcaagtgcaggaggaatgtggtagggagtccatgagagatggatggaaggatcgtgtagcagcagagacccagtttagaaaacacatattcctagaggagactttgagattggatttgtaactttcttcatcaactcccaagagcctggtggcaggagccaagcagacagatggtacagttttcccagaactggaaaaccccaaacacagtagaagatagggggcacaggcatccaccaaggggagagagaatcagggaaccagggcactgttgagaaagctggtcaggggttcaagttggccaggaagatagtacctctactatctacctataatttttttaaaaaaccccaaagtcctaggaccccacatctcctccaaccactacctcatttctctgccccacctcgacagccaagcacttcaagagagttgtgcctacacatgttttacccacttctctgctgttgttcacttctcgacccccaccaaaatggctcttgagtcttgacagtttctgcaatggcctccgcgttgtccgtgcacactccatcatcttgcacacattcctcagtatcgcagagggagctgaccactccctgattcctagaatattctcttctcatgtctttctggttttatgtattttgccccaaaaagtggcagcaggggagttcccacacaagaaagtgcaacacactatcctgaagtggggctggttgggattccaaagaaaggagcactaagcaccagtgagatcagtccaaaacatttattaggggaacttacttacagaagtgctgcagtgatccctgcaccgaacagcgagagaaaagggatgttctgcccaggcacaaatgcagtgaggggtccagggtatggagtttttatgagggtttaaggagtttggctcagggatggggccagtttctttcagtgttttaggcaacaatctagatacctttgtcagtgtctgggaatgttcaaggccccagtttgggattaagcctgctgggaataacccacatttggctgggtcacagagtggtcaaggcactctgtgattttctatcaagacacagaaagaaagcgggagagctgaagggacctacataagcactattggcatttgggccatatttgaggtttacaacataatgttatgtatagatagtatacataatgatatatatatagatagtaaaatggttactgcagtgaagtaggttaacatccatcattgcacatagttactttttttgtgacaagggcaactaaaatctacttaaccaaaatccgtaatacaatttttcatcctcatgctatacattagatctctagacttgttcatcctatataactgttattttgtatcctttgacttacatcttcctattttttccttctctaccccctttgataatcactcccttatctatctctgcatatttgagctctttttttaaaaaaatgtttcacatataagagagatcatgcaatatttttctttctctttctggcttacttcacttagcataatgtcttccaggtccatctttgttgtggagaatggcaagatctctttctgttctaggctgaataatattccattacacacacagacacacacacacacatacacacacacacacgtgtacatgttctttccccatttgtacatttcctacattttcttttcccaaatgaacatggacatttaggtcgtttccatatcctggctattgttaataatgttgcaatgaacatgggtccacaggtgtctttatgaggtagtgagtttatctcctctaggtaaatacccagaagtcggattgctgtatcatatgatagtttatttttagttgaggaacctccataccattttccaccatggctataccaatctacgtttccatcaacagcatacagggttaccttttctccagacccttaccaacatttgctatctcttgtctttttgataatagctatccttatggatgtgagataatatcttatagtggttttaatttgcatttccctgatgattaatgatgttgaacaccttttcatatacctgttggccatttttatattgtctttggaaaaaatgtctgttcaggttatttgcccattttttagttgggtttttttgtttttctgctattgagttttaacagttatttacaaattttagatattaactccttatcagatatgtgaaatgcagttttttgtttgtttgttttttcagttcgtagttttccttttctttctttcttttttctgtgtgagacagggtctcactctgtcacccaggctggagtgcagtggcataataatagctcactgcagccccaaactcctgggctcaagtgatcctcctgcctgggtctcctgagtagttgggactacaggtgcatgccactatgtctggatgatttaaaaaaaatttttttagagatggagtctcactgtgttgcccaggctatgccttttcattttgttgtttgtttcctttgctgtgaagaaggtttttagtttcatgtagttccatttatttattttatttttgtagcatgaactgttggtgtgatatccaaaaaaattattacaaaggccaatgttgaggaggttttctgctattttctcttctaggagatttatgatttctgagccagataattctttgttgttggcagctgccctgtgtcctctgggatggttggcagcacccctggcccctggccccaccagttgtgataaccaaaaatgtttccagatattgtctgattctgatgtcccctagagaacaagatcatccccattgagatctgcttctctaaatgatgcactctccaaactctgtcctgtaaccttttctgtcctttctctgcacaattagactcatccgttccatggctttgagtaccatctgcgtgataatgactcccattcatgctccacgttgagatttgtggcccactttgatgttctagaccctgggctaaattaaggtaaattaagcctggggcttttcaaattagacagagggaatgtaagcccctgttctactcttgctgtgtaactttaactcttttaacctttgtttctctgtctgaaaaacaaataataaagatgtcaaagctgtaaagatgatcattagagtccttggcacatagtaagttgctaagtattattataacattcataattctgatctcaatgccttcaggctatgcacaaagggcttctggacttagggtcattcaatagaatgttatagactgttgaaagttcaactctagagcctgagagacctgggttcaaatcctgaatctacaattctgctctatgacctctctaaggctcggtttcttcctgcttggaaaaggggaataataatattacccactttggagggtgaatcaaatgagatcatcctaggaaaatcaattaacatgatgtctaacataccagtacttaataaacattagtaattattattagggtaacattagagaagctgatctttaactgaatctcaagggctatagaaagagcagtctcggcagagcatgaataatgggacagggtaaggaaaagtgagctataatctgggaatgacaaggagttctggattgctagtgcaaggttagggcttgagatgaaactaatgaattgtcatctaaatgcccttccacgccagtttgggactatgggctttatccttttagtacctgctagcagaaattgttttttggttttttttggcaaggggagagggacaccaaagagttttagattaggcaacaacatgatgattaaattttcaacttaggaagagagctctcatcaatatggaagagcttggagaagataagaacagaggcaggaaggctgggtaggagattgtggcatgaactccagtgagagatcaggaaggctgctcatcaggagatgaatgccacagacatcaaagagctaacaactgatgagttgaatgcagggggctgagtaggactctgaggctttttgcttggtcgcacgtggtggaccggtggtccattgaaccctctgctgtctcctcatcccaccactgccctctcctctctcctcttccctccttagctaagctcatcatctcagtaacacttctgccatagcccataacttctttgcctcttgtcctcacaccaatctagcaaaactccagccctgaatgaacacatcttttctcttctttgtgcttacacctgagccctgcacctggaaaaagtcacatttcagtgcagattggccagttcacatcatgctaatttcctagagctgctgtaacaaattgccacacatttggtggcttaaaacaacagaaatttaattatcttacaattctggggtccagaaattcaaaattcatctcactgggccaaaattaaggtgtcaacaggaccacactccctctgggggctctagggcagtggtcccaaacctttttggcaccagggactagtttcctggagaacagtttttccatgggctgcagtagggggaatggtttcaggataaaactgttctacctcagatcatcaggcattagattctcataaggagtacacaacctagatcccttgcatgtgcagttcaccatagggtttgcacttttatgagaattgaatgccgccacttacttgacaggaggtgtattagggttttctagagggacagaactgataggagatatatatgtgaatttattaagaattaactcacacaatcacagggtcccacaatcagctgtctgcaagctgaggagcaaggagagccagtccaagtcccaaaactgaagaacttggagtctgatgttcaaggataggaagaatccagcatgggagaaagatgtagtctgggaggctaggccagtctctccttttcacattttctgcctgctttatattcattgacagctaattagatggtgcccacacagctgattagatggtgcccacccagattaagggtgggtctgccttccccagtccactgactcaaatgttaatctcctttcgcaacaccctcacagacacacccagggtcaatactttgcatccttcaatccaatcaagttgacactcagtattaaccatcacaggaggtgaagctcaggcggtaatgctggctcaccccgatctcctgctgtgtggcccagctcctaacaggccacagactgggggctggggactcctgctctagggacgatttgttccttgcctcttgcggcttctggtgactgtcagcaggcttgtgtgtggctgcatcactctactctctgcctccatcctcacgtggccttctccttgtctctgtctcaaagctccctctgccactctcttttaaggatacatatgattgcatttaaggcttccagatagtctagaataaacatctcctctcaagatccttaaataaatcatatcttttgccatataaggtactattcacactttctggggattagaagtgaacatgcagtagtccctttgtatctgcaggttctgcatccactgattcagccaaaaatattggaaaaataaaaattaaaaattaatacagattttaaaaatacagtataacaactatttacaaagtattacatcacattagatattataagtaatctggagatgctttaaagtatacagaaggagtatatgggaggagtagctgtggattttgatattcacaggatgatgctggaaccaacccccgacaaataccaaggaatgattgtatttcgcggggacatttttcttcctaccatttacacttatgcaggaccactgaccttggagggcccttgacctgcctggcaatctgaccaaattactctggaaggcttgtcctcccactttccctaatgctgattcctttcattcctgacccacctatgggtcacatcacttttcccacatcattctcaacaagtgaccttgttgtgttctctatggggggaaaagaaaagaaagaaaaagaaatccctggacctggaccagaatttcttaacttgttgctaaagttaataaacctacctgcatctttcctcacttcttctcctactaaaataatggatctctccatccctgtcctgagaccatctctactcaggctctggataccactctctcctgcttcctcaggaaccttaaatggccaatcaccccacctttgttttgtagagtcagccttttcttcttgataaggtccttcccttcagctcaagttttaaaactcttccttcaggaattttccttcttaaaagaacaatttaaaaaccttacaacaaacaaaattccaccccctggccaatccatcactaagtcctgctgatggtaccttgtaagtctttctaattcaccaacttctccccttctcagcctgctatgagtccagtctgtcatcacatactcctggacgaccatagtaacctttctgcatccatttttggcacctcacaattgctctgttaagctgccttcagttgtgtgtgattggtatgtgagctccatgaggtcagggacttagttccattcatgtgttccctgtgtcctcatcatcttgaaaagggccagaaacacagtagctgttcaataaatgtttgttgaaggtattcacataatttatcactaatttcaggaggaagacaaagttccttaacagcccaaaaggcccagaaaggcctgacccctactcatctctccacctcatcttgtgtcatcttcccttgttccctgagctctagacacattggtcttctatgaacgctcccagttttctcctgccccagggtatgtgtagagaaatgtttcctcattgtttagaacattcccctctgccccaacccaacttttcctaataaataccactcagccttcagatctcagctcatatatagcaagttgcttccttggaaaatctttccttagcaccattatatgctctgttatgttctcgttgcacatatatctgtcatagaaatttcccagtaagaactgtgttcatatttggtgactatttgattcatgtctgtcttagtccattcagactgctataacaaaatatcttagactcagtgatttacaaacaacagaatttattgcttacaattctggaggctgagcagtccaagatcaaggcaccagcagatttgttgtctggtaagggcctgttccccatacatggcaccttcttgctgcatcttcatgtggaggaagggtaagagagctcactcaggtctcttttataaggacactaattccatttatgagggtggagccctcatcacttaatcacttcccaaaggttccaccacttaatactatcacattggctattagattcaacataagaacttgatggagggggctgtcaacattcagactgtatcaatgtctgtctttcccatcaaatgaggacaggggccactatattcccagtgcttagcatactgtctgacacacagagatgctcaataggtatgcactgcaggaacaaatgaagggataatggaataatggcaaggctgagatcagttgcaggaggagaaggtttagtggaagggtcacaactcagttttgcccatgttggagggccccacagctaattcagctggagaggtacactcttgtttgggaatctgggctgggagctaaggacagagggcaggctggatatctagacttaggtggttggcaaccctgtagtagatgcaaaagatgggccatataagaggattcatgtctagagatgagagggggatgggattaagggcagactgggagctcagaaaggaagacccacagattaaaaaaagatgagctaagtgtagagatgtaaaggagggacgaggttgaggggcacgtgaagcagcaggtgaggccaagtgaaggtgaaggacagactgggggtaaaatgagggattggggagaatcaggaaggtttagattttctgagaggaaaaaaatctcctgctggcctaggccaagcaggtgacctgcatgagtggagtgtgtttacctgtgtgcatgcttatacgtgtgtcatagggaacaccacaccactctcaatgtgacttcacttctcaatagattgcctggcatctttttacagcaacccaaactctctgaggcaagtaaggcaggtgtaatgatctttcttttctaggtgcaatattaagttggactcatatcctaggccaatgctctttccaccaaaccacactatttcactgggctctagccagcttgtccggagcttgaagacatattactgtcttatttcagcatttctgtctactgcagatgaaattggcctccagccagagaaaaataaaatgcccttgataaacggcaatatagtaggatcatagctttaggaaattgtgatgctccttgtaacattccccgctttttttctttaatggggagtccttaagaatcaattacattttcctaattagtgtgggtagtcaggacagaccagaaccaaaatattattaatggaatgtgcctcctatcctcggcagctgagtttgggtagcacatgcaaccccaaggaagagctcagccctctccactctgtgggtttgaattcagctacagaagctcagaagaaagagcactggactctactgaaaaccatgtttctacatgagttttcattcttcattcaaattttagcaaattttaggctttgtgacttctaggcatggcccactattgtgttggacaatttttcaggtaaccatataacaaggtactgcggttcttattcttagaatctaaggaaagctatgtactgtgtcatcagaaaaatgcactcacacacacaattttgcttgtatttcagggatttctccaaccttctgaggcctgtccatggctgactccccctatagtttagggggccttcagtccactcatgagtggattcctactgcagcctcccaataggtctctcctctttgctctctgactttccattcctctgctaaattaagaatttcctattgttctcaagtcagcccaaattcttctacatggcttatgaggcccttcatgatctggcaactagctcacatttccccactgtaggcacgtagagggaggggagtgagggaggtttgaggagaatgtaactcagtgaggatctgatggacaaataaaagttagagagtggatgaggatggaagaggaggagtgttgcttggagaggcctggaggtgagagggaaccctaaagaacaagaaaggaatatgacatgggctttggaatacaacatctcagatttgattcctggctctcctgcttattaaccaggtgaccttgcacaattcttcaaacctcagtttccctgtgtgtaaaatggcagtaatagtagcctcctcaaaggaagggtgtgagggctgcaatgcataatgtgtggaaagtgcttagcagagtcctggcaggtaaacagtggatgggtgggctgcagtgagataccaactcttgggatgggatgcctagccatgaaggccatgtaggtcataggagggagttcgttgacactttatctcctctttaccagttgggacttgctggccagccttccagaggtctaacactgaatgctgccagcctctcctgctggcttcagggcctccttgtgtcaaaagtgattgcagctccagacaactgagccccactgacagacacctcccatcctaacacccaccctaacctttcaccaaaggccacaggaccaagatgggaaggctgagactgtgccacagcagggcttcctatgaccccaaatgggggtcagcttttgactctggtgagatacattggagaaccagattaacaccagattcctcatagagcaacttagttatgccaagcatattctcagtggcgacgtgcaaaccgcatttatcctatgtggtagggaatgagacttttctccataaatgcatcatcacatactgcagccttctaagtgttaaccattttgtccaccgatttggcaaaaacagactcgtctttcaagattcagctcaaagtcacttcctctgtgaagccactcctgttcctcctcccccatcccaacacctagtagaagccaagcccttctgaggcttctgatgtctgccattggggagaatttcccttttatttctgcctctttgtctccctctgctagagtgcaagtcctttgaggacaaagcatgttttaatcatcttggactccccagggcccaggacaaaaattggctctcggtagttaataagtgtttgttgaacaaaaggatggctacattttttgcccttttccttcattattaaatattaaatgttcctatttacatattctgccttactgaagaggtgttgctggtccctacacaaaacggtccctgatgactgtactctgatatttcttacattctttccctgtgagtctgtttctaacggcaacctcatcttctaaatgtaatttcacacatgttactaaatcactttgcttcagcctgaacctaggatgttgcttctccttcagaataagatgccagctgggaatagagatccaggcagtcccagaagccccatgctaacaacttctgctaattcttaggctgattatgtggattattgaatagatcgtctttctgctttttatcctttaaactctctctgctcggccttgtctgtttcatcagtaaaggtgggcatggggaacatagagactgtgaaatctaaacctactctactccacttccatttggtcaggttttggaataaaaaaatctactctattagtaaagaattatagtcattttagagccattctctgagtaaaactgtcaattaataaacttggccattctgtttggggaataaaagaaaggaggagggagttaaggagcttatttcccccaattctctaactcaccaatgggtttgtggctgcaattgcctgaagtcccattgactgtgttgcctgcctattgagtaggatcttctggggtacatacaacttaaatgtagttttgaaagttgcttgtctttctctcaggtcatattgctaatattgtatacattgccaattgagcaatcagtttaccaactagaggaaatctggctcactagatttactgagcacctgctgtataccaggctctagactgggtgccctgtctccttgacctctaatcttcacaagcaatctaggaaaagtgttatgaacattttagagatgaaggaagagactcagagaggttatttacttcttgctcaagcccatacagcaatgatttcccaaacctgtagggtgtttcttccttgggtgttttgtagcggggaaaaagaaagtcaaagcctgtttccattatcgtggattttagggaaaggggagtattaaacatagtaatcagagaagcctggttcttctgaagcttctgactgtcatcaaattggaagttaatgctgggggagaagctctgtgtgaaggacccacatactcccgtctctggcccagcccaaactgccttggcttacctgaggctgccagtgacttctggctcctagatcttcatcttgcagctacgtggacaaggtgggtgcagcctggtgccttatgtctgtgctgtagcttcttaacagcaagtgagatggtagcaggcatggaaggccatcggtgggaagggaaaggaggggttgtcatagaccaaggagggtgaccacagcattccacagattcaaaaatgcccatttttaacattgtagcattttacaagtcagaatgcatcttacaattgatatgtacatgaaatgtaggattccttttccagataaactgttagtgcatcattgatacctcttatacgcaatggcatcctggattcaaggaactatggcaggtttcatcttatgtgtcaattctgatcaagtggtggagactatctggagtttgggaggagaaaggtctggtgctatgtccatggcagtggtgaacaacaataaactgagtggggcgtcactgtgcatgagagatggcatagaatcctactgtcgggcatttgcgccttcatccaatatctttggtattaaatggaggagcacctgccatatcttcaactgtaaactaaaggacacaaaacacaggaagcatttccaagggaccaggtcagaggcctgcctcttctcatgcagatttgtgactgtggcctttttaaatacttttttaaagtattaatttaattataaaaatagtacatgcatgctataatacaaagatacagaggtacatgaaattttaaatgtctcattgtatagatgttactattactggccttatagatttttacccttcttctattgtaaacaaatgtgtctttgtgtatgtctgtgcacgtacacacacacacttgtctgtctatggagaaaatcttaacagaattgtgggcaggcctcatttttaatgggcacaacatagtctacttaacctctccccattgaggtttggctcaaagcttatttcttgtttcttatgagtgtaaatgctcagaataacctgtatgaccagtgtcatagtccattcatgctgctataacaaaataccacagattgggttatttataaagaatagaaatgtatttctcacagtctggaagctgagaagtacaagatctaggtgccagcaagtttagtgtctggtgaggactgttttctgcttccaaatggtgccttgttgcatgctctggaggggacaagcactgtgtcctcaggtggtagaagggataatataagcagtttcatctcttaagacctttataaggtcactaatcccatttatgagggctctgccctcatgacttaatcacctcctaaagcctccacctcttaatagtatcacattgattattacttttcaacatatgaattttaggggacattcagaccatagccacaaggaatgctttacttacattttaaattagtttattaagatggtttcccagaaacataaacatgcttaaggtttctgataatttctgaattgatatgtcaaagatgtggttgattgacacttgttaactatgggtaaatttaaactcagtaacaaagcttttgtgtttccattaccaaagaacaagaaactattggaggtaagtcattgtatatttatgttggctgtttggcgatgtccttgttaggaatggagtgagtcatgctgcctgaatgcagtgtgtcagaggctcagggtctcagggacaatatccaggctctaggtcacctttgactttacctgccttatctgaccggctcatagcaggctggggtaagttcatgttgccacggattctaggagggatctctgaagtgtcaagtactgccttttcttctcatggttcagtgcagatggccgcagagggcaggatagttgatgacttattctctggagtcatccaatcttgggattaattcttttatattcatttgctgggaagggaaaggaagaaaaggggaagaagctctgatggcagttccctcttcctagattccctgctggtggtgcctcaggaacttcctttctttttgggtataccctcctttctttccttcctttctcagtgtttactatttgtgggagcatgtactaagtgctacgcactttacacatgtgatctcatttaactcaatccatttaactgaactgccaagaggctaagtggcttacaaaaccaattctatgatctttacatttttacttgtgcaaacgtgtgagaaagtttaactggtgaaacatctgtcaggtgaagactgatgtgctttctatgggtcagcaagaaggcagaagtatatccatctaagtatacatttatatcaaaataatttatttggacccatgtaactatagcattgattattgttttctaaatttgattagcagtcaactgaacatactattcgtttattgcaattgggtactttaaaacaagttctcagagtaagggttttttttctgttatatttttatactcacattaaaaaaagaaatatatacccaatcttgttcaaaaagaatttaggatagctcatatctggtttaatctaaaattaatactttaaaaatggaattttaaaatgataattttagtagtgttttggagactaaaattgggaaagtcaagaagctggctgttgactcacactattggtttcacattgcagaagataatgtgccatttttttcatttcaattcaggcaacgcttcctgatcacctactaagtgctgggcactgcatgtggccagtaagacctccatgtgttgcacagtagctgacagcagatcagcagacttttgctaccaggatgggcacagggcactctaactttgcaaagcagcctttagggcctcttttcaggtgcccagagattgctacggtgtaagggaaacttttgtatgttccagggctggtgtcaggcccattttcattggcaatgaccttcctggcatatgctgcattttcctatgttggtgagaaatttaattttactctccagaggtattagggaaaatattacaaaccacttttcaagttgaggttgaacaaatgaccaggtataactggttcaggaccccaaaataatgtcattgtttctttaagcattgtcattgagttgaaagccatggaggtcacaaataaaaagagttaggctcatattctaaagatccccagctctttaatttaaaaaaaaatcagtgtcaaaatgttttgttttaattacatcattgttttcagactatgctttaaagaattttaaaattagcttagttttttagtaatctatgaataaagcttctcttctcgtgtgcctgccttagagatggactgacttttttgcaaaatgcagcttttattcttagagaacttagtagtgcttaaactgtgttcatattcatcctgtcatttgagctctgtgacagccttgtgatggagacagaactggattcttacccaaattttacagatgaaaagttagaggttgaacaacttgcctaaggccaccttgcctaaagtagcagggccatttgagccctagttcaggcatatttcattgggcacactgtctttccaaatatttgcaaaattggacgcttgaatagaagaccttcaccaaaactctgcttactatttggctatttcaaaagttaattgttggatttgctgggactacctaagtgtcttgaaaaatatgtgcattctgataatggatgcaatacatcaactaagtatttttaggccccttgtgtttttacacttgttacatctttgtaatgtattgatcaaactaatgagtcggactatttggaatgagcagctcagtattatttaatgctgcatttcttgtattttattgatcacttgcctgattaattaacttatactatacttggttttaagaagactttgctggagctactgaacaattctttagctcacttttcttatgaaataaccatggaacaaggtactatttagagtctttgggtcttgttgcgaatttgtgggtagaaaatgtaagatatatttcaatacatggatataatccatttacaagtagctagacggcctttgttcaaatttgaccacctttcagacaatgagcttcacctctcaactctgcaggaagcccttagtaggtcccaaatggaaataggatctactctgtcataactatcaagcctgagatcttaaggcatccaggtagtcacttaggaatgaagaggcaaggatagattcaaacaacatttcagaggtagaaattggcttgttcagtttagaaatgacatggaaatttctagtttaatgatgccagtaactgagagaccaacggaggggcaggggctgaaggaaggggctggattgagtttgaaatattgtatccttctcctgaggaggttataacttggtttgggaatgtggagttgacatggatgagaaaagataagtaaacaaatgactaaactgcagtatgataaggccagagacagagatctgcagagcatgctgggagaacaatttgtggaggttgagaagtcagaaaaagcctcctagtgggcctgacacatgggctacattgtagaagaattaattagggagagtgtagcacagggcattcaatgcagtaaaggcagtctatacaaaggctccaacggtacaacaagagccagtagaccaggcaagttcagtgggctggaggttttaggatggttgaaagatttgaaaagaagcagcagcttagtcatgaagagcctggtaatagcagccagcacttgtaagcatttactgcaagccaggcatcgcagaatagttcagaatatgtttagaaggtagaattgtcagtatgtggtgaccagttggacatggggtagaaaagagaagtacaagtccaaagagagtcccaagtttctgccttgaccaagacagagtttgaatgaggagcctatttatgagggagaaggctgatgagctccatttgggacctgtacaattcaaggttcctttagtcatccatagtatttggatgtatggagtctgagaccagactgccccggtttgaatcctagctcagccacttaggagacttatgaccatgggtaagttacttaatccctctgtgcctcagttcagttttctcactaataagatgggaataatggcacttaaccttatagagtagttgtgatatttaaattttacataaaattatgtatattaattatatattatacgtaattttataatgtgtataattatataaatatacaatgtatataaaattgtatatgattatatatataatttaggttctagatcataacaggcacttgataacttattgttattaattattatcattatatagttctgagactcaaggacctgggttgacaccatcaaggtagagtattatatatgatcattatgtatgatcattatgtatctcttaggaggtatttggctataagaaacagaaaatccaatcatggcttttatcatgggttcttttattgtttagcaaggagtttggagataaatggcttccacattcttttagcagctcagtgacatcaggtccctggactagtagctctgtgattcactcagcctttctcttctattccataaaatggctgtgctagctcctccggttcataaattggccacactagctcaaagcatgtcaccctcaccaacagtgttctaaataggagagaaggaggatagtgggggaaaacactctcctcataggccactaccccttttgtcagagaggaaaatcccagaagcctcctggctgatgtttctgtacctctcattagccaaaagcaggtcacatggtcacctgaaactcaaggaaaggaacaggatagccataattggtttagaccagtcatgattcaatctctggggttggacactgtaaatcctaaacaaatagggtcttttagcaaaagagaaggagggaatggctgttgggccagtaattaagaatgtgcaccactctagggagggaggacatttagagaagaggacaagaggagaacccaggactccatgacattcataggtcttatagggaacaggggccagggaagagatttcaaatgccaaggaaataggagaagaaatccagagaagcaccccaaagggaagagctgggggagaggcaagtctacaggggtacatctggcagagctttgagcagaatgaggctgtaaaaagctgtcagagttggcagtgaggaggtcagagtgaccattgccagtgcagattcagtgatgccaagggttaagaagagaatggtgatctctatcatatgcagttggtaggcgtgcaaattaatccaaaatttgtattagtttggcactgtgtgccaaaatttaaaatgctcataccctttaactctgaaatttcacttctaggaattaattcaactggccaatttagacaagtggaggctgatgtaagtacgaggatgttgattgcagccttgtttgttatagcaaaacaaaaaaagaggggtgattgatctgatctgaaagcccatcatataggattaattataataaatggtagtacatcttggcagtggaataccaggaacagtagaaaagaactgaagttctggagtcccacagccagggtttaaattctggttctgccatttaccagctgtgtgacctcagctctctgtgaacatttctgggactcagtttctttagctgtaaaatgggataattataatactaactcatagagctatagtgaggaataaggatgcagatataagtgaaatacactgaatatttctggcacagattattatgcagtaatttaaaaagatttggcagatttacatgtatgtttaaaagattgtttataagatgttaagagaaagaaatgaggttacagaatatcacgatataatgatccaacaggtggttttatctgggaggtaaaatcctgggcacaattcactttctactttatacctatttgtattttttacctttaaaacaaggcatttaatgtcttattcacctggccaattataagccacaggagggaagctaccatttctgttttgttcaccacagtatatcataatatctggcatattacaagcagatgataaatatgtgttgaatgagtgtatgaaaaaatagtaagttgtgtttagaaggaaattccataggccaagagttcaaagatgcagtagttctgcaccaacaagtccccgggtagacctcagggacaaggctgcagaaatgaagcagaagtcagggctgagggttgtatattggtcttcagtatgaatgcctcagcttctgaaacagctcaggttgcaaaacctgaggaagaagagggaaaacaagccccaaagcaccaggatccagtccctggttttgttcagcacttcccaaacaggctgaatctgagagccaaatcacattttagaattgcagggcattttggtgccattgagtcatttcaacttcagaaaacccaaggccctggaaggaggagttctccaagttcctacaagacctgagacgaccctgccctgtgtttcccaattcctgctctagtgctggctccttcttccaaggactgaacattgtagatttctgatacacacgaagttgttttcagaggatgtccattcatttgactcctaagaaacccagttctcttaagcacaattcaatggcttgcgtctctaaagttcactgatcacccatcgctcttgctctttatttgtaaagaacaaagggaccagggatgtaattaactcacccacatttcccattgtccttaagtcttttgtgcaagcattgattgttgtttttattgttgaaagcagaattgttctcctggcaacacacatccagaaagagagcccagtgagggactcagcaggtgatgctgttgaagtttgaccttaccgtttggaagaataaaagaaaaagccaaaaaaagcaataattgagcagagggtcgttatgaattggttactattctatactattaaatgctttgggagaaaagacatttggttatttttaagtgcatttaggaattcagaatatcagccagctgagctcccaagtacaggtcctcaggggattcagtttaatgaatctttaagagcagcctgttgttaacatattacaattagcacaggtaaatggaggattcgaatgtgcttctggcaaataatctgttctcacttttatatcttagtcattacttactcatacattgatgtttactctgaggttgttttgctgggaagaaaggatacacttagcaaagcaagatgatatggcagaagagagcttgagatttgggatctaaatatgaccgggtggaatattggctctgttcattagtacagtcgtgtggtcctcaggaaattgctgaaatcctctgaatctgtttcctcctctataaaatggggattataaaacctgtttcagtggattgttcagctgattcaaccaaatcatgttaaaagggctgctgcatagctcaataaactttagcttctttccctcaaagttaagcttttcttccctgttcatctaaaaaatcaagcaatgaattactgaaaccttttcatagggaagagaaggcaatgttttgggttctttacccacattttgcccatacattcgactttatccaaagaacgctttgagttgctgcaaccacctgcacgctgagaagacaaaggtgaggagtagggttaaaagcaggttcatgtaggttcaactggaaaaccagctgccacggaagcctcaggcatatctaaatttgttcctccctcttttccttcctaactccttaaggtttgtgggcgggatcatgtaggatgacgacagccaaagggaaccatccaaggctctgaggtggagggagctctgcttgtttaaggaactggagctcggtgggtgagacaaatggtggcaggagatgatgcctgagaagttggcagggaccagattaggtggggaattgcaagctggcattataaagtttggattttaagtgtaatggaaagccactggaagtctttaaacagggaagtgacatgatttattattttaaatgtgcgctctggcttctgtgggaagattggattgtaggggctaagtatggaagcagagagataagttagaaggttgttgcagtggtttattgagtttgggtgctttagggtgctggagagaaatactgtgaaggtaaaactgacaggcagtcaaaggtgaggcttaaatgaaataacataaatgaagtgccaagtgtgtagtagataattaacaacacaagttccctctcttcgtgctacaactatatcaacaaagtgatgtttttctctggaattggatatagggagatgataaattaataaccacattttctcagctatggatttgttctttggaggtgggctgactgggagatggaggtcagcttttgcagatcacagcctgccaactgggaacacttgcgaaaggaagaaataatagaagcaggaagcaggaaaggagggaagagcagtatggaaaaaagactgggccaggtgcggtggctcacgcctgtaatcccagcactttgggaggctgaggtgggcagatcatgaggtcaagagtgcaagaccggcctgaccaacatggtgaaaccccatctctactaagaaaacaaaaattagctgggcgtagtggtgggcgcctgtaatcccagctacttgggaggctgaggcaggagaatcacttgaacccgggaggccgaggttggagtgagccaagattgggccactgcactccagcctcggtgacagtgcgagactccatctcaaagaaaaaaaaaaaagactggaaggagcaatttggggaccttatctccctcacaaggcatgtgacagtggtatggcttggctgcttcagtgccctagtactcaaacccctaaagggagaatgcagatggacaggtgcagaggtcatggggagcacttttgggcttcaaccccacggcagtatcttggggtgagtgcttacgactcttgaagccccagtgggtgtgtgttacagtgtgctctttctgctttgccatctgcaggtggcttgtgttaatcagctcaagtagaccctctgccttatcgcaagagcagagggctttctgtatcctgagttcttgcccagtgtaccagaaaaatttgatcacaggtgggcttggtgcaaggttctgttgagtggtggaggtggcgctcagcaagatggatggggggccagaagagggatggagtgggaaggtggtcttcccctggagtcaggctacccagtggcagactgtcctctgatggcccctggctgaactcccctcagagtccgcattgttccaccatcgctggtctgccagtgtctgctggtgtggtcctctgctcctccgatgtctagccgcttgtgtgtgtgcctgctaaggtctcgggtttatatgggcacaggatggggggcatggctggccagagtggtcttggaaaatgcaacatttgggcacaaaaacaagagtgcctgttctctcttaggtccatgggcacaggcccaagggtggagcccctgccagggaccccactcttctctacccagggcttccctgccctacttccgcatcactgagaaatgtgaggacattggtgtgtgtggaaggtgctggcataacagctggagttgcatccttcaagtgacaatataggtatatcagggcagtctgctatgattagaactgaaaagaatctggaggccatatcatctgaattcctcattttaggaaactgatctctagagagaaaaagtgacttgggcaaagccacagagataatggcagaggcagggctggtagcaaactagagtgggaagagattgagttttaaagtaagagactgggggtgcagtcatttattcagcaaacatgtaccaagctcctgttccatgtcagacccaagtctaggcaccgggaacacagtcaaataaaacagacaaggctcctgcccccatggagcttacattctcattcctcctcttacagactcttctgagactaccatggcagtccacctagtttgccttcatgaatcgatttcctcttctctaaaaagggagtagcaatacctctttaattttaattaattcatttattcattctacaaatattgatcaagtatatatgatgtgccaggcacaatgctaggtgctggtgacccaaaagtaagcaaggtagaaccagcccctgctttcagatatgacgaactagaggcaagatggttgtcatcttaaatgtccatcaaaatcacctgaagcccttaggaggtcactgctgccctggccccatgcctggagctgtcgattccactgctctggggtggggctaggcatcactattttcacaaaccttccaggtggttcttataggggtggggtgaagaagtgctggagaggcaaagataaagggtcatgcgggtggtggtttggcaggtggagggtgcagcctatcagacctgggttcttggggctgggaaatgcttcccagaggaagtgactcatcaggtgagaccatgagtaggactagtccaggaacaagaagtgggagcagtgtctgggaaggccagagcccccagaggttgctctgagggtaaaaggggtaacagaggtggaccatagtccgtggtcagagacaagaactatgccattgttcctttgcctgtttctctctctttgttctttccagccccactcccttcctgttatgttctttatcctacaatacaccatactgacagcacaacagctgattctccagctcctaataattatctgaaagagcttcctcctgtcatccatctcatgtccactgcttctctgcaaggcaggagccagcctccggctcccttcccacagcttccagctcaattgcctccctacagcagagggaaatgctctctttgctgcatgatttgatcagtgtattccccccaaccctccaccttcaggtgcacaaagacaaaatgcattctcttcagatatttgatttgttttgcaagtaagtgctcagtacccaccagctgataaccacattggatgtgtttgacaaatagtccttgagtgttaccataaatctataacttgatgagagattcttattgtcaaaatataattagatcaaagtttggtatttcccaagggtgtaaggaagttcatggatgtgtaccatattcagtaagatatacatctgtgcatgatgtctgccattgtcactctaaaacaagagggaaatctgacatgcttttacgtcctaaagaaggaagatattcagtgacttgtttaagtctcttctgaaataaccctcagcagagcctgagtttattctcaaggcgagggggtgggggaaacggggtgcacaaacagttttgatcccatgccgatgtctgctgacttacgcagagaatacaacaagcttcagggttaaggaaaggataacagggaggttgagaaagaaaaatcagtctgctggaaatgtcattgtcttaagcgagggtggaggagagttggagagtccttctcttctatgtataatcttctcaatgcattgtaaaatgttttaaagggattatattatttctcctgcctgtgaggttaccccaacttgtctcctcctctctccccatttttcccatttttggctcttttgacatgtaagtgagaccagaaacaaaggctgtcatctcatccaggcagccatttgtccacacttaccagtaaactgaatttgccaagaactcccactctgcagtctctgggagaggcaagatgataagcttgtgcctctgataaagcctgcagcctgggatgatctgggctgagtggggagactgaatccatgggaaactgcatcccttgaggagactcgtctggacttctctctgccgggaggcactggcgttgtaagaaatgaaggaatggggtcaggggtggggagcatccacaactcagatgtttaaagagccagagctgcaaacaaaatctggctaggaacagttttcttcgactgacctcactagatgcctctttccaaaattccaagccctcttggggcacacggggtctttctggaagttggtgatgtcgtggaaaggtcactaggtttggatccaaactgcctagtatgagtttaccatgagcttcaataatctgatcaagttccaacattcctctgagcttcagttgcttctgtgagatggaaaacaccatcccttctcaggactgtcagggactttaaatgagctgacatagttaatacaaataaaccaccagcacagtgactgggacacagaaggacctcagcaaactgagtttttgctcctttttcctttgctaaatgaaatcaaaccattgcaaaccccattagtgtataagagacattcatttgtccatccctgaaggtgtaagcacaatataaaaaggcttcccaaactactcaggcggagcaggatagagagatgtatgttttgctgagctgatcataaatctgaatgaagtaattatgtaaagtattcaagagcaattcagtaagaagatgcctcatctgccttgatgggcttttcaattactcatttttagtactgcattatactgttctctggcaataattattaaacatttcaactgtactgctatataaaacttaaaaggctgatttatttcctaggcattagactacattgaataaaatcccccaattacatggttctattttttaaaacctgtttatcagtgattttctagtattgagtcaaaactgacagcaggtcctcatgtgaaaaataagggtacagtgtgttaaatccagcggttattagctttggggtcatggaggatattaatacagaccccctacttgctagtcccagtttctgaatctgtaaaatggggataattcccacttcactggattattgtttgaaataatggatacaaagtgttagcaagaatgtagagtctgtgccaggtttggtggctcacacctgtaatctcagctctttgggaggctgaggcaggaggattgcttgaacccaggagtttgagaccaacctgggcaacatagacctcatctctacaaaatataaaaaataaaaaatattacctcggcatggtggcgtgtgcctgtggtcctagctactagataggattgcttgagtccaggagttcaaggttatagtgagctatgatcttgtcacttcactctagccggggcacagagtgagaccctgtctcaaaaataaataaaaataaaattttaaaaaagaatatagggtatttacttattaaacactagatattctgagattcactggcatttacatatagccagtgagaatcttcccacttattcagtgtatatgcatcaatcacctactaggctctaggcactcaagatgccaccagggcccattctctgattgtcacttcaatgactcaaagtcatggtcatcaagcatctagcagctccaggtccccttctgggctctgtacacaggacatctttcatcatgtgtagccattttccacataaggatgtgtactcacagagagttgggtgactttactcaaggtcattcagtagctaaggcagaaatcagacctatgtctgctggctccaaagtccacatcttctctccccactaccccatgctacctctcaggattccaggagcacatttcacctggtttgaaggataattcctcctcctcttcctggtttttctagaggagatagctcttttcttattgaggattacccacccctgaaaaattaccactttcccgaagtctgtctctacttttctcagcatcttccaattctcacctggaagatgaggctttctattctaactgaggactacaccatgattcaggcagtgacccctacacacacacacacacacacaagcatgtgtgtgcccagttctactggagcctgtccattgtacttgaggctcccaagccaaactggatttaggtgcaggccagctgggctggtaccctggataccagtctgtaaagagaactaaaatgctgctggaaatgtaatacagtggagaaaatggtctttaccagaattgttgagagcaagcgggacacgagaatgataataataatatttatcaatgcacagtgattataatatacactgatagttttgttgataaactttctccttagttcagccaaaaccgggctcttgtcacatgatcaggaaaagattaggcttgtggacacagaatggtgaggaaaacagaatttattgggtgaaaaggaaaaaggaaaagcaactctcagcaaagtgagagagtcctcctatcaggtttcccgcctcacacgttgaatcccaggtcaccacatagcaacgggagaggccaggctcctccccactgaacttcctgaggctccaccccattctcccagtgctcaggtgggcgttattcagaaagaatcagtcaggaaagggtggcttcatccaggaagtgtagtcaggtttttcagccttcaggctgttttaggtttaaatatggagttttgctggggacccttggctgcctcctgtctccactggttttgtgccagaagcttctctaacaactttgtatatgaattcatataaacacttctggcccattgaggtagatgctattatcagtccccattttacagataaggagaatcagtccagaaaagttaaggaacttgccagagtcacaccagtaataaataggctgctggactctcctaggactttgtattgtctcctggtagggggaaaacccccaagagcacttaagtgacaagagctggtatctcagtgaccttccaggcctcttagttgctgggtgaggtatgcaagtttagggcagcagttgaactactcaggttaatagagtgagcagtgctgagctggcagtctgcctgccctcctcccacgcagcactcagcctatcctccaaatgaatgttgggcaaatatttagagaatatcgttttgaaagggggccaggttattagcctgcccagggcgcctacgcatcttggcccagccttgctcccaagcctggcctgctgtctgtgctcctaatatgtgaaacaactcacatagcatggaggattaatctgcttttgggggagaaatgcaatctggtgtttctcaggactaaacttctgtggattggatgccacatgcccggtgccagagggtccgccaatggtgctcgtggccacgtcacctcccccacaatcccacgtgcttctcaagtctggaaagcacagggtacactcccgggaagagaaaataaagcaagtgagattttaaaagatgaataagatggaggtaagaatccgtttgaagagatgctaatgcaaaaagggatgctagttcagagacatgcaaatcaaaactacaacgaggcaccacctaacagcagtcagaatggctgttgttaaaaagacaaaaaataacagatgctagcaaggctgcggagaaaagggaacacttgtacactgtaggtgggaatgtaagttagtttgtccactgtggaaagcagtttggagatttctccaagaactaaaaacagaactaggatttgttccagcaatcccattactgggtatatatgcaaaggaaaataaattgttctacaaaaaagacataagcactcatatgttcattacagtactattcacaatagcaacgacatggcatcaacttaggtgtttgtcagtggtgaactggataaagaaaatgtggtacatatataccatggaatactacatagctataaataataaaatctatcctttgcagcaatatggatgcagctggaggccatcatccgaagcaaattaactcaggaacagaaaaccaataccacatgttctcacttgtaagtgggagcaaaacactggattcatatggacataaagatggaaatgatagacaccaggggctaccggagcaggaagagattaatggggaaaggtctgaaagactaccttttgtgtactgtgctcactacctgggtgatgggatcattcgtaacaaacctgtacatgtacaccctgaagttgaaattatatatttttaaaaaggatgctataacttttgtgaaagttaggctggaagatgggggtatttgtagggaaaagggacaggatttaagcctaaatctttacagtttagaagagaggccactgacaaaaagtacactgaataacgcagtcaatgcagccattcaaattatgtttctgttaagttcagaaaaacctggaaaaatattgaggctcctaggacaaatggaaaaagaaacaagacacattatataaacaaaatcagtaccgctattaacaaattttaaagaatacatggagaaaaggctagaaggaaacaaaccaaaattattcaaacagtggaggatttttttttttcctttacttttctgtcctggttaacgtttctatgataaacttactttttaaatcaataagggcaaaatctgaattttaaaaaatctatattgaaagccctttcataaaagacaaaagcaactgtctttccttccatggctttcagattgaaaaaatacacgtaggaaactagtaagaggtgattcaatgactgggattattttctttggattctctctcaggttttactgaagtagttagaaagcccttcctgggcagattcagcaataataaactacattaatttcatttccagaaaaaacttaagatgtcaaatttagctaagggggatcataatagccccaaattataaacaacaaaatgttcaacgtgctgaggtttgttaggtaaaatgtggaccaaataagatgaggtattatgctgccattaaaaattttattgggattgtacattaaatggaaaagaaatatgttcgtgatatggtgtgaaatgacgagttataacatgggaagcatactttaatcctgtcttttagaattacatttttatatgtatatgtatgcacaatctaaaatgatatacaccaaaatattaataactatcttggggtggtggaatgatcaggaacgtttgtttcatattttttgctcccctatgttttctgattttctacgatgaacaaatatctgtatggagtaattataagaagcttatttgtttcccctcttaaaagtgtcttcctcccatgttagccagcctgtggtgttaatgcttccctctggggatgtgggccacgaccagttaggagaggggtgcacggcacacaaggggaaccacaacataccgagggcctgttaacagctgctggctgcttcgtcaatactatctcatctattccttctgtccatcaagcaagatggatattatcatcctcattttgcagatgagaaaacagacccagagaggtcaagtagcttggtgtggtcaaagtcatctaattagaaagtggcagagccatgatttagtccaaatctacctgcctcaaacattcatctactttttactctatcacactacttctcatgacacctctagagaagaaatatttataaagtggtgtcatagcacatgtcttccctcattccccaccctggtccctaacttcagtgccccctatactccctgactcaacagtgcatatttagatgtcccaatgccctgttcttcaggcccagcccacccagtacccacatacccagaccagaagctgctgtcctcaattgggggttatcacaccactatccctgataggaaactttggtcgtggtgcctcagcattgaccactgagtcccctgagttgtttccttaatcacatctcacatcctccacagaagatgtcccttcttatcccaaggcccagtttctaagactagcctctcctgctcactctgctccaagcccatgttcatgggactagtttcctgctgtggatgctattccaagttcctgttctaattatctgacttctccttgattctcatgtgggaactggagccctgacctggccactagtcctgacctctgtgtctggggctctgcttcctgaagacaaatgtcccagatgccacttacgtggactttggaatcgtattctcctagatgtctcactgccatggcccacccacgtgttagaacgcttgcaacttcctctgggaccttgatgctgttcaggttcatctcttgaggcttgtgtctcttgaaccagaaagtgtgaggaggtgacgtatcaggggagataatccagatcagagttgaggaggggagtcaagattagatttagggaagaagggttgtatgttcagatctgaaaaagaaaagcccataaataggctgagggaagagtaggcaccctcagagtaaagatgggtcatgatgtaggtttcaaaatgggtatggcatgtgatttaggactaagactgcattcaatgaaaagttttagaagcctagaaaaatcattctattagcttaaaatgcccctgatatttgaaaaggcatattcatgaccagatacccaaccagttgctttaacaatagactgacaagtattggggaaatcaaaccttgtctacctgtctaaacttggtggatatctgggttgtctcacctggctggatgggaaccagtcacagattaagatttctccgtctcttgcaaggagtcaagcagctgccttatcagcaaatctctcccaaagtgactttaaacttaaacttaacccaagaaggtttatttaaacctatatataaaatagaaatgttatcattggaatgttgtaattaggtcctttaaaaatattaagctgggtgtggtggcatatacctatcatccaagctactcaggaggctgaagcgagaggattacttgaacccaggagttcacagccagcctgggcaacatagtaagatcctatttaaaaaaagaaaaatgtataacctcttcatctaaagtaatacatcatcattgttgaaaatttagaaaacacaaaaattatacaaaggaaataaaaatcacccataatactattactagacacaaccactccattgtaatatgttttaattttctgtcttaggtaaaaagaaatcacagattgaaatgaatgactgccatttagttggtagctaacacggtaggattctgagacccactctagatgacgagtgtggagacgtttgggattgccaggaggtttgagagcaggttctgatagtgcaaggcttttcagaagaagctgatattttctgagaagcaaacaatgtttggaggattctctggatcgagagaaataactccttctgttcaatgtttaattaccatctggcaactgaggttgtggataaacaaccgtatttacctgaggtagcttctatggattggagaacattcttctttgtttcacttctgggccaagggtcttagtcttatgtccccctgggatcttggtcagagttcacctggagagagcatggactttggcttcagacaaccctgggtctgaatccagacagatcactctgagctccagttcctcatctgtaaaatcttctgttcctatcaaaggtccagtgatatgaccatgctaggtacctggcagataataaatgttaactcgatatgagtgccttttggctttcccagtgtagtcacccagaaccttcccaaggattttaaagatttaggattaaaaattcctgccaaagttctctgcgaccatcagcaaacagggtcctcactggactcactattctgcaagtccaagaaaatcacattgtttggaaacctaccctcacgtcaacaaagctgcagaagagagtctaagaacctgttaagaaaatatgaagcaaaagtactattcacttttaccaagtacttatgtgtatgttggagtggagtggggtcttttgttgtgggttggtccagtgtatgtggtttcatgggactaggattggctagagagaaatttcctgcctatcataaaggatatggcactattaggagggactgtagcataggggaaagagcatggacattatggccaagtagggctgacctcaagccctagctctgccattctgggactttggacaggttgttgaacccatctgcattacagtagtttcctaaggggtgggtttaataatgcttatttttcagtgtttgagggaatggaaataatatatgtaaaggtcttcatcaagagaaagtgctgaaaaatgctattattattatcaaggctattaataaccatctagggaaacaaagtccaaattcagaaggaagtccagggaattatctaattaaaggagctgagacacatattgtggccaagtcatatagccaggaacctcacaacaaaagggaggaggcaagtacacttagttctttttttttttttttttttttaagacagggtctcactctgtcacccagactggagtgcagtggcacaatcacagttcactgtagcctcaacttcctgagtttaagcaatccttctacctcagcctcccaagtagctgagaccacaagtgtgcaccatcacagctggctaattttttatttttttatagagatggggcctcactacgttacccaggctgatctcgaactcctaagctcaagcaatcctcttgccttggcctcccaaagtgctggggttacaggcatgagccaccatgcccagcctactacacttcattcttacagtgcacacttattagtaccagctaccttgcaaagtggtgatgaaatgatgactatttttaaaaaggctttggaaataggaattgaccagggccttggcaggagaagacacctgaccagtgtacaaagtgcaggaagcaaggagggagatggcacaatgtgaggctagaggcagggaggcaggaactagcctctgtgtaggatttcagtcttgattctgaaagcaatgaaaagctgttgaaatactctgaggaaggagataattatattgtaatgatatttgtgtttttaaaaggcctgtggcttgcagtatagataacaaattggagaaagacgagagagtatataaagacagttagaatgatgttacattagttcagagaagaaatgatgtagcttagtccagggtaatagtaagaatggtggtagacattcaggagatatttggaaggtaagatggacaacatttaaatatggaggatgaaggcaaggaagagccaagggtgacctccagggtttccgacttgcacaattggagtaggaccaggttagaggaaagacggttaatggttaggttagttattaacagggtatatttgaggtgtttctgatatatcaaaaggtaaatgcaagtaaaagatagaaagttggagatacatgcctggaactcagagaagcagccaacactagaaatataaacgaatgaatcatctatacagaggtagtaattaaagccatgagttgaatgagatcacctacagataaagaatcaagtcagaacaggagagggtttacgactgaaccttgagcaagttcaaatttaaaggccagtagtggaagatgagtagccaaagaaagtggagagagtggatgggggaagttgggggagggcaccaagaaggagctatggcacagaaggcaagggaggagagtcagttgagaagaaggatgacataggatccattggattaagcattgcagaagcttagctagagttattttggtagtgcaatgtggcctgaaaatacacagaactgggttgatgaataagtgggaggtgaagggaagacagtaagtatagctaccttattcaagtaatttcattgtgatgaagagagagagaagaccgtaactggagggggatgaagagttaagtaaggtctcagctttttttttaattttattattattatactttaagttttagggtacatgtgcacaatgtgcaggtttgttacatatgtatacatatgccatgttggtgtgctgcacccattaactcgtctcagctttttaatgggagagatttgaatgtgcttaaaagacaatgacaacaattcagttggagcacaagttgaatccagagaagagtaaggagataattgttagagttgggaagaagggatgggaccaagacagtgtggtattagtaaaaaaatagtctaacagagcaatggagtataataaaaagcccagaaatagacccacacaaatatagtcaactgatctttgacaaaggagcaaaggtaatataatagagcaaagatagtcttttcaacaaatggtgctgaaacaactgcatatccacatgtagaaaaaaaaaaagaatctagacatagaccttacacccctcacaaaaattaactcaaaatggattacagacctaagtgtaaaatgcagaactataaaactcctagaagacaacacagaagaaaacctagatgacattggatatggcagtgattttttaagtacaacaccaaaagcattatccatgaaagaaataattgataagttggacttcattaaaatttaaaacttttgctgtgtgaaagacactgtcaagagaatgagaagacaagccacagatttgaagaaagtatttgcaaaagacatatctgataaagaactgctatccaaaatatgcaaaaaactcttaaaactcaacattaagggccaggcgcggtgggtcttaattccagcactttgggaggccaaggcaggcggatcacttgaggtcaggagttcgagaccagcctggccaacatgatgaaaccctgtctctactaaaaatacaaaaattagctgggtgtagtggcacacacctgtaatcccagctgcttgggaggctgaggcaggagaatcacttgaacccgggaggtaggggttgcagtgagccgagatcgtgccactgcactccagcctgggtgacagagtgggactctgtctcaaaaaataaataaataacgactgggcgtggcagctcatgcctttaatcctagcactttgggaggccaaggtgggcggaccacttgaggtcaggagttcaaaaccagcctggccaacatggtgaaaccccatctctactaaaaatacaaaaaagtttagtcagacgtggtggtgggcacctgtaatcctagctacttggaaggctgaggcaggaaaattgcctgaacgtgggaggcagaggttatagtgagctgagatggcaccactgcactccagcctgggcaatagaatgagactccatctcaaaaaaacaaaacaaaacaaaacaaacaactcaacattaagaaagtgaacaacccaaataaaaaatggtaaaagacccaaacagaaacctcaccaaagaaaatatacagatggcaagtaagcaaataaaaatatgttcaacatcatacgtcattagggtgttacaaattaaaacaataatgagataccactatacatctattagaatgaccaaaatccaacacaatgacaacatcaaatcctgtggaggatgtggaacaacaggaactctaattgttgctggtggaaatgcaaaatggtaaagctgctttggaagacagtttggcagttaaatctaaatatactattgccatatgatccagcaattgtgctctttggtatttacccaaatgaactaaaaattttatgtccacccaaaaacctgcacatggacgtttatagcagctttattcataattgccaaaactcagaagtaaccaagatatccttccgtaagtgagtggataaactgtggtactttcagacaatcagatgtcattcagtgctaaaaaagaaatgagctattaagtcatgaaaatacagagaggaaacttaaatgcatattactaagtgaaagaagccaatctggaaaagctacatactgtatgattccaattctatgacattcaggaaaaggcaaaactgtggagatagaaaagattagtggttgggaagaacaagggatgaataagaagagcacagaggatttctgggccagtgaaactatttcatatgatactacaatggtggatacatctcattatacatttgtcaaaacccataagatgtataataccaggagagcagcataatgtaaactgtggactttgcaggataatgatatgttaatataggctcattgattgtaacaaatgtatcattctgatataggatgttgatagtgagggagactgtgtgtgtgtatgtgtgtgtaggggtgaagggacagggaatatgtgggataaccctgtactttccactcagttttgctgtgaacctaaaagtgctctaagaaaataaaatttattaatgtttttttaaaaaatgaagttggatccctactctatcatattaaaaaataaactccaaatggattgaagacctaaatgtgaaagggaaaattataaagctaatgaaagaaaatattggagaatatctatatgatctcagtttctttaggcaagatcataaaagtgcaagccataggagataagttgatgaatttgactagaagaaagttatttctgctaaatgaagaattccaaaggtaagactaacctctgggtgccagaaaggaaaagatatttgtagatgttgaggtattcatgtctagaaaatcccccaaaacagcaagaaaaagacaatagaatccactggcaaagattttgaatagacaatttgcagaaaggcaaacctgataaatttgtgaagatgatcaaatgtagtaacattaaaataagatactacattataagcatcagattggaaacagttagaaaatccagtaataacaagtactggtgaggatatggaggaaattaggaacactagtacatggctgatagaataaaaggtatagctattctgcagtacttagtgaaattaatatgactatacccacaacttagcaatcctactacattatcaatcttgctgagaaactctgatcacaagtacagcagcatgaggttcttcattacatcaatatttgtggagacaaggaactggaagtcaactaagtgcccctcactggaagaatggttacataaaatgtgatctatgcatgcaatggaatactaggcaacagtcataaacaaattacatttacatgtagtaacaatgatatagctcaaaagtgtaaagttgaatgaaagaaccattaaaacacaaaacaattctaaataacacacacacactcagaacaacacaaatacttaggagtgaatgctaagtagaggaggaaaaatggaagtaggataaaaagtataaagataaaaagtaatagaaaatggtctttgctttgtccagtgataaaattatatgataaactatggagtttgaggtacttcattccttttgtctgttgtcctaaaaagaaaaggaatttttaaaagtaaaataaatacaatataggtataataatttaataagattgtgttttgaagattaagtcagataaagcacttaacttagtgcctagaacatattaaacactcaatgaatgttatctagtaatgctatcaacactattcatgatacagctactaccaatctattggagttggcacttaaaaccaattggatttagattactttctcccaaaagatcctttcaggtctaatatactatagttctgcaagagggatagggaaataccacaggaggcccagaagcaacaggcaggagaagagatggaacatccttggggaatgggaaaggctaccatcttgtttgtagcatcataggaaactttgatggttaatttgggagaatactgattagtaaatacaatgcacagattaaggaagtaggaactgcgctagtaaaaagtgctatgaagctgggatactttatatactttgctatacttcctccaaaagggtgttttaacattttaagttataaaattgtagctgagttatgaagttttgctatgcagtgtttgatttggattacccctcccccatcctccttcttccccaaagtgggacacaggtcgttctattgaaataagcaagatcatcacctagtggttaattcctcaaagtgctgacacaagatttggtcccagagagcaaagatgtgcccagtctgcgtcctcatacaatgttaattcattcaacaagcgttgactgggactttatgccaagcactattctggtgcctggggatacagagttgctaacataaaatgataagtttaaaaataaagttaaggaagtaccaacttagaagcttaagcgccctctcaaaatgatgttgcatgtatttatttcccactggttttccgtagatcatagacgaagaagaaactcagtttatgagcaattgccctgttgcagtcactgaaagcactccacggaggaggacccggatccaggtgttttggatagcaccaccagcgggaacaggctgcgtgattctgaagtaagtaaacatggaatccttccctgcagtttatcaaagactttgtggtgtgattgcagggaaaaaaaaaaaagttctttactgagcatcagaaagttgcatcatctctctgccctcccttatctgaattctcaatagcaccatagactatcattggtgaagtgttccataaagattcatttgctagaatctctattttcatcaaataggatgattctcctggccaccctgtcctaccagagataattatattagggctggttaagaaaaattacaaaccaggtgaagataatctttgactttttccacctggaatttaacactttttcttttctcggaacatacagcacctagaatccttaaacactgcttaggctgccccgagacccacatgtgacctccattagccctgagctccactttatgatgctatcttcttctttgcccatcaaaatggccctctggtgccacttcctatctggcctcctgacctcctttcagtgagttataataggtgataaaaggtattaaccagccaaaggagttttcctctggaaggtagcattatctcaaacctgtttctccaaacttatgtgccacagaatgatggtttgggaaatggaaatagatgggcaggaaaatgatttctgtggtcaaatgtttgcaaaatgctgtgtactagatacccttcttacagattcataatactagcataatgaaggttttgcaaagtcctggcgaaaaaaaaaaatctgtttaatttggtttcacccagtatttatggtgacatctattaacattcacagtttggtgaaacataggcataatctattttaaataggtttgaagtcctatatggaatgatgctgagaatgttaggatttcataccagcaaattagtcatgggtagatggagagggttccagtcctagcatccaagaagtcacttttttttaatggaagtaggcactgagaccttcccaacagcctttctcttttttaaatcctcgaaggtcttatttatgtatttggttcatttgtcaaatatagtcattttgacagacttaacaactgtggttaactccagcccacccctgaggagatcccgataagaaagcccacctaggcatcgcaatacctgcagttcttagacttccactgtgcttggcttatggaaaaaaccccacagaatctctgaagcatctgtccattgtccagactcacccgtcattgtctggcctccctttgccgccatctgtctggacattatttgtttctttcttagtttaatgcaagctgagcatccttcctcagattccttgagcagtttggctcttggcattaatctacactggtcattaagaaaaaatcagaattttaaaagatgaaatcatatctataaatgtcaatatataacatgtctatagtatctagttaaaatgtgggagatggccttgtggaaatgaacaaagacccctgaaatgagaacagagactgtgtgttcagagcctgttgtataacaagggagtcagctgccattactagcatttggcagagtctcaaagacaggcagaggactgggaaagccttctagtgaaaacaagagaagactgattggaggttccttggcatgaggaagctggaggcaggctaactacaagtggagcatcttatgtgattggtttggagggcatatttggcttcctctggttagttctgagttgaaagttggggaggtggtgagggcaaaaaatagagcagttgacagttccttggacaaatgctgattttctgtgtcaattgctggggcccagagactaggggtcagagtactatggtcactgtgataaataaccttgctattgtctgttagtattttcactcttagcccagagactgggttcccagcttggccctcagtgcccatcccactacccatgacagcccaatggctccacagagcctggagctctaaagaagatgggctgaaaatgtcagatctatgtgaggagccttcctgctctaaaagctctcatccctctggcccagatctctggttttctttgatttattgttcttacaacccagaagcattagatctttttggtggaagccagaaaggcatctcttgtttacccattaacaatcaacgttatgtgtacatatgtttatccattaacatgtatggcttattcatttgctcattcttccaacaaatgcaactgagcttctattagcccaggcatccaggatatacacaatggaggtatattcttgaccctggaggttcttacaagtcaaataagggagagagaaaaagtcaaccaatgctttctgtgtaccaagaactcagcacacatctagcaggctttgtctaatttgatcttcacagaaaacgactcccattttacagaggaggagacaggccctggggatattaggcaagttttttaaagtcatgaatccatgtaatattaaagtccatgttctgcctttcttttatttattttttctctgaaggaatcatatataagctacaactatttattaaataaatagtaattgtatgggcaggacataaatgcattcacctcgtaaaatttcaaacaatacaaaaagtagtaaaatacagaaaaatacagaataaagaaaaagttaaagatccatgacatcttggctggacacagtggctcatgcctataatcccagcactttgggaggctgaggcaagcagatcacttgaggtaaggagttcaagaccagcctggtcaacatggcaaaaccctgtctttactaaaaatacaaacattagctgggcgtggtggtgcgcacctgtagtcccagatactcgggaggctgaggcaggagaataacttgaatctgaggggtggcagttgcagtgagccgagactgtgccaccgcactccagcctgggtgacagagtgaaaccccatctcaaataaataaacaaacaaataaaatccatagcatctctctcaattccagttttctacacaaaggcaataatagaatcaatttggtttgtatgctttagacttatctctgcttttacattcacgaaggtaatcataaaagcacatagtttcattcctgtgggaatttaaggttacacaaatggtatcatgttatgtcctgaacttgaatggtttttcactaaataagatgtattagagatatgtctgggtcagtacatacaaagctacctctttttgttttttaactgctgcatgtctatggtatggatgttaattattccaaagttagtggacatttagattgtttctggtgtcttactatgacaaataatgttatgatgaatatcctgaaacttgcctattgagcaaatttccaagtttttatccacagtagatgccaagaaatgggatcataagggatgcacatttataattttattagatgctgccagatttttctccagaaagcttgccaacttaaacactctccctgactgtgaacaagagagcctaaatctttacttgctcaatggcacttggtattatcaatctttaagattcataaagattgtgtgaatggcccattcatattcttgtccattttttaataatctgtcttttaaaaattgatttacacggccgggcgtggtggctcttgcttgtaatcccagcactttgggaggccgagccgagaggggggcagatcgcctgaggtcgggagttcgagaccagcctggccaacatggtgaaacccccgtctcttctaaaaatacaaaaattagccaggtatggtggcatgcgcctgtaatcccagctactcaggaggccgaggcaggagaatcacttgaacccaggagatggaggttgcagttagctgagatcctgccactgccattcagtctgggggacagagtgagactccatctaaaaaataataataaaaatttaattatatatttaattttgttttaatatatatattatatttaaaatatagcttataaaatgtttttataaatatatgtaaatacatcttatatatttacatacatataaaataatttgatttatttagaacatatttatgtttaaaattgctctttaggtagtccagataatgacactttgttgtaaatttcaaatatttctctccacctttcttttaactttgcttgtgggtgtctaatcagtcaaaagtttgaaatttttatgtaatcaaatgtatccatcctttcctttatgaattttgattttatgtcttgttcaaaaataattttcctatgcctaaggctataaatatattcccatattttatagattttaaaataaatgtaggtctttaatcttcctggaatttaatgttgtgaatgatatgatattaataagctaccacagaaaatagatggcatgctcaaaatgaggtgccagaggaaagtttaataagggtctattcacaatggtgggggcaaaataacagtgaaggagggctatacaaggagggcctgaagaagcaaaaggaaaaggcagagaggatggggtagagaggaccacccctttacaggagctaagaccttcggttaagggaagcaactagcctcaggtaccccaaccctactcctttctctaattccttgtggactctccctttggtgtggctccaactacaggaacacagagcccattgatataatctttacggagtattctcagtctttaactagggagcagaagagtagagcaggtatccagaggaacaaatcaaagatatccaccatagatgggaaattgaaatctacctatttttccccaaatgggtagttgtcccccatccatttatcaaatagtttattctttccttgatgggctgagatgctacttcattaaatgcaaaatttttatacaggtctggtctgttctgttgatctttttatgtattcttgcatgaaacccacaccattttatagtgtaaaatggtttgaaatggttatgttttgatagcaagtcattgctcattagtcttctagttcaaactgttcatggtcattcaagcagatttctaattcctgacaaatcatagaataagtttgttgtgtttgataaaaaatcattttgggatttcgaatggctttgcactgaattaatagtttcccagaatacataagatgcattctcagtcaaaaacatggaatgttccatatttattttggtctttcgtatccttcttaaaattttgtaatttttcttcatttagattgcacattcttgagaggctttttccccacataggtaatttatagttttatttcttttgtgaatgggatctttgtcttgttgtgctttctaatcattgatcccttgtgtttagaaaagctatcaatttttgtaccttaagtttgaatttgggcactgctgaactctcttggtagttctactggcttattctttcattcttttgggattgtcgatgtaaatgatcatatcttaaaataatgaatatatatatataccttttgtttcttttttatgttttactttattatctagcacctctagtacagtattgcatagtagtattcatgcttattccagattttaatgggaacactattttacttttaagtgtaatattcagtattacagatttcaaatcagtgcctttaatcaagttgaggaagaccctttagctaagaaacttcccttctttatcatgttgaaggtgttatttgggaaaccaaccaaccagtattccatgtgtaagagtaaggcaagaagtgtaggcacccagagtataccagacattgagaaagattcagggtataaacaatgatcctgactttcaaaacactttcagcctagttgtgatgtatattaaaatatttatgcaaaagctagcaaaccgaagacagatattaatgggggacaaattaaacatggtaagagttcagagaggagatgaatgaggaatggaaaaatcagagcctcttggaaaggttagcagttacatcttgaagacagtgttagggtttggataaaaggacagaagggaagaggttattccaggtaaaaggggtggataaagtgaaaactgaagtgagagcaaacatggcagccctagaagacagtagacagacctttcaagattaaaaagcctttggggacaaaatctattgctaaatcatagagtccctccaatgtcaacaggaagagattgaacttgattctaaagtagttgagggagccattagtagttattaaacagtggactgacacactgggaggaatgttcattaaaaagttaataagggtgggccaggtgtggtggctcacgcctgtaatcccagcattttgggaggctgaggcgggcagatcacctgaggtcaggagtttgagaccagcctggccaacatggtgaaaccctgtctctactacaaatacaaaattagccaggtgtggaggtgcatgcctgtaatcccagctacttgggaggctgaggtaggagaatcgcttgaacccaggaggtggaggttgcattgagcggagatcatgccattgcactccagcctgggcaacaagagtgaaacctcatctcaaaacaaacaaacaggttagtaaggatacttaaatctggcagcaaagttcaggacagataaagagggggataccaactgtgctgcagagccctcacttgtaaaaaggagcatttgtgttgtggtgtttgagtaatattcctgggagaaggcagcctagtagataagctgcacagactgatgaatgtctatagatgacagctctgaagcccacgtagctggttgtgttcctttgcccaggagtgccgggaaggaaaatacatagcaattatgactttccttttggcacaaacctgacaccatttccattttccatttggatgcaaagctttgaacatttctaaattacagactttccaggcagccctccttatagacttctccctacaaatgagcgacccagcacttaaagtttccctggcatatgctacaatgctgcaagaatgctgcaaaccatcatagacaagtagcgattgattaaaagaaaaagccgccatgagtagaataaatgtttacagaccccaccagaaggaagttccgtacccttcagtctgacaaaagttttatctcatgaagtgatcctctgtttccatggatttgttacctttggatagatttccaacacttacttgtcccttcctggaagggtctgagatgtagatcatccgtctcctgagaacacactcatttggtaaaccattaggaaattcattcttaggaaacagtggttggtaaaaggcagacgtaagagacaagagccaggcactgttctgggtgcactacaaatacttatttcatcctcatagcaaccctatgaagtagatatgaaggaggaagctgaggcacagagaggttcagtaatgttcccaaggtcacagagtaagtgacagagttgggattcaaacagaagcatctgggctcccaagtctgtgatcttcatactgtactctgccatctcagtctgatgccacagggtcaggttgaactctgactcttctctccctccaacatcattagagccagatcttggctctttttttatcactgctctacattcattgcctaattcacagacacttcttgcattactcttacagaaacctcctgactgatcactctagttccttaccctctggtcctcctcacgctggtataagacttgctgtcctcaggcccatctgagtcacaccacttacctaacacttgaacagggctccccagcaccttcagataaagtccaaatcctgatcagagcatataagggtgcctatgaccttcaccaggttcctcaccagccttccactgcatctctctctctgaactctgaatcctccctagcctttcttgtctgtccattcctttggtagcacttactgaacacctcctgcttgcaggcagtaaggacacagaggctgcctttgaggttggcacagtctagggaaaatcatgaacatacaaattgggtccacagcccttcatccacaaactgaaatccagaaagctctaaaatccaaaagatttttcataactcatttagggccaaaacctgccctaaactgcctcaaagttacgtatggtctttttgtgtacatattaatgtgtttgatggtgagatgctgtcccagaccctgatgggggcattacaagatacatggaatgtgtactatattattcaaaatattcttaatttcaaaacatatctggcctcaggtctatcagagaaaggaccttggccctgtcgatgcaatccagggtgggaaattcagtaatggaagcatcactcagggtgcttaggcagccctctggcaggactgggtttcatgtaaatgttaaaaagaagcaactcatttcttgctagtgaaataacctattcccagctgcagctgctacaagatatgagaactcattcaatgtttctcaccaccaaagaataaagtcaaaattccttaacatgatgtctaactctgtatatttctagccacctttacaaccttatttgtaggaactcctccccacacaggactctgagcttcataaaggcatagatcaatttcattcttctttgtggtcataatgtaggtcagcaaatcacagcccatgggccaaaactggtccattgcctgtttttgtaaataaagttttattggaacacagttacgttaattcatttgtgtactgttagagctctatcaagctatagtagcagaacttaaaagttgcagtggagaccatatgtcctgcaaagcctgaaatatttatctggccctttatagaaaaagtttactgactcctgttctaatgtacactccagcatcaggaactcgaaaattattgattcttgtcctaggttcttctaaaagcccagctgagacctaagtttataagcaggtagtttatttgggaaatgatcccagggatcaagagtgaagggtgggggtggtgatttggtcaagtgttattgacttggccaccactgcaggccactggtgtttgaccccagttggggcctttggagaaggcttatgacatgtgtctcagaacagtgtgcccagggtaaaccggggaagccactatccattggcctccatccttcactaatcaaaggtggccccatagcattaactctcctccacttctgagatgcatacatgtgagtattcttaagattctgaacacttgctgcagcatcagagaagctctgggacaggaatcaagtggtacaccatgcaggcaagacgtgcatcatcccattgcagtgggggcagagatggtcaagtctgtacagagttggtcactgcaacagtggttggagtcagagttgtgctgagaggatgtgaagaggggtgtagagttgcctattatggtctgaatattttgtgtccaccccaaaatccatttgttgaagtttaatccccatcgtgatggtatttggaggtgggacctttgtgctataattagatcaagagggtgaagccctcaaaaatgggattagtgcccttataaaaagacacacagggagagatgtggtggctcacacctgtagtcccaacactttgagaagccaaggtgggaggatcgtttgagtccaggactttgagaccagcctgggaaacatagtgagaccttgtctctacaaaaaataaacaaaattagcctggtgtgctggtgagagcctatagtcccagctactcaggagactaaggtgggaggattgctggagcccaggagattgaggcttcaatgagctgagatggcaccactgcactccagtctgggagacatagtgagagcctgtctcaaaaaaaaaaaaaagagagacagggcttccttcctctctctgtcattcactatgtgaggacaggaggagatggccatctttaaaccatgaagagggcctttacagggcactgaatatggtggcaccttgatcttagactttccagcccccaggactgtgagaaataaattctgttgtttataagctactcagtttatgatattgtattttgttataacagcctgaacagactaagacagtgcccaatacattgattaatcaaataataagtagcttatatttattgctaaccactatgctaaatgcattgcatgtcttatatatgtcttatgtaattctcataaaagccctatagaattttcactatattattcccattttgttcataagagagctgatgtttagacagttgatgtaaagtaatgaggcctgggacttcaactcacttctgcctgactccaaagccctaatcaccactaagctacactgactaagcttgactcccctccccacagctcctgcccaccttctgcctcagtaggtctgtcaggagtaggacagagctcttcctataaccaggggttggaggtctacctgtgaggtgagatattgttccccaagtgaggaaactaaatgtcacttagaaaatggaaaacaagcccagggaaactggcaagagaaagacttgttagtgggaagagaggatgagtattaagaagcaattagctagcactcataatactttgtaatttcgtagggctcactaactctttttatcttcaaagaaagtaacagaaaaccacatgcaatgactccgtgtgtgatttagaggaaaatggcagggttaggaggatctgatgtggctggggcgaagcttaccccacagtttttctggcattaggtagcaagaggaactacaggctcctttgttgtaagtcagggtggttttacttcaggcagcctagaacctcaggaaccctgaccagggaggaagcaaggagtcaacagaaaagggactaggaaacccctgaaccagctaaagtgtcagattcttgggagagcagttggaaagaccaatgccatggctaaatgaaaacatgtgcctgattaggaagactcagataccccagaatctgccatccaacaggtggaatccagatgccagaggttctcgggatgccagtgggagcatggctccaggggatcagtccaatggcagcagagtttcattcaacagctgggatcccaggtgcaggatccagcccccaggggagaaaactggaaagaattaaataggaagtacaggctgccgaggaacaggccctagacagagctctaggcacagcagtaaactgaagcttggtgggaagactaaagcactgccagattgcaccaacatcgtggggatcctgggattgactgcaactttgttggcatgcaagaacacatggcccgccctatttgtgagctagcaccaggtctatggcagcaagactagttccaatcctcttccactgatggagtgggagttgccaatatattccctgccctggtcaagttgggatcaaaacggaatgtttcaaccctatgaacatttttataattgaggttaaattcacataacataaaatcaaccattttaaagtgatcaattcagtggcatctggtacatttataatgtgcaaccaccatctctacctagttctaaaacatttccatcatttcaaagtaaaaccccttattcattgagcagtttctccccattctcctctccccaccccagcccctggcaatcaccaatctacattccggctctatggacttacctattcttgatatttcatataaatggaagcatacaatgtgtgaccttttgtgtctagctttttttcacttaacataatgtttttgaggttcatccatgttgtagctttatcactactttattcctttatatagctgaataattccccattgtatggatataccacaatctgtttatccctgtgaacatttttaacatgagatgatcaaaggataaaaatgagaactttgggcaacagtgaaaaagtatcatggtattattcctacattaacttttcagtccctatttttttaaccaggagataattggcatgttgcctcacacctaagtcccacaccatccataggaaggacagtaatgactccaaacaagagtagaaaaggacaaagaaatggttttacacctactttgtctttcagggtcacaaagtatgaaacagcctgtcccaaaaatgggttgattagatctttggacacccagtgtgtgaccacagtgcaacaaagtcatatacttgggcatttgttccttcatctggaagaagcgagggcagaagccacctgaaggtcctcagtgctgtggaagatggcattcctctatagatgctctcctgctctaccactgttcattctcaattactaatcaaataagtgcacctgagttatttacctccctgcaagcctgctcacaacaaagaatacccaacctaaagtcagtgaacaataagattgcataagaagaaagaatgtaccacactccctccataattaattattgtgggctgatttcagctacatttttccttgggcattttcctaacagttcatatttaacagtccctggaagccaggaaaacagaggagaaaaagctcctttatgtcttagttctatgctattcataaatgaaaatcattgttaatttagagtttgacagctgtggtgcacttgtaagtccagggcagctgtcatcagcactccagtttatttttcaagcacatgtttaatttgactttagcgctattgccagttcttaaggagaaagagggggaagcagaaacagaaataatcattatcttcatcatttggtttcctttcaaaatgtaaatcggcatgattaacaatgatatcagaattgctctaattgcagttttgggtgcagaactagttagctatcatctcctacatggtccaaagtctagttttcttttctttttttttttcctcctaaagtcagagggtgttttgtggtaattacacgcagactctgaacaacagtcccagctccacagaaaagccttccaaagtgcagaagaaaatcaaaaatcaaggaatggggaatgatgggggtgactaggccacaatcccagatgaaagccacaggctgagtcttgtcttgtggctctggaatcaggaaaccagcgagagcaatcagagcccttggaacagcagccaggatctcccgctcttacatatctaccatgcttctgcggccaggcagctggctttgtacaggctcacagtgtgcaaatcggtctcaaagtataaaattaaacacatctgtagctccacgtagaaatctgatgagtcagtatgtacttgatcgggcccactgttccagtccacgttgcttggaggaatcttccttcgcaccagctgtgatgctagctaaacccacttcctggatctttcttcaccctcatttttatatgtgtggcttccggaggtctcacttggcctttattttttgccatctgtcatgtgtccaatcacaatgtcccaaagaacctctttgacattgcctctgtagtggggacagtagatgcaataacacactcctatctttctatttgtttctttgtacattgagatgaaagactgccttgccttcttcatcagtcaacatctcgatatgtgctatgctaaaaaagatcccacccaaaggaaaactttggcaaatgtcctggaccccagctctgaaattaaagtttgatagaggaacaatctacaacttcacccttctagtgccggaggatcctctagacagaactaaagatgtagaccctgaggggcaagtctgactcctaaaagggtagtcttccgtctttttaaatggaaagtattatttgtagattatgagatcagaactaattcttccttaacgatagaaagaccaggcttctgccaggttaacgtcccaagaatctgtgagaatccttagggaattataaacatgtaccaaaaactactggctgttgcttgttgcttgccaccttggccatccacctggggctaggctctggatctgttccgtgggcagctcctctccctgcctttgcctcaagcttggactccaggctgtccattagtacccacattatggttagggccaaacagcaatggttaataagatgttgaggacttggggagtgccccaaagtcctcacagagatcctacataactggactaagggttggctgctcttaggcccacgagcccaagctcatccttagaggttccctgctctcagctcctggcctgtctcacacaaggtgggcaccaggctgcctgcctaaccccagtggcctctttacttctccttcaaagattacccctgtacaagtcccaggttgccccaatttccagacctaactcccctccacactagtttgcttagcattgtagttaagaaggtggacttccaggtcaagtgatctgagattgaagtctggcattaccacttactaatgacgttaggcaagtcattttagacacccagtgcctcaggtgcctcccccataacatgggggtggtaatattaatagtatgtacctacctcatagagttgctgagaagactaaatgagttagtgcatgtaaaattcttagaacacttcctggcacagaataagctctaaacaaggctatattattaatgttgctgttattactattgctttacatttgcaataaaacaaagatcatcatgtagatgtttcctaagacaaagaagtggtctacccaagaagtgaatttcagtttctggtacttaggacaaaaactgtacattttaaaggtcgtttttcaagcttcaaaaactgtttagtcacactggatctccatttcttttacttgcttgctccttgccacttcccataaagaatatgaagtggcattaagaaaaatataaaacaaagtggtcgtgttaaattaaaaaaaatcaagaccagggaaaatcaacattaaaatataacatcggctgggcacggtggctcatgtaatcccagcactttgggaggctgaggcaggtggatcacgaggtcaggagattgagaccatcctggcaaacacggtgaaaccccgtctctacttaaaaatacaaaaaaattagccaggcgtggtggcgggcatctgtagtcccagctacttgggaggctgaggcaggagaatggtgtgaacctgggaagcggagcttgcagtaagcggagatcgcgccactgcactccagcctgggtgacagagcgagactccatctcaaaaaataaattaattaatcaattaaataaaatataacatcaagacaggaggaagatctaaagcatgctaagggctctaaattctcatacacttataagagcactggattacaacccattaaataaaatggaaataaactaaataatataaataatataaataaacacatataccagttaaacaagtggatggataattggaaagtttgataaggaacaggaggtttctataatctcaaagtacttgcccttgaaatacttaatcactaaaaagggagaaaagcaagaactttagaatggagaaatctggcagccacctgtaatgtgtgccacctgataggatgcaatgagaagaaaacgacacagtgccacttctgtgatattcctgctagagatgcataacctgaatctaattatgaggaaacatcagacaagctcaaatattttacagaataaataacatgtaatcttcaagtttcaaagtcaaagactgaggaagattctagattgaaggaaactaaagtgacatgaaatctaaatgcaacactgtgattctaaactagatatattatctgcaacagaacaattgttgaaatgtgaatagggttcgaggattagatatatcaatgttatctaatctcatggttatattgtggttaaatgggagaatatctttgcaagaattacacaaaaaaagtacttgagctgatcagcatcatgtcaaccacttactctcaaatgcttcagggtaaataagttttttataccgctcttgtaagttttctttaaggttgaaatggtttcaaattaaaaagattcagggttgccagacacagtggctcatctgtaatcccaacaatttgggaagctgaggctggaagattgcttgaacccaggagttcaagaccagcctggaaaacgtagtgagaccttgtctctacaaaaaaaaaaaacaaaacaaaaacttaaaaataaaattagctgggcatggtgatgcatgcctgtggtcccagctactaaggaggctgaggtaagaggatcactggagccaggaagatagaggctgcagagagccatgattgtgccactgcactccagtctgggggacagagtgagaccctgtctcaaaaacaaaaaaaggactcggcaaaatcagggggtgttggggtggagaggaaaaaagagctatattgacatctttccttccttcctttttttcttttctccctggcttttttctctcagaaggttgggccaagattttgatgagaagacactgggttcaatcaggaaggcaggcaaggacttgccagacctgaggggctgagctgagttggttcgttcagtgatccttcctgtagtgtgtgtatactaagcaccttcatcacatcccaagtgccataccagacagcaaggatacagagctgagcaggatgcagcctgtgtgaccggagactcgcagagtggtgggaaatgagccagtcaacaggcagcaacctcatggtgtgaaagggcctccccgagagaagcacagggcggagttgggcaggtacccatcctggttgagggtggtgaggaaggtccagacagcagtggcaaaaggcaacagatgaagggaagcagcggaaacagtgtgggattgtccctagaccagagaaggcaaggaacattaggggacctgcaagcaggtggagcaaggaggactgtgattggggcgaaggtgaggccatggtaaggagtgggtgctcaatgaatgttcctctttttctgtactttccttctcttctttatcgcttcctttgccaaaacatcccttctttgagcattcagctgggtattgctctaattttttaatgacagtaacaattgctaaaatatgtgcccacaatcctataatgcagatactattatttcctccattttacagagaagaaaattgaagcacagcttgctcaacatgatatagctcataagtagcagagctgagatttgaaccctggacagtctaactgtgtagcccaagcttttgatctaccacaatgccagagtacatctttaacaaggctgaatcctcaggggattatgtcttttataaagtgtcttgagggcctcaatagttctataactagaggggtaaagggagtggggatcttacaagctgtgtctgttggtgcatcttacccattccagccacctcccctcatcccactcactgccttttcatgcctgccctgttatcagttgtgtgggacctgcaatgggtccagggacacaggcagcctgggctggaccagtgagggttttacccagggtggctgcagagtcagcacagctcatagtggaggagggaaacaaagggtcaaatcaaagaaggatcaggtccaaagggccctcagggggaaaggctgtgcccagcaagaaactgggcacaaagttgggtcaaggtgagctgttcgggatggaaactgaataaagcaaagtcaaaatgtaaaaggtgaaaaaggctcttttgcatgtggtctcaggcaggagggaatgggaaacatactttccaccaccgtagaccccccactaccccctcagggctcaattatttattggacaaatatttagtgagcacctactatgtgccaggctaatgctaggaactggggaggaaaggagaaaaaacaaggcagagagaccagaggggctggcacatgaatattcatctgagaacctgaaatgccaagctttctttggaaccaggctgcatttccattttccctttagcccctggaacaaagccaggaagtgacagagttactggctggggaagagtgtgggagggagggaagagcaagttccccccagcagccgctgccacagtcatttctaaaacaggtttttacagaaaagcctggttattccattattcctctgcagccaggaaaaatccccctttccacacctgcctggtgatcaatacagatgcttctgctaattgtgttgtcaagaaggtccttgactggttctaagcattctgttaggcaaagcttcccccttgcaggtgggttttagggtcagacaggtcaaggttggaatcctggctctacccagtctgagcctgttttcctccttataaaatgggaatcaggagcaaaggcataggaagtacccctttacatttttaaaagtaatttagggtttgcagagcaccttccgctctacccccccaactacttttgctaggtcaacatcataataattgtgagaaattgaagctcagagaggtaatgtgatttgaattggatcacacagaccctgagtataaatgtcaagatatagaaactcggccttcacttttaaaatagaaatgatttgctaggcttttgtacattttcttttgtgatggtcaaaatctactgcctaataccaaggatacctacatactatctaatacccagtagttttagctgggaatttccttgacaaatggaaggcaggagagcccagtggagaagggtatgggttgtggagtcaaagttgttgggctcctaatcctggactacctcttaacagctgaacttgagcaaggtacttgatccctctatacctcagcttcatttatttgcaaaaggagtactacctacctcataggcaggagaattaaacgagataaccagggattcttggccctggctgcatattggaatcacctgagcagcttttaaaacttacctgtcctttggccccacctctggaaattctgatctcatctgtctggggtggaattagggcacccaaatgattctaatgagcaaccagggctgcaaaccctggaactaaataaaatgtctactacagagtgcctagcacatcacaagcactcagtagatgctagttatcactgtcatactggttggtgataaaaccaaggcatgtgggccaacactgatccattggtaccaacatccagtaggtcccagttactgtgccatgcactgtgggtagatacaacggtgaacaagagtgagtctctaccttataagggtttcattaattctctagtttggtaaaaaaaaaggcataaatatgagaagttataataaatagtgacacaaggtttaaaggagaaggaagaaggaaagataaaatttttcaagctcctatctcatgctaggcactttctacaccaacgtagttcattaatgcacacaggagccctataaagtagatattaagctcaatttgtgggacagaaaactgatgctcagggaagaaattcacctacacacaaaacagctagatccagaataaaattttatctgcctgactacagaggtctttctattgtaccatgtctttagcacactgatttcatggtgattataagaacaagtaataagctggtaagaattagaatgtagaaggttcaagtccttatgtgtgtgtgaatgtacacaactatcatctatctgtcattctatgtatctatcattctatccaattatccatccatccacctatccagtcatctaattctgttatccatcattggttgtaaaattagattttcagcttaatcaaatatttcagttaataggtcaagcttttaaattactcttaattaattctccattttcctgcataaaattaaaatattagcattaagccaaacaatatatcacttccagtaaatcatggaggaataggattgctgatgttattctttaaagtgtgctaatggtatcagactatttaatgtagattaactaccaggcctaaacagtaatacaaatagaggaaaacaaaattaacgtgattaaatacacttggaggctatttagtcaacagtcagattgcagacatttgcagctgcagctccaaaagctggttctcttctcagctgtcactaattaatgcgattttcctaataacagttttctgatagacagacagcatcaaatcaaaacaacttcatttttatgctgatgaggcctaactactgcaacaagagcccaacagatgcaaatggcaatgttgctaactgcaggcttgcatgtggtcttaatcacacacaagttgaccatcagtgctggaagtttattgcacaaatacatgggatgtgggagagcttggctagttacatcgtcacatcagccttggtagtactgggtcacagtgggatataccacagctctaggagaaaagtgctctagacaattgtccattgctccggacctacacctgtgtaagtgactcatcttcccttaatttgactgacacttatttttcccaaaagacagaattcaagcaggccggttcacatcattcaatattcagaacccttgctgggcagggtcagcaggaaggcaaccccaaaatggccagcatccctcaagtctaatatggatgactttggctcaggcattgatccctggtgtaatcaattgcagttaatcggtttctccaaagcatgttacataaatcataaatatttatggatcaagaaactggtttacatttcctaagaagggtactagacacatggaaggccaggatttactaccttttctactgacaaccagtacaatagcatcgcaaactgggccaatcagtggcatttgacctctggccatgaggaacttctggtcatctctaggggagcttgaacagagaagaatccaaattggcaggagagtgaattgtagattttcaagaccatgtcagcccagagaaacactgtacatattgatgcctttggatggagaggcattaaatacagtgcaaaatgttattaccaaaagattgttgccaaatatcctccgaggataagaattctgctagttgactttcttgaaatgcatctcactttataatagaaacatccttcacatggagatatccagaaagctagggaaatgtacatcttaatctcatggcccagactcatccatttacaaacaaagcagtgaccaggacaaagaccctggaaaaagtttgggcccaccacactgtgagggtccagctccagggaggtctgttgtgctgcaccatggaggtggcaactacctggttttgctcttgttcccttacacagatgaggagatagagacttccccctccttccctctttttttcctctcttctcggtgatttctacctatcctactttgtaaaggttttaagtgttttcaagggacacattctctgaagttcaactccctcatgtctcccagatgtgcaacatggaaatgtacatgttacattgtcaaccttaggatatagatttttacttatgtattgggttttaatttattccttgccaacttgaaaacaatttgcagtaccttgtttcacacagacgctccagaatgattcccaagtctcccaacataaacatgagtggtttaccattaaaataaaaaaaattcatcatttacattctgctctgcattaaaatgggatcacattaatttcttttccacattattcactaagaaaactagagttcttggtttccttccttccctcccttcctcccttccttttttcttcccttctcccactcttcctttcttccttcctttcttgtagctgaaaatatttctgtgagaaagattaggaaacaggacagatcatgtccggattttgtagcttacatatggtctcatgctgttgccccagaactctgtgagggtccaagatgactgtggcttacgtctgatgagcttatgccacataaggatgaggtcagatgctacaagaggggcacagacattgaaaagaagaaacatggggcaactcaatggatgagcaaagttgaatgcgttgtgcagtcagcaagtgtcttttttataagaaagctctgtgcttggtttcacctcctggtgctggacataccatcatcctgctgattcccaacattgtgaagggattttgagttcagcctccgtggttccttttgagaacaatggttgccatcagccaaactgcctagcttggtcaaaacacagaaggcataaacagcctttatgcagtgggaaatgtttcatgattcagaccagtcactgtttgctgatcacacagcactctgggtggcactgctaatacagaggagtttgtgcttcttgccagattgtggacatatggcagacactcaaaattatgtgttgaatataaaagagttgaattatggggaaagtcagtgtattgaaaatgtatcacatcagcacacctgcaatgtttcctgtaggaaagctcagtgccaaatgttagagggtccaccagggaataacaaggttcctaccctcaaaaagcttggaattcaggcagaaatgcaaaatataaacatgcaataaatcaaaggataatacaagatattaaataaagttcaagcaaacatcaagagtacccaatgcctgaatgccaaatgaacagtaacaacaaactgtgttctagaagtctggtggagggacaggtcacttctgatggtcctggttaatgcggctctgaggaggaagtgagatggtgacagatgattgggatctgacgaggcagagaggagggtagaagtgaggaggagacatgtgacacacatccacacagtaaagctgaattcaggtacttggggaggggggtatcagacctgaaaggtggcttgcaccccagtgttcagaattgtggatgtttagccaagacttcggactataacctgtaagcgagagaggagcctttgtttagagaggacctactgtgtgccacaccctgtgctggggtgtggtagaggttgggggtgggataattaggatgtggtgccatcgttgctaacaatgtgtgaaagaaagtgataatgaagaggtgatgatcagtcccctggcagagcataggtaaatgggatgggttggcaaggacaggagaccattaggaggttactgcagtaattaaccagaaaatccttcacttaatcttctgtgtgtgtccttccttagggtgaggtagaggggagtcaggtgggtactagcaggcatgaaaatcaaggcttctactttagacagctgctcttatagaatctctccccaaagcaatgcacatgcttacaattttgcatatactttccatacagttttttcaggggttcaaagatcctctggaaccaatcatggtctatgaggtcctagctgagaacagtgacccccctcccacacctccaaccccacctaaagagcaagcatctcccaacagccagttctactactctacaggatgctcccatttccacagcagaaaacctgagtgagaggaaacagaaagaaggcaggtggcccgccctcaaggaccttgctctgtcacctggattgtttccttacacctgagaggacagtgctcttgcagtcagccctagtttgcaggaacccacagaagcgggaggaggctgaagccaaggcaaagtgggacgaactgcggagagtaatgacttgcatgaacccagccaagagggagcttgcaatgtggcagcatttcctcttccttagaggctggggcgattatatgattacacccacgcccagccacggagcagcaaggactcagcacagaacaccggagaaacccaagagcaacacttcactttctatttcttgttttccagctgagacaggttctattttggatcagagcatagtctggagagaaagcagttgaagtcttgggtgcttggaataaaaatttgaccttaatctttaggaaaaaagtgtatatcttagttggaatattttattaaatggaatgacattcatgcccttctgcgtatctactgtcatatatttcagacctaatggtgattcttaagctttgtggggtcaggaacccctttgagaagcagatgaaagctatgaattctgactcagaaaaatgcacttgtgcacatcaaacaaaatttcatcatcctaaaacctgtctgcaaaccctatgttaagaactccaggtttgataagccttggccagatcctctgttaggtcctaggaatgcaatgatgaataagacactagtccctggactcaaggggctctgagtttaaggaagtgttgtttatagatgtgaagaggttggcagggagagccagggaggtcaccgaatagcaagtgaactgtaagaggcattaatagtcaccagctaaacaatgtcatagagacagcctgccagttgtcccttgactagtaataccccaggtaccactaatcaattgcaaaatgctaagtaatgtgctaaggctgattgaaaaataaaagtaattttttagtaacatcaaactgaaaaataaaagtaatttttcagtaacatcaaaccccttgttcatgtgttattaagagaaaagattttttggcttaatgatgtatgtgagatactgccttcaccccaggctcagggattagacaaatatctctttgcaaggttaagaaataccatggataatttcaaccagaggaagaaaaccattaagggtcaaaagacgctggaaaaaaaaattgatagtttggtttaaaacaattatagaaaatgagaaatagtcctgttaactatctagaattgcctgcctgtcagagcttccacaaccgggactacctcctgcagcctatttatttcattcatatgagttgaagagttttccaacagctgacaaatttccagccagtgatccagcaggtacccctaaggatttccgctctttcctgagcttcaccttacaggcatgtgaaagcttcctccagagagaaaaaaagtatttcccttgcttgtgttttcctgtcaaactcctactcacaacccccaccccacctttcctttacagccacatctctgggatgtaaacttgaaggcctgacccagcacagggaccctctggttcccaaatccaaggccttcttataaggccttgtccacagctgtccctcttctccctcttctcagtctcttctgatgaagggcatccctgcccctcactcccaccaaaaaccgtcagtgtgggagcaatagctcacacctgtaatcccagcactttgaggggcctaggcaagcggatcacttgccaggaattcgagaccagcctggacagcatagcaagaccccatctataccaaaaaaaaatgtaaaaagcagccaagcatagtggcaggcaccagttgtcccagctactcaggaagctgagccaggaggatcacttgagtccaagagattgaggctgcagtaagctgtgttcatgccactgcattccagcctgggcgagacagtgagactctgcctcaaaaaaaacaaaacaacaataaaagacctccaacagctccccagtggtgcaaccttgtggcctacatatgggaccagacagagcctgactcctcctttcctctgaactgccctccctatatcccaccatgcctctttccatcagttaggcacacatttaagagcagcattcattacaaaggttggctgatgatggcttcaacaaatagaggtttatttttcccataccacaagaagccccagggtaagtgactgctggtattctttcagcagctaaatgatgtcaaggccagtgtctttgtgattcttcttggcctttcttcatggtagcaaaatggcttgccttgttccacacattgtgtttgtaagggaaagtccatggtgggtcatttgtttttcttacctgggaagcaaaacttcctcagaaggatctcttttaggtgtgcagctctactgcgaagttcctgtccctggttttacagacttagtctcttccatcttgcaaacttcccgttatgttactgaggccacatgtgggtcacatgtcctaccaccagcagcaaggaaggctgggaaagcaggaacaggactatcatgactggcatgtctgatattaccccaaacaaaatgacagctctgcaagtggggaagatggagggaatggatgctgggtagacgccaggacttgctgtgcagtgttctgattcaacagattacgtcactctcctgtcaggtgggcaactatttggtatcacacaaacaatagcttattcatctttgtatctctaagtcctaacacagctttgtggcacttactctgttagacaaacttatgagtaaatgaatgtctgtctggttttaatacctctcacatctaaagtagttctttttaaaacacaatccagttttattcttgtctttttatatctcttatatgaaaatcaattcatcattagttttccattggatttgggcagacgggtaagttgtaaagtgctagagtaatggtattgacaagttatatgatgaagttgaacaatatgagagaaaatgggatcatggtaaccttgttatccctaggtcagtttaactattgaagaggaaataaactgagcactaaaactagctttcctttagtttttattaaaatcagaaccagggctttgtagtgtaactttgtgcaatgcgaattgagagcttgagaaatccaatgaccacacaagtttgggaatgggttgtagtcttgttaagagcctaaccgacctcttacccaaattctggtaataatcaaagctgcacatgggtgtgcagcaccatgtggagctgatatctctgattcaggtcgagatgtctgctcagagcagagaacgttgtttccaagggccacagatggtgggcctgccaagggtctcttttaggtgtgcagctctactgcaaagttcccgtccctggttttaaaaacttagtctctaggactccaagtccaactcctgtgccatttttccaagaagttacacctggtcaacctcatttctaccaacactttccccaactccacctcactccagccagaaatggccaccctccgctgagttgtagcacttgtagatgattgtttgattgggattctaacagatttgtgttgtgagagtcattcgggtatgttccatcatagagagtgccagagtttctttagaatggcatgatctagctttcatctaaccttattgcaccatttggtacccagactcaagcccagtgaattgtatcaatgtcaatatcatggttgtacaattatacttaagttttgcaaagtgtcaccattgggagaaaccaggcagagtacaatcactttgtattcttttttacaaccatatatgaatctacaatatctcaataaaaattttaaaaataaaaatatttctttctaatccccctgtcttttgtgtcaatcctagcattactatgtctccctctagtcattggtgttcgtacctaggagtcagttcccttacctccctctatctcagttttctcatctgtaaaatagggatgatagtaatgcctacctcttggttggggggattaaatgagttaatatttgtgaagcacataggaaggtgcttaactgttaaataaacaataaataaataaaatatcttatgcttaactttctctttctgccttagatccaatatgctataagtcctgatgaattttcctaccatgtgtctcatagagtctctatttcccatgcccctttctcagttctgaccttcagagccgccgccatcatctcctcctcttgaagccttgccattgtgaagttagtcacttcacctctgcctcccatggctcctccattatcatgttccacattgatttccagtttcctttttctgtttatctcttttcacccactagcataggagctccttgctggaagtcatcgtttcttattcctctttgaagtttcagctcctaacatagtgcctggcacaaaatgagtgttcagcatatgtttttgagtgagtgataattaatcaggaataatctcatttcagctactggaattgcttttttgcagtcatggtagatgacctctgaatctatagctttgtgaccccaagcagagactgcagccttaccctttaactctatctacaagtcatggagtcttgtagatagagtcttgtagatagagtcctgcagataagttttcacttttcttctcccatgggcccactgtcttgggcttcctggatacttgttaactcttgaacatacctccatttcttgagacccacctaaagccatatacaagattggtgagtgtgcatcctggcatgtacacagcctttggataaatatgcggccatcgttcagttagcccttggcatccttgtgaagtaaaataagggagacggcctcagcatctgatattatcattgcagtgacttcaatatttgattcctgggtcatcccacagttaattttttcattggtagatgggaataaatattgctggttataaactggaccaactctatggaaaacattactgagatcatagagaaattttataaagtatttcaagaaatattcagtaataaggattttactggaattgggaagaaggctggcaaaaatagtctagagaccacaaacccaaccttcattttggcaatttattgtctctgtctgaagcagctgactaaggtaatactctcactcctccttccacaagcaaagaaacagacctgacatcaatcataaaaacaactactgtttattaagtacttattacgtgccaggtactttttgttaggggctggtgacttaacagcagcaatgataatgaccaccacatactggatatttaccgtgtgcaacacaccacagtaggaacttacatgaattgtctctatatggctgtgacacattccctgaggatccaggtatattttttaagtcatttcatgacctgatttctcccaagtacttcagtttctgagatctctctctcccgggagcagggaccccagccccttttagcactagacagcaaacccacaacttcacaaactctaacttcaccccaacaggcagattccctcaggaaaaagagtggtaaatgaataaaccctccaaacagaaaagggctgagcacctaagagattcaggatggcatttttggaaatgttcacttcaggttgaaaagaaaacttttgaaatgattagtgagttatttagaacctcaatattctaaagtttgagaagataacatactgaggaatttaatttagatttccttaacatgctctcttatgataagagagcattcagtatataaatgctatgcaacagtactgccaaattgcaacacagtatgggagaaatttgtcattttgaaatgctaagggagttcttactaacagctttctcatcttgtaaagctattatttttctgaatgataatatgatttataaacctcagctgagttttatagttttgatgggaatagactcaaaatgcattttctcagaatataaaattctctcaggagttgaccaaatgaggaataaatagaaacttccgcaaccaagtgtaccaaagtcttggtctccactagcatctctgtaggtgaatgttggtcttcctcagggttctgggctcagtttgactctcactctcaactctgcacgctttccctgggtgacatcagccactccaaatcctttgactcttacctaggccagcaactcccacgtccacactcccattccctcccagctttccagagttacaatgccctatgtctaacgacccactagactgcccaccatcacaacctaagccacattagcctcagattctctcctgtccccaaaccctgttccttctcctagaacattggtagtagaatgatactaacatttggaggaataaggtacgaatcttggaatctagcacaggagactgaaaagtgaataggtaacaacagaactcagggaggataaatgaaattcatacataatctaacctttttttttgagacggagtctccctctgtcatccaggctggagttcagtggtgcaatctcagctcactgcaacctccacctcctgggttcaagcgattctcctgcctcagtctcccaagcagcatgggccacctcgcccggctaatttttgtatttttggtagagatgaggttttagcatgttggccaggctggtcgcaaactcctgacctcaagtgatccatctatctcagcctcccaaagtgctgggattactggtgtgagccacagcacctggccccataatcgaacattttactgcagaatattgatgtgtttgattatagaggtattagtggtatatgtacaatcttaactttctgatatctaaaagtttctgaattccaaaacatattccagaccacgggttttgggtgaagaatttgaggacctgtcatatataaagcataagttatataaggtaataatgtatattaagtgcctccttagtgcagactagcacatagtaagggctcagaaatgacaacaattattaaaaagaggaaatgggttgccttagactttatagaatattgaggaagctgagacatcttataggaaatacatgtttttcatctctagtcccccaaaatttttataatcatatatttcaaaaatttgagggcaattacttttctatgcactatcatgcttttaaatgataggctttgccattgtccccctatttacagtaggaggaagaagattcagagtatttattacagaggcaagcaaaggcaggcatgggtgattccggagaggaggcagcacaggcagaggcctggtcgagttgaagaggtgttcacacaagaataaacatcgaaagtctgcaacccgggaagcttggcccaaagtgatgacagctgaagccaggacatgtctggggaaaattataaagacccttgaatattataagtttgtattttatcctgtagatgactgatttttaaatgtttttagcaagagagctttatggaaacaaaacttgatttgcatgggagctctgtccactgcagccacacaccaactggtttttactacatcctgagtgctcttttaaaagagcagatctgatcatcttagtcctctgggcacactcttcaaagatatctcattaaacttggagtgaaatgccatctccctgcaggctctgggtaatgtggccctacccatcttcccagctcatctcatacaggtcgagtattccttatccaaaatgactgggaccagaaatgttttagatttgtgattttttttttcagattttggaatatttgcatatacacaatgaggtatcttgggatgggacccaagtctaaacacaaaattcatgcacgtttcaaacatatacatgaatagacccttatatatatagcctgagattaatgttatacattattcttaataattttgtgcctaaaacaagtttgtgttttacacaaacattgagccatcagaaagcaaaggtatcaccaccacagcctgccatgtggacagtttgtggttgtttggcatcaccatcattcctaaccctaaatttatgtgctgccaataaatgttttaactgtgacctgatacatgaggtcagacgtggaattttccactgtagtgtcatgtcagcacccaaaaagttttggattttggagcatttcagattttagattttcagattaggcttgtataatctgtactacctccctgacttaccactcgtaggtcctcccatgagcccatgtccctcccctcctgaagaactttataagggatgccctctccctgtctcctcccttccacttgcctaattagctcctagtttgctctttcaaacctcagctctgccaccttttttcaggggagcctttcccagcatggttaggatgccctattctatgctctcctgcactccgtggacttccttgtaaactttaatcaaggttgtgttaaatgatcagctgcaggtttggttatttgatactttctcctactatgctgtaaactttgagaatgggtagtgtggccccatctggcttgtttatgacagtgtcctggaacctccctcaggcccctaagcagacccccaactatttgttgaaaatacaccagtaaatataatgggaagacaaatgggggaagaggctgttgtggttgaaattaggatggagcctttggctgaagcaggaatgtggggcctgggatacttcccactaagcctgccccttcccctccacagaggtcctggaggcacagagtggaaaacactctgaaaagcactgttggagatgatgggatgatctgactaacaaaaggctttgttatttggctttggggtgaagactgttattctcttggcctgaggaaactttcttttgcttcatagtcaaaagaatgatcaaagtagctttgcgtagacaggaagcatatttcattcatttatttcaacatcttgtctctcttgggtaaggaatgactgtaaaagacatctgtaggatggtcagaattgtattattttgtgcaagactagatgtagagtagatatttctttggaaagtcatcctggcctaggcccagaccatcaggaagattgcctctgtactctgtggatccatgcacacatggccccattcctgggtctgggatcatgtgacacatgcagatcatgtgactctaatactccttcagtgtggtcagctataatacagtcaaggaatccctatatctgttaaacagggtgaatggaagtgaaaattaccgtttgactgagtagcattgctgaagaaaatcagtagaagtggtccaagatcctttcgcattgtctcagttctaaatgttgtaaactttcaaattactgaaactctgggtttcagtatccaaccccttcaaggccagctgaaaatcaacaacagagtgggttaaaataaaagaagcatgtctgtgcaatcccaaattaaagcgaaaatatgtgctggccaaaagtaagtcatttttcagcctcaaaatattttttccaaattctaagatcctgcatttgacatgtttaagagggagatataacagctgaagttgtctttgttcagaatgtaggagacagttttgtctagactttcaggaaagatatagaatgacattttcagaacaaatcaaaatatatttttaaattcctttttccccttcacaaagaggatctgacatgcttctgtgatttgaatttggctgatctataaatggcctcaatagtttaacatgaaaagtagagtaaaataaaccattgagaaaagttattaaaatactgttagttcactttcttaccttcacaataaccttaccaccaaaaacaatttagtaactaatattgagtggagtggtttctaggtatgtgttaatctcttgacatacattttctgacttagttctcaccacaaccccataaagcaggtattgctgttatgttaattttctcatgaagacagagagagttggggtgactcactcaaagccacaaagccaagcagggactatgtctgactgatctcccaaacctgccttcctgccctcctcaccactgtgcttgggtcttctttcttcacagggccagcatcgtacaaaaacgcattatttattttcaagatgagggctctctgaccaagaaactttgtgaacaaggtaagaccctgtgggtggggagggggaggggcagagacatggaaggcagctcctcctgcacgatcctcctgctgcaagaattaaggcccctgggcttcgtgagttcctctgggttctgcttcctcacgtagctccgatttttaatctggctgtgtgctgtgggtaattggatccgccttaagctctaattactcagcttgattccctgggtagaagataatgtaccttatattggtgtcgtcttcttatttttgtgaaacagtgattattctgaagaggttccttggaataattcacaggacttaattaaggaatgcacaattgtgtacctttaaaaagtctgtaatggttctttggaaaaaaatcaccagcaagatcttgtgtggcacccagacaatatgggaggattttctccagagaagcccagcaggggatggggatgccaagggggtgttgaccttgtgatatcaccacattcaaggatctagtccttagatttgcaaacttatcaaccttctctccttaggttgaaggtattgtaacaaagctcatggaggctaactagactcgggggataaagcagagacctgagtttagatcaggcccaggttcggatctgcctctgccccttctagccatgtgacttaaatagataaaatagtacagtacctccttgacacatagtaaatgctgtctatagaatagatagctcttgttatctatatctgaaagcttattcattaatctactgcaaaaaaaattgaccttaaacatcggaatgtttttaaaagttattggataactaaataaaaataaaaaatgctctatatttatacagcataacaatctcatttctatttaattttgcagaatttttatttgcatttagagcaattagtgtttggagaagaaataatcctctccaactatagcaaagtataagctactaagaaaaagaaaggttgataaaggtcttcggggaaaacaataataataggtaatatgtttggggtgctttgctacgtgccaataactattttaagcacttcatatgcattaattttataatctgcacagcagccctatatggtaaagattattattatatttttattttatggatgaggggcctgacacaaaaaatttaaatagctttcttagcatcatatactcatggtggaaggctgggtttgaagtcaggagccaatgcccttaaccattgctttctagcaaagcaactgcttcccagttcagtagttcttatcattgcctttgacagatcaatgcattgtcctcctgtagatgagctgagcagaaactaggtcccctgtttggaattgtttagagaacatggcaatagcaaaggagagagagagttggataccttgcattaggatcatacctcccagaggggctggagagctggaatctgcagtccagagaaccctggccagcttccacatggacaccaccacacgtgtcttctgaggcttttcttttttgtgttcaactgcctgcaagttcactcagcctttctctacacagggagcatctccacttattaagctcttggttcctcaatgacaatcccatccctgctgtatcttcatgtgatgagatccaggtgctgtggtggacttgtgggtgttttggatcacacatttccaagacacctcttgtaaatgccttagacaagtcttcacataacatcaggattgagactttgggaagtgcacattagttaatgattgatggcagtacatgagggtgtcagtgaagtatctcctaagaaccctcagctcctgaaaataaggctgtcctccgacagtcaaactgacaaaaccacaccacagtgcctggggagaagacctagagctgcacagatgaaaagcaaaggcaaacaatagttttaaaaagcaagataaacaataggttacttccaattaagaacagagaaacaaaatattcaaaaaagtgacctataacaaacatatgcatacacatactttatttttttttttttagtttttttgagacagagtttcactctgtcacccaggctggaatgcagtggcacgatctcggctcactgcaacctccaacccccgggttcaggcgattctcctgcctcagcctcccgagtagttgggattacaggaacacaccaccatgcccatttttgtatttttagtagagatggggtttcatctctactaaatatgaaaagatctctgtctcacaagtaagatctaaatagagatttgccatgttggccaggctggtctcgaactcctgacctcaagtgatccgctcatctctgcctcctaaagtgctggaattacaggcatgagctaccgtgcccggccctgcatacacatactttaataccatgtcacaagcaattaaatgaaagagacaaaaaaaaaaggaaaaaggaagggaaacgcagaaaaaagagaaaaatgtcaacagaaacaggataatgagaaaaggaagaaaaagggaagaggaacaaagaatacaggaagagagttgcaaaggaagtcagtggatttcaagtagaaatggggagagagggcggctctggagatgctccatagcctgaaattacccatggttggcagaccctgcctgctgtggttagaagaggagtaagtggacgattcttatcactgccctttgaaagcctgattcattttcaataggcttttccttagtaggaaaacagtatgtctgtttttattttcaaactgaaaaatttatttttcaaatgggagcttaaaaatgtatttttcaaatggaagcttattttcctttgaaaatccaaaaggtttattatgcattcctttgaaccctcagaaatatcgttaagtttaccacctatatccgaaagcccttttgataaggcaaagctaccagttggccttcttttggtttttgtagagactattgctgcctcatttaatagcccctagtagctacaattgaaacctcagcatgtatctctgatttagaaatcgtagagctatgtagggaggcaattttttttttagcgcatctttcttcattgaaaaaagcaatacagaaacaataaaaaagttttctctctttcctatctatgcagacctatccagatgaggtctttcctggagtaatgtagtgcagagattaagggtatgagtcctggacccaaaaagacctggcctccagttctgcctgccctgttcactaaccctgtgaccttgaacaggttacctaatctgcttcaatttactgacctgtaaaatggggatagcaaaagtacttacctcctagcattgttaggattaaacgagacaatatatggaaagaaatcagcaaataaaaggactcagtattttgtagttattattatgatgtctcatcctttcatctccaccctagaacctagaattcacttctatccatcatggattttatatatttaaaccaaatcaacccagtaaattccaaaaggaagtcttgtaaaatgctcttcctaacactcacaatgattttaacattctttgccactactctttgtataatatttaagaataaatgtccaactgcaaagaaaaaaaaattatgttaatactactagaggaagtgaaaaaaagcaactgaagcaagttacatctgtagtcattgttttcatcttgcaggaagcagaacagactaaaagcaacaacgtgcagctagagatgtgggtttgacaatcggaaatactgaatttattcatgtaatctctctttccccacttatcagctattcacagctaaaaatgagggccgagagggaatcttaagtttttcctggctacttctatacccagaagtacagtaaacctgagcttatgaacacatttccaccccctactcctcccagtgaagtctctgaaagcatgataagaagtgacgtgattatatatgcatgcctcttttttttctcccttcagtaattctttatctctctccatttattttcactgctctgcttcaaagtcattccttctggtcctgtcattttggtcccagagaatatttcctagagaaagcacacatgtgtattcctcctaaaatttgttagagaaatcctgttgtgggaggggtggggaaggagaccaggatccggaaaggatgattgagtgaattttacccctgatttttcaacatagcccccatcttaaatattctcgaatagcctatgggttattgctcccacagatcttctcaatttattagggaaaaagctctctttttttttttcaaaatattaccatacttagaggcatacaaaatcctttattgcccaagtactgatctggctctaagtcttattaactaatgaaagctgcatcttcttttcctaagggttaaggataaaatgagaccatgatagcaccaccttatatacaacccacgtttactttctaacttggtgacttttctgactgtttcagattccacatttgatggggtgactgacaaacccatcttagactgctgtgctgcggaactgccaagtacagactcacattttatgggaattggtccgagaagacacacccaaaggattaccctcgtgagtagagtggctactctgtggtttggggaaaagcacattgtcaaagttctgtctggttatagggcacactagctgcagcatgtcagatctgctccctagtattggctggttcatgaaatgcacaatccaagtatgtatattaatcaagacaggcagacattatatgggtatgctttcagcttctttgcatagcattgtgctattttttttctttttttttttgagatggagtctcgctctgttgccgaggctggagtgcagtggcacaatctcggctcactgcaacctccgcctcccgggttcaagcagttctcctgcctcagcctcctgagtagctgggattacaggtatgggccaccatgcccagctaatttttgtatttttagtagagatggggttttgccatgttgcctgggctggtcttgaacacctgacctcaggtgctccacccaccttggcctcccgaagtgctgggattacaggtgtgagccactgtgcccagccccagcattgtgctttcttatctgtgatttttaaaaatattcccaaagtcatgctgcttatattcaggtgaggcatttggtaacctcaatccccctgcaatgaccctgtccatgaattccatgacagacctgctggaaatagcggcaaaagggacctgctcttgactctataggtcaaggtcaacaaatactctgctatcataggtgttagtaattagtcagcatgccttttttttactgacttcagatgccaccttgaaatcccttcatgaggggccaagcatggtggctcaagcctgtactcccagtgctttgggaggctgatgtgggaggatcctttgaggccaggagttagagacctgcctaggcaacatagcaaaattctaaaattagctgggcatggtggcacatgcctgtagtcctgtagtcttgcctgtagtcctagctactcaagaggctaaggcaggaggatcttaagcccaggagttcaaggctgcagtgagccatgaccacaccactacactccagcctgggcagcagagcaagactctgactcaaaaaaaaaaaaaatcttttcataacattgttatcaagatagccaatacaaagccatgagagttgtcaggagaccccaaacttactattttttaagtagatcctactaattccactttatcatataattgtctcaacaaacgcctaacatgtgccaggcactgtgctcagctctagagttataatactgaacaaaaaaaagatgcatcccatattctcaagccactcagcggctagtggagagacagacactaaccaaatagtcatgcagaaagaggtgaagactataagaaaagtggacttactgtgaaccaagcatttctacatatgttatagtgtttaatcctcaaagtaatgtgtttttgtggataagtttactggggaggagagagatgtcatgatttgcccacattgagatgtaagtaatggatccaagatccaaaggggtttttcagtctcctatgcctgccttttgtttgggttgcgtgttgcccattctctctgtgggtggcaggatgtccatgtgtggcactgagcctgtttttttctgttcattgtctgttttgttcttgtgcattttactttggagttaccgcagttcaggaagaacagtaggaatgggagagagagattaaaaagagggatttggctcaggtcccaaaggaaagggggagaaaagggcacatgattggacttaagaagactcagaccagatcagaacctccatgatccccacgcagcccacccagaggggacttcgacatttgttgacaaatcaagagctctattgtttaatgttacccacatgcaatcaaggcttgggatcttagaagcctctttctagttcattcttctgactctgagattcagcctgatctgcatcagctgtgtgggagacctgtgcgaagaaacttggactctctgcctgggggaaagaaaacatttggaacaagcacgatggaaaaatttcctccagcctctcctatccactaaccagaggaaataaaatgttaggggcccgttactcatcttttgtgatcctaagaagcttcttgacctttcctattctgccactgtcatttcccagaatttagggaggaggtgaaaaaaaaaaattgtttctgggtctttgggccaaatcaagtacaaatctatacagagtttctgtggagttgttgagagtttcttagtaaatatagcagacgtgtgttccagatcttctaggattgttccatttttgacatgatgtcttatagacaattgtcagattgtgtcctaatttttggttggaaaaatttggtcacttgtacagaatagcacttaacatagcatactgtagttatttttttaaaagtctttctttcccactagaccaagaagtcctccaggacaaacgtgatgacgtgcttatctttgattcttagtgcctgttgtcttcccaagcactgtgtactgattgttgaactccgagtcacactcattatgacctgggaggcagatgtctagccttcagctaattatgatgggcagtatggaggagagtgtgagtcaaaccttccatggaggaaaaggagtgaacactcagggagactggagccgtttaaaaggacatggggaggatctaatcgggatcttgaaaatttaatgttctcaaaagttatttctatcagtcttaagtaatagatgaatttctttttgccactgcaaagatgatactgtcttgataaccattctctatcatcatgcccagagaagcttcccacaatagtgcaaactgacaattgccaagcccccctgtcctttattagtcatccaaaacactgctttctctacagtgatcttaggacagtggttcttaagcttttaaatcttaggaccgcttttgtatgcttaaaaaatctttgaggatcccaacataagtggtttatatgggttatagccatcaatcttccatgtatcaaaaactaaaacagagaaattgaaaaatattatttatttttaaaataaacctagtaaattaaaaataataaacttgttccaggttaatataaagaacatattttatgaaaatacctatattcaaaacaaaagaaatgtgaaaagaggatcaatgttttacgtttttgcaactgtcttttctatctggcttaatagaatacacctggattcccatttgcctttgcttttgcattcaacttagattcaaaatagattcaaataggttcaaaaaatctattttttggttgaagtatgcggagaaaattctgtctcatatggctatgtaattggaaaagggaagagtattttaataaccttttctgataattatggataatctttgatcctacaccagaactctgcaaattgtttttttaaaggttaattacaatgtggaatttgaaactatatcaatgaacttgtactcttacattaaaagtcattgctttaccttctactttgaatggatcttttacaaatgcatggttttgtaacatcttacgttgatcatttggaaaatattggtttactgagttatgcagattgtgcaagtgttgacacagttcattaaacaatatgaaaagccatatccattaatatcactaccaatctcatcagaaaagtatttaatattggaaagctatcaagttcataataatgaacacaagttttctaaaattctgggttttgcttgaaagcttgaattttatcattggcaacaaatactgtcagttgttttccttgaagtgacaggatcactttattttttagaaaatgtaggccaaattcccaagtctgaataaccataatttgtctgtcatttgtcctttcaagtgaaaatgatgttttatgaacataaaaagcggctagtccagcttgcacctcaaagagtcgcataagtgcttttattcaagacaatcacagtacttcagtatatagcagaagtgcttctgcgtagttcccaattagtcacacagaaaaaataaaaatatgtttactcaaaggcagagatctaatgaaattaatcatttttattgttttttcaaggacattctttttttttttaactttaagttctgggatatgtgtgcagaatgtgcaggtttgttacgtaggtatacatgtgccatggtggttttgccgcacctatcaacccattatctaggttttacgtcccacatgcattaggttatttgtcctaatgctctccctccccttgccctgcactccccgacaggaccaggtgtgtgatgttcccctccctgtgtccatgtgttctcattgttcaactcccacttacgagtgagaacatgctgtgtttggttttctgttcctgtgttagtttgttgaggatgatggtttccagcttcatccatgtccctgcaaaggacatgaactcattcttttttatggctgcatagtattccatggtgtatatgtgatgcattttctttatccagtctatcactgatgggcatttgggttggttccaagtctttgctgttgtaaacagtgctgcaataagcataaatatgcatgtgtctttatagtagcatgatttataatcctttgggtatatacccagtaataggatcactaggtcgaatggcatttctggttctagatccttgaggaattgccacactgtgttccacaatggttgaactaatttacactcccaccaacagtgtgaaagcattcctatttctccacatcctctccagcacctgttgtttcttgactttttaatgatcactattctaactggcatgagatggtatctcattgtggttttgatttgcatttccctaatgaccagtgatgatgagctttttttcatatgtttgttggccacataaatgtcttcttttgagaaatgtctgttcatatccttcacccactttttgatggggttgtttttttcttgtaaatttgtttgagttctttgtaattctggaaattagccctttgtcagatggatagattgcaaaaattttctcccactctgtaggttgcctgttcgctgtgatgctagtttcttttgctgtgatgaagctctttagtttagtaagatcccatttgtcaattttggcttttgttgcaattgcttttggtgttgtagtcatgaagtctttgcccatgcttatgtcctgaatgatattgcctagattttcttctagggtttttatgcttttaggttttacatttaagtctttaataatccatcttgagttaacttttgtataagatataaggaagggtccagtttctgttttatgcatatggctaggcagttttcccagcaccattgattaaatagagaatcctttccccactgctttttttttgtcagatttgtcaaagattagagggttgtagatgtgtggtgttatttctgaggcctctgttctgttccattgatctatatatctgttttggtaccagtaccatgctgctttggttactgtaggcttgtagtataatttgaagtcaggtagcatgatgcctccagctttgttctttttgcttaggattgtcttggctatacaggctcttttttagttccatacgaaatttaaagtagttttttctagttctgtgaagaaactcaatggtagcttgatgggaataacattgaatctataaattactttgggcagtatggccattttcacaatattaattcttcctatccatgagcatggaatttttttccatttgtttgtgttctctcttatttccttgagcagtggtttgtagttctccttgaagaggtcattcatgtcccttgtaagttgtattcctaggtattttattctctttgtagcaattgtgaacgggagttcactcatgatttggctctctgcttgcctattattggtgtataggaatgtttgtgatttttgcacattgattttgtatcctgagactttgctgaagttgcttatcagcttgagattttaagctgagatgatggggttttctaaatatacaatcatgtcatctgcaaacagagacaatttgacctcctttcttcctatttgagtatgctttatttctttctcttgcctgattgccctggtcagaacttccaatagtatgttaaatgggagtggtgagagggggcatccttgtcttgtgctggttttcaagggaaatgcttccagcttttgcccattcaatatgatattggttatgggtctgtcataaatagctcttattattttgagatatgttctatcaatacataatttactgagagtttttagcatgaagcagtgttgaattttactgaaggctttttctgcatctattgagataatcatgtggtttttgtcattggttctgtttatgggatggattacatttattgatttgcatatgttgaaccagccttgcatcccaggtatgaagccgacttgatcatggtggataagctttttgatgtgctgctggatttggtttgccggtattttattgaggattttcacatcaatgttcatcagggatattgacctaaaattttctttttttgttgtgtctctgtcaggttttggaattgggatgatgctggcctcagaaaatgagttggggaggagttcgtctttttctgttgtttggaatagtttcagaaggaatggtaccaactcctctttgtacctctggcagaattcagctgtgaatccgtctggtcctgggctttttttggttggtaggctattaattaatgcctcaatttcagaacttgttattggtctattcagggattcaacttcttcctgatttagtcttgggagggtgtatgtgtccaggaatttatccatttcttctagattttctagtttatttgtgtagaggtgtttatagtattctctgatgggagtctgtagttttgtgggatcagtagtgatatcctttatcattttttattgtgtctatttgattcttctctcttttcttctttattagtctggctagcagtctatctattttgttaattttttcaaagaaccagctcctggattcactgattttttttaagggtttccatgtctctatctccttcagttctgctctgatgttagttatttcttgtcttctgctagcttttgaatttgtttactcttgcttctctagttcttttaattgtgatgttagggtatcgattttagatctttcctgctttctgatgtgggattttgtgcttataaatttccctcttaacactgctttagctgtgtcccagagattctggtacattgtctctttattcccattggtttcaaagaactcatttatttctgccttaattttgttatttaccccatagtcatccaggagcaggttgttcaatttccatgtagttgtgtggttttgagtgagtttcttaatcctgagttctagtttgattgcactgtggtctgcgagactgtttgttatgatttctgttcttttgcattttctgaggagtgttttacttccaattatgtggtcaattttagaataagtgctaagtggtgcagagaaggatgtatattctgttgatttggggtagatagttctgtagttctattaggtccacttggtccagagctgaattaaagtcccgaatatccttgttaattttctgtcccattgatctaaaattgacagtggggtgttaaaatttcccactattattctgtaggagtctaagtctctttgtaggtctctaagaactttctttataaatctgggtgctcctgtattgggggcacatatatttaggatagttagctcttcttgttgcattgatccctttaccattctgtagtgcccttctttgtcttttttgatctttgttggtttaaagtctgttttatcagagactaggactgctttttttggctttccatttgcttggtaaatattcctccatcccttttttttgagcctatgtgtgcctttgcatgtgagatgggtctcctgaatacagcacactgatgagtcttgactctttacccaattttccagtgtatgtcttttaattggagcatttagcccatttacatttaaggttaatattgttatgtgtgagtttgatcctgtcattatgatgctagctggttattttgcacatttgttgatgcagtttcttcatagtgtcattgatctttatattttgtgtgtttttgtggtggctggtgccagtttttcctttccatgtttagtgcttccttcaggagctcttgtaaggcatgcctgttggtgacaaaatccctcagcatttgcttgtctataaaggattttatttctccttcacttatgaagcttaatttggctagatatgaaattctgggttgaaaattcgtttctttaagaatgttgaatattggccccccactctcttctggcttgtagggtttctgcagagagatctgctgttagtcttatgggcttccctttgtgggtaacctgacctttctctctggctgcccttaacattttttccttcatttcaaccttggtgaatctgacaattatgtgttttggggttgttcttctcggggagtatcattgtggtgttctctgtatttcctgaatttgaatgttggcctgtcttgctagattggggaagttctcttggataatatcctgaagtgtgttttctaacttggttccattcttgtcctcactttcaggtaccccaatcaattgtaggtttggtcttttcatatactcccatatttcttagaggctgtgttcgttccttttcattcttttttctctaatctagtcctcgtgccttattttggtaagttgatcttcaatatctgatatcccttcttctgcttggtttagctattgatacttgtgaatgcctcaggaagttctcatgctgtgtttttcagctccatcaggtcatttatgttcttctctaaactggttattctagttagcagttcctgtcaccttttatcaaggttctgatcttccttgcactgggttagaacacgttcctttacctcagaggagtttgttattactcaccttctgaagcctacttctgtcaatttgtcaaactcattctccatccagttttgtgcacttgctggagaggagttgtgatcctttgtaggagaagaggcattctggtttttggaattttcagcatttttgcattggatttatcctcatcttcatggatttatctacctttgatcttgaggctgatgacctttggatggggttttttgtgtgggggtcctttttgttgatgttgatgttattgcttcctgtttgttagttttccttctaacagtcaggctcctcttctgcaggtatgctgcagtttgctggaggtctactccagaccctgttctcgtgggtatcaccagcagaggctccagaatcgcaaaaattgctgtttgctccttcttctggaagcttcatcccagaggggcaccagccttatgccagctggagctctcctgtatgaggtgtctgtcaacccctgctgggaggtctctccccgtcaggaagcacggaggtcagggactcacttgaggaggcagcctgtcccttagcagagctcgagctctgtgctggtagaatcctccttgtcaggatctgctgcactcttcagagctggcaggcaggaatgtttaaatccgctgaagctgggcccacagccaccccttccctgaggtgatctgtctcagggagaggggagttttatctctaagcccctgactgggcctgccgcctttctttcagagacgccctgccctgtgaggaggaatctagaaaggcagtctggccacagctgttttgccacgctgtgttgagttccgcccagtctgaacttcccagcctccttagcactgtcggggaaaactgcttactcaagcctcagaaatggtggatgccccttcccacaccaagctcgatcatcccaggtcaacttcagactgctgtgctggcagtaagaatttcaagccagtggttcttagactgctgggctccacgggaatgggaccggctgagcaagaccacttggttccctggtttcagccccctttccaggggagtgaatgaacagttctgtcttgctggagttccaggcaccactagggtatgaaaaaaaaaaaaaaaaaaaaaactgcagccagcttggcgtctgcccaaacagccgcccagttttgtgattgaaagccagggccctggacgtgtaggcacacaagggaatctcttggtctgcggattgcaaaaactatgggaaaagcgtagtatctgggctggatagcacagtcctgtgtctggaattggtgggttcttggtctcactgacttcaagaatgaagccgcggaccctcgtagtgagtgttacagctcttaaggtggtgtgtctggagtctgtctcttctgatgttcagatgtgtttggagtttcttccttctggtgggttcgtggtctcattggctcaggagtgaagctgcagacctttgtggtgagtgttacagctcttaaggcggcgggtctggagttgttcgttcctcctggtgggctcgtggtctggctgggctcaggagtgaagctgcagatcttcacggtgagtgttacagctcataaaagcagcgtggacccaaagagtgagcagcagcaagatttattgcaaagagcaaaagaacaaagcttccacagtgtggaaggggacccggttgccactgctggctcccgcagcctgcttttattctcttatctggccccccccccccccccccccgcccacatcctgctgattggtagagcccagtagcctgttttgtcagggcgctgattggtgcatttacaacccctgagctagatacaaaggttctccacgtccccatcagattagttagatacagagttttgacacacaggttctccaaggccccaccagagcagctagacacagcgtgtcgattggtgcactcacaaaccttgagctaaacacagggtgctgattggtgtatttacaatccctgagctagacataaaggttctccaaagccccaccagagcagctagatacagagtgtcgattggtgcactcacaaaccttgagcgagacacagggtgctgattggtgtgtttacaatccctgagttagatataaagactctccacgtccccaccagactcaggagcccagctgacttcacctagtggatcccgcaccggggctgcaggtggagctgcctgccagtcccgtgccgagcgctggcattcctcagcccttgggtggtcgatgggactgggcgccgtggagcagggggtggtgctcgttggggaggctcgggccgcacaggagcccatggagtgggtgggaggctcaggcatggcgggctgcaggtcccgagccctgccccgcgggaaggcagctcaggctcggtgagaaattgagcgcagcaccggtgggccggcactgctgggggacccagtacaccctccgcagccactggcccgggtgctaagtccctcattgcccggggccagcagggctggccgcctgctccgagtgcggagcccgccaagcccacgcccacccagaactccagctggctcgcaagtgccgcccgcagccccggttctcgctcgcacctttccctccacacctccctgcaagctgagggagtgggctctagccttggccagcccagaaaggggctcccacagtgcagtggggggctgaagggctcctcaaatgccgccaaagtaggagcccaggcaggggaggtgccgagagcaagcgagggctctgaggactgccagcacgctgtcacctctcaatccctcacggcttccttttgctgggggtggcggggcgggggaggcccccagctgcttgcacttcctgggcaaggcgacaccccaccttgtttctgctcatcctctgtgggctgtacccactgcctaaccagtcccagtgagatgaacagggttcctcagttggaaatgcagaaatcacccgccttctgcattggtcttgctgtgagctgcagaccagagctgttcctattcggccatcttgccaataccctccaaggacattcttaagtgaaacggaccccttttgctttttactgttggtatgtggcagtgaaaaatatatcagcgactaacatggtttggggtcattaacttgatccatgctcagtgccagagttaatgtcaatacattacaaagggaagtaatgtcttagcattattataaaaatagttttcaccttctagaccccctgaaagggtcttggggttccaaggggtctgtggtccagactttgagaacctctgcaataggtaagatagcaacctaaggtgtctgactttcagtactctttgactaacttgcccttgggaatttacgttggacactataggaaggatggggcaatacccagtctctgcaggtgggccacatctgccgaggctcttctcaaccattttacaaaatggtttgttccaagtgctgtttctggggttccttccattggagcacagtgttctctctaggaggggctagatgtggttagataagaagggaggcaggggaatcgcctaaatgacctctggcattccctatctattgtaatgctatagatctctgcttgtcatctggaaatagtgaaatccttttaaaacacttctaatctagtagttctagaaacgcattttaacttatcatgtaagttttacttcctaattttacaagtgaaaaactgaagcacaaagaagttacagactcagatgacatagccacagagtgtccgaaacaaaatcaaagcttaggtctcctgactcctttttgccttcctctgtaggctattaggaggccatcaatcttctgtccttctgcagaaaaattagtatcttatacacaaagcatcttttaataaggccctgctgtactaacatgaactcaactggtaccaaatttggtgccatactgaacagctttgccccactctacaaaaacctgcattgcagagatcctaacttagaagtcagaaagagaaggtctggattcactggtcctgagtggagttcatggaccttaaagtgtcagaagaactgccagctcctgcaatgtctgttcgaggcactgtgagtctgtagcttccagctatggctcagaagcagttgcttcacagaaacaaggtgactaggcagtgtaaccacatgagggtgtcctggaggctggagacatgcccattctttgccaaggaattgggagttacctaaaagatgctgagtctctttattctctagctctgaatacagctcttgggtttttgacaaatgctcctatcccatagagaccctttaatcacctttgacaatgtaagctgcatagcttcccccatttttgatatgacatcggttttaatgctgtttaacagatatgcattgatgaaaagaacatttttttccaggagccaatcacgttttccgtttgacaatacattgcctaaaatataaatacagcaattgggaaatatactctatataatcaaagttcattttacaatgaaattcagccatcttttctattggatcaccagatttaggaaattattattaagtccaatcacatgaaaaaccaccgctctaacacttaacaactacttttgtttcttcatatattcatctatgtacagagtatgtatatcacatttgaacatactgttctactttttgcatttgattttgtcttcatactcatatcagcttattctaagcaacttatctattgttttattgatcatttaagtaatgtcaggtcttttgctaacatagaaagcactgcaataaaatactttgtacttaggccaggcatggtggtcacgcctatgatcccagcactttgggaggccaaggcagatggatcacttgaggtcaggagtttgagaccagcctagccaacatggtgaaaccctgtctctactaaaaatacaaaaactcaccaggcatgctggtgtgtgcctgtaattccaactactcaggaggctgaggcacgagaatcgcttgaacctgggaggcagaggttgcagtgagccgagattgtaccactgcactccagcctgagtgacagagtgagactctgtctcaaaaaaaaaaaaaaagccacacaacgcttggtacttaaagtcttcctcaacccgtctcctttctttggaattatttccttgaaataatttcccaagatgaaaactgctggatcaaaggatatggatttttcttttggcccttgatacatcttgccagattcttctccaacacatttgtatcaattcagtttattaccaataatgaataaatgtgtctgtttctcccagccttctcagcattcaattaaaattttaattaaaattttatttagtaataatttattaaaattaatcttattttaaattggcattggtttaattaccaacacacttgaatcttttttcatgtttattgtcctttgcctttaaaaccactagggtgttggcatgaatcaagtctgattttgctccttgtctccccagggcatcagtcattgtctggcacactgaaagttctgaataaatagtgtggaatgaatggatgaatgaatgagaagcagttacaaaatgaggaaggaagagagtggagggagatgagcaatgaaaagctgctgatgaagaggttagggcaggagagagataaggccatatgtggctgctgagtggacagcagcttggatggggccagtggtgtgtgggaggatgcgcaaggaggacattgcagtcagttagtgggcaatggtgtggcttggactgcagcggtgaaagtggtaatggagaaaattggtatatttcacatctcttttaacagtagattctgtcatgaactggatgcggaggagtaagagagagaaacatcatagctgacaagctaggtttctggcttggaaatggaggtgctctttcttttgaaaatattcctcaatattattatctctctctttttacaaatgactttgaaatcatttcatcaggctctgaaaaggatcctgtcagaattttaagtgggattgcactaagtctcaaaattaccttgagaggaattgttagctttataatgtttagcttgtctagttttttcccatttatgaataaaaccaagcatttctgggtttccttagcaccatgcctagaagagtgataccatatggaccatagcccttctttctcaatctaactgcagaaacaaaattaaacattatattacagttctccagagaaacagaccaacaggagatagataaatgagagactagatagatagatagatagatagatagatagatagatagatagataatacatttttttttgaggaattggctcacatgattatggaggctgagaagttccacaatctgccatctgcaaaccggagacccaggagacccagtggtgtagttctagttgaattccaaaagcctgagaacaaagggagccaatggtgtaaatcccagccccagggcaggagaaggccaatgtccctggtcaagcaggcaggcagggtgtaaagaaatggatttcttcttcctctgcatattgttctattcggccctcaattgattggatgaggcccacccacacgggggatggaagtctcctttgttaagttacctgattcaaatgtgtatcacatctggaaatcctcacagatgcacccagaaataatttgggcacccaatggcgcagctgacacataaaatgaaccatcacaaacatacaatgaacaataatcccactgcttccttcttccatcactgtggaatccctcccaatcctgagaagtctgcccatcagagcatctcagctgtgccactgccagtgctatgatgggacaggagacattgctgctgccaccaggctgagtcacaaatataggatttcaccaggaaatggaatttggcacccaacacttgtgtcgtcatacacagtttcagtgaaagaaagggcaaaagagaaaggattaaatatcttctttaccctttttctcttgccttccttctgcctctctggaaaggaagtcctatgacaaccagtcactcatgtatgggttgggagtggagaaggaaagtccatgatcacattttccagttaaacagggaaggctgaacacataaatctctgttgtttccccaaatcccacaaagataacactagatgaataaagcagactcagtcccagaggatttctctcacttttttccagcacttttaggtactttgcacaggtgtgttttttagggatttcattctcacccccagatccactcttctctccatcctgctttgggagggtgacgtcgagggatctcatcaagtggctctctcgccctctgcattccagctggatttggtcagtgggaagccaaggacagaggaaagtgaggtcagggtctctacctacccacccactgctccctgccagtggaggctgcaggtgggtggtcctcttccagcagccacagcttctgcccagccaccctgtcttccagcttcaactctccctcctggttcctgaaactgctcctcctcaggtttaggggtagtcacaactccctgggagcttcacctttccttattgcactcctttgactctgccaggcccttataaaatgtcccttcatcaaactcacttctcttgccccacttgagtatgccatctgtttcctgtgggactgagactggtattgccactttttcagaaattgattcttagactctgtacatgtattattttgataaaataagaagcaaagctaacaaaacagtaaagtcagttattactatagaattttatgttgctataggattttataaaagattatacatccccactgtactgaggctgccctttctgaattgccttcctctcccccatcccactcaaatgctgcttccttccattgctcacctaggacctaaaaacacccaaatgagaatgtcttttctctgggtctgtggctaaactcagacgccaatccagttcccattcccaaatcttctctctttgccaacactaggctgtcatctaacccaaaacatactcaaaggaacaacgttataaagtagattattagataggggtttctggaattttagctaagaggacaccctttaataatagggagtgcattttcacagatcatgtttcctggtttaaaaatatatgcaatttccgtaaaaactgagacttgaagagattttaattttttctaaatgatttttgttttctcaagaaggctttgctgtttcattcttatatatgcttcatcaagttaattcctagaattattttatgttttggttattatgaatgagatttccagttttcattacgttttctatcaggttataattagtgtacaaaaatgctctcgttattcccatttattgtacctctatgttttttcctaatagttttacctaatattccttgggttacataagtaatcaatagctatttgcctagctgggcatggtggtgcgtgcctgtagtcccagctacttgggaggctgaggcaggaggatgacttgaacccatccttgaacccatggttaaggccattgagccatgattgtaccactgccactgcactccagcccaggcaacagagtgagacctcatttctaaaaagataaataaacaaaataaaaaattaataatttgcctgtaaaacacaacatgtttttgtcttttttttttctgattactcttccatgatttctgtggtctcccacttgttcactgacaaggtatgatgttgactcttggcttccaggatgttaaaggatgtttaaggatgttaaatatagatgtacacttctaatttttttaatgggtgttgcatttttctttctttttgagacggagtctcgctctgtcgcccaggctggagtgcagtggcacgatctcagctcactgcaagctccgcctcccgggttcacaccattctcctgcctcagcctccccactagctgggactacaggcgcctgccaccacgcccagctaattttttgtattttttagtagagacggggtttcaccgtgttagccaggatggtctcgatctcctaaccttgtgatccgcctgcctcggcctcccaaagtgctgggattacaggcgtgagccggatgttggattttctaatgccatttcagcgcttattgatatgaacaaataattgttactattcaatctcttttgtggagtattataattactagttttcaatttgctagactattcatccattctgtgatgagcctaatttaattgtggtttgttttttccttcctttagtacacatgtgtaattataaactattcacaaagcattatatttttggtatacattttctcaataattcttgccttagcctcataggatgaatattatgctcctgatttatggaagagaaaattgagtctcagagaggctagagagtaggcccagttcatagagcaaatctgtggtcgagctggtgcgtgatatgaaaggcagagagagagagaggggtgggaagagagagagagagagaataggaggggaagagagacagagggagaagaggagagagagggaaagagaggcagccagagaatgatgcactggctgtgccacaggtttgcactatgaaatgcatctggctttgaatctgggtccatctgaccctagagtcctttctaccatgcctctcctttaaagtggtaatccattagtattgtcattaaattcttcagatctacatgcaagagtgaaagtggtacacaattcctgatttttaaatcaactctttatctgactgtagtctcaaggccatactagctttgaggagtaaattggttagttcctacctacctgtttttattcataattgagactttaaaagaattatccacacacattgaatactttcccttatcctcacccccaagttatccaatttcttcatcagttattggtgtattcaagctctttcttttatgtcagttttagaattttactttttcctttaaaaattatccattttatttagattttcatagttcctagcatacaactatagagtgcagtaagatcattcactatttcctggctaaatttacccgtgttagctttatctaataagctgtgtagcttattaaataatgctactgttatgctgttggtaatttacacacatccacttttatatatactgttcccttctatttcttttgggttgtccttttgttcctttggtgaatttttatattgttgacttagtatgctgattttcccattttgttttttgtttttattaataataaatgcacttaaggctgtgaattttcttagtgtagctctgagcccttcccagggaatttaatatgtagttctcattttcattgttttcttaatagagtgcttttgtgcactttatcttcttgacatatttgttaattagcagattatttcaaaatttctaagtagtcagagagttttgatttacatctttgttcctaattttgttttattttgttttggtaagtgtgttagtccatttttgcatcactataaagaaatacctgagactgggataatttataaagaaaagaggtttaattggctgcaggctgtacaagcacaactccagcatctgtttctggtgagggcctcaggaggctacaatcagggctgaaggccaagcggaagcaactgatgtcatacggtgagagaaggagtgagggacagagggaagaggtgccacactcttccaaacaaccagatctcctgtgaactaccagagcgagaactcactcatcaccaagcggagggagctaagccactcatgagggatctccccacctgatccgatcacctcccaccaggccccatctccaatactgggggttacatttcaatatgagatttggaggggacaaacatccaaaccatatcagtaaaagagtgtgttatatataatttctgcttttttgtacttactgagtttttttttttttttaataacctagcttatgttgactttcaaaagcctgttttcttattctgcctcaggtgccaagctatgtgttacctagtgacacacaagtataattagtccatgaaaggcccctctgggccttgttgtttgttcgtttgattccatctaccccatatttattgtgattactgtcctactataatttttctgccatgttattatacatttctgattgtactttctcatttctttttttttagacaccttcttttctttccattgcctaaattattttcttctgctggattaaaagtgatttgatccatttttttgttgttgttcttatggtggttgcctttaatgtaagacacgtacttatgtttatctctgttgaattcataaacaaaacaagtactttagcatactttataattcctttggtctctactatccctgtacccaaatacacactttatgttggttattttctagaattttatttctggattgtatggataatttcttttttgtttttctctagtctttgcttttttacacaaccataaacattactaaagtgttgttcacccatagctctttagcatttttcttatttcactattttctacaagagtatttttataatacatttttgcaaggcaaaccccctaaggccttatatgcctgagaattttttattatgctctcacatttaaatgactgatggctgacataagacctgcattcagaaacactttgttttccattgtccagtgtgtccttctatccagctgcttagaagcctaatctcagtctgaatttggttgcttcctaggtgatcaaatctctctctctgttttgcttttccatttttttgttgttgttttgtttggtttgttttttgctgtctctttgatgttctttattttcacagttaatgtgacttgatgtcgtttttttctttttaaaacctggttttcggctgggcgcagtggctaatgcctgtaatcccagtgctttgggaggctgaggtgggcggatcacccaaggtcaggagtttgagaccagccagaccaacatggtgaaaccccatctctactaaaaatacaaaacttagccgggagtggtggtgcatgcctgtaatcccagctactcaggaggctgaggcaggagaattgcttgaacccacgaggcagaggttgcagtgagcagagatcatgccattgcactccagcctgggtgacagagtaagactccatctcaaaaaataataataatttaaaaataataataaaataataaaacctagttttctattctatgggtcctttaaatatgagggctttcctcctttaattctggagatttattttttgtcaaatatttcccctcctccttttttctctttctgagcctctggtgactcagatattgtcacttctactcatttccttcatatcatctgggttttattttatgtgttttttcccttcctacctcactgctgcctttaaaaaggcttagatcatctaaaaatactaaaaaacaaactcaaaaacactaaaaaggtctattaattaaagagaagaaaaagcaagtgagaagttcctcagttttatccctaggccactcattctttagtgccaaccatcctgcttttaccccaactactatgttgcttatttcaactgttgtgggggttttattataaacctttatgttgaaatagcttcaaatttatataaaagttgcaagaatagcacacagaacttctgatcacctgtcaccagattccacagttgttaacattttaccacatttcctttatcattctctcaccatatagatacatattattttttgtgaacttctgagaagtagcagacatcatgcctgtccttttacctctaaatacttcagtgtgtatttcctgaatgtttttgtaatattttgtaagagaacaaggatgctcttacaaaattacaatacacttatcattaacattgataaaatactataatctaatctatatgtcttgttcaaattatactcattatacctctcatgttctccaaagcaatactgtatcatatcactataatgtaaaccacaaatatgagccacgtatgtaatttcaagtgttctaatagccatattaaaaaaattaaacagaagcaagtgcaattaattttaatgttctattctattttatttaagccagtatatccaaagtagtagcattttaacatgcaattcatataaaaatttattattgagacattttgcattctctttttcataatatgatccattgtatttttttacacttaacagcacgtctcaattcagactagccacatttcaatcacacagtagctacatgtagctggtggcaaccatatcacacagcacagttttgtagcaaatcaaaaataaaaattctggttcaagatccagtctaagattatatactgcatttacttgtcaggtctctttagtcttgttcaatctggaatggttcttagtccttcttgactttcatgacactgatgcctttgaagagtacaaggcagttactatgtagactctccttctgtctggggctgtctgatgctttctcataattagattcaggttgtgcatctttggcagggataccacagccattatggatatttgtttaacacctaatttacattttgttctttttctctatttcttgttcttgcttcatattgctaacatgctcccgatctttgagaatatgtattgtgcttctgttaaatttttggtccatctgttgcaataagctgcttcatgttcagcttgcattctctttcgctagttgtactgcttgggatttagttactgtggcaggtggtcttctgtttctgtggtgatataaatgttctgcctggtagtgtatgatggggaaaggccaaatcctaggtggtgccccttctggtgtgtataaggaaaaggaaggagacgaggcccaggcatcatgtcgctgctatcaactcttctgtttgctttcttctactgggtaacttattcagttaaggattcatcctgacactcttagaacaaagcaggaataggaggaagtgatctcctcaggttctaatccccagccctgcaagtctggaaacagaagggatgaagaagtgtatacccagtgaaggctgggattcgtttatccctgtctctcctgagagggctttatgctgctgccctgagattattctggctgggaataggaatagagctggcctagtcctgcagacatctgggttgcaggacaggcaaggacccagaccctcccttggtgatgtcaaggaggggaaatgagagaactgcaatagtcctcacaaatccatcctcccaccactgggccagaggaaagaggaggattcatcactccatctatcctctttttcctgggtcaggatagcctttgatctcctctttatttcagtgtctctgttagttccttggatctgtgcttccctctgcttctgaagtttccctgggttgaatttagaggatgaggagcacatgctaattcaccgtcttatcaggaaacagcaataacatttcagggttttttatttgtttgcttgtttgttgttcaatctattaaattgttggcaatacctaccctttctgctgtatgtttaattatgcttttcagtctattaatttatcattttcttattaatttatcatattctgataatggggtattaataccttgttctaaaattgtatacttattaatttccctttgatttttataagggatttgttgctatgttctttgaaccttatagacataatatcattatgctctcattattaaggcttttatcacataattaacagttagcttgctttaataacttttaccataattctaccttgtctgaaatctcacttgctttttttccctttaattagtagacctttttagtgatttttaaatttactttttagtgtttttatcctttttctaagcctttttaaagatttcccagtaaattattgcattattccagttggaagcatttttttcgtttttgtgttttattttttcttcctcaaaattgtttgagcttatacttattttaaccctagtccgcttaggtttatgttcttccattttactttttatctctcaatttttatagttaatttgtttttttttcccctagatgttctttggtattatatacacaattaatttgtttggtttgggttttgcttattttaatttcctttagcaactgtcttctttttaatttgattagctgtcaatttaagataaaccacaaagatttcattatcaaaatggtatctttgattctcttttatgggaaacttttgttctttttttgttcttccctactctgttactgcttccatttttcattgaattaacttgttgctcagtttatttattttaatctgcttttattctaacaattttcctaatgcccaactcctatcacaaacaattctttctattgtttttgtttacttatctcttcaataggtacatactaattcaagatttcatactatttttaatagcatcatcttttttcaggtctatcttttaagatcagatttctttttgtagtaacttttgaagtcagtgctggtccattagtgggtgaccaaatttcttaagactgaaaattcatgaacatctttacatttggataaaaacttgactgtataaagacagaaattatacagcttctttactctatggtatgtacatggttttttcattacaatgaagtccttgtctacttatgactatatcttttacatgaaatatgtaacctagctccttgcagaatgttttcttttccttttgtaattaaaataaaatatttgatgatacatgttgatttcagttatttttagtggatcttaaatagggctctgtttgtactttaacctttaactattttattaatggttacatttttcttctagtggatcttttctttttctaatcttcaatgttttattctttgtttgctcattcattccataaatctattcaaagcatctatttcatgcaagcaatgtgttcagttcattccttctctttctttaggaactcctatctcttccagagcactccattctccagatcttcttttgcatatttttatatctcttttcatgctctgcagattttttcctagttcattttctctttctctgttagttacctgtagcatccaattctacattttacctatactaccattgtttactccttcctgccccttcctgctgtaatgagctcttctgaaatagatataatgtctttcttccacatttaagaaatagtttataagtattttctaaatcctgttttgattcttgtttcatttcatggtttattgattcatacttcccatccccaccccaccctgcacccaggttcttaattcatctttcttctctcgtgcctgacaaacattttcaatggttccagtcatttattcccctttactcattcttccttgagtttctcatgatgatatggctgctatttctgaaacctttgcttcagactgttttattcacatttaaataggccttgaaattggaaggttcacaggctctcactcagacttcctcctggaggtccaaaaactttatttcttgagcacatcatgtcctaaataacacacacctgtattggattggccattcagaattagatattacattaaatattactttccttatatctatcaaggtaaagtcccattaccactgagaggggtaagttaatttattgataacttgcttgccatttactcctgctggttggcagtttaaagagcacatgcttcctgcatctcatttatgtagcttaagtagtcacctgttttgaactgatttgagagggaagactggattcattggcaagtcatggatcaattattatgtaagctctaatgctagcagtctcctagcaaaatggatgtgattaacatttaagcacgatgacaacccatgcatttttcatttactatttccttcaaacctatttgccagttcctctgctgtgattccaagaaatgcatactttaataataaagacttaacttttcctttgtatgaaaatattataaacaccaaaaagccttatgaaattataggagggggaatatcaaagaccattaacaacattatgtatggtcacccaggaatttgcacacaaaattctgccaaagctagtgtcatttatgtacttaagttttccaaacaacgagttgaaaaatataccctcaagaattgtttatgccaagaagggccaactatttataatcacaagtggagtttctgcaaaggtctctgccagccactacagtcctggcatacatccctcccaatctgcaaaaactctactgtttggggttgaaagtgaagcatgagtccaaagaaatacttgcagctttttcctagactcagttgaattcagagtgaaagaacatagaagacgacaaagggtataggaaatcgcagcataggcagccctgccttatttttagtgaaaaggattagtactggtagccctgcagtaaagctgatcgcctgtgatcagggagtaggatagttgtaatccctttactataccactgagttgattgattaaattgaaagttatgagtcaaatgcccccagagcatcttggaaccttcctgagtctgtgcatattcatatggtcctaatgaccttccactggaaggaaaaagtgtgtgctgcctgcagggaacacatgaagaaaggcttaggacgaagcaaaactttttcacaaccaccagcaagagtttaattaaactctgtctaacattataagcttgcctcaatttaagagcaaaatgtaccaggtttttcctgcacatggagcctcccagggtcttgcagctcaagtggaaagaacaatgaaaagcagaaggctttcattttacatctggctccttgaaatggggctaagaggctttctggagggttttgctggctgggacagttagtgtttacagatgtgagtggctttcagtcattgaatgtaaattgcatttgctttgttgcacacaccctgggaaaaccaagaggaagaagagaaataatgttcctttatccgcccacacacattgatattcaaggcacagtcttttcaggtttattgggtccctaagcaacctttgaagagatctgtacatctgtccggctgtccgtactccagcggacatggattcctttgctttgcttttcaagtctctggttccatctttggtccgttgactgaattttttggtaaacatttcttgcattcagacctgagtggccacccagctcctgggctaattctgcttctctcttaaaatttgatctgtattctgaaggcaagatcctcaggaaaaaaaaaaaaaaaaaaaaatgaaagagggctagcttttaatgtggaagctaaaagcctaagaagtaaactaaaataggaaggtgggagagagagcaagttcttgctgaaataccaaatccccaaaccagatcagagtaatgcgagagtggaaaggaagcctttctaaagtgagagaaactgtaatctaggtttcttttgcaccttgcagctccccagaaaagagtagccaatggtcagcactccgctgagaggcaatacatattgtatatagtttgaacaataatggactattgtgagtcagatccatctaggagtgttgaatctgagacttactagaggggcttatggaagctacttaacgtgtctgtgcctcagttttctcatctgtaaagcagggataatcaaatcacctatctcatgaagcagttttaaagacgacctaggttcaaagctaatctccaccatttactagctgtagcaccttgcagaagacactgacttacactgacctccagtctcctcagtaaaatcacagtctacatcactgtattgttgtagagttggatgagttaatattcttagaataggcttggaatatgatgaaagctcacaaagtgttcgtcattattattttaaaatgagacgatgtataaatggttcttagctcagaacaagaccaacagcaaggactgtgttagctatggctataatgtgcttatttctagccttgtcctgctacccacccaaattctcaacctctaaataaggatttagctctgatctcatgctgatatcttggataagtcttctcatctgattggcttccatcacctgatgagagtttgctgagattccaacctgactcctgaatttcttccatgtaccaagtggagagagggccaagttccaggtatattttgtcatccctaacttcacaaatatcactggaagtaaagggccccaagtttacacttgacagaccatttataaaagattttatactacaaggcctaaccagcaatgaggaaatagagttttcatttgtgactttttcccctatcagaaaggaatttaataacaaataaaatatatccatttcagcagccaaccagacaaacacatggaactaatcagctaattttaagttagtatttgatgaccttttttttttttgtaaataagaaaagagaagtcagtggagtttggaatttatgtgttctgtgatttctgttggccaaggtcagttttacttgatttctcttcccctctttgcctaccacccaacccccaggagcacataagcaattattaggtgggatctctctctatgtatcctaggggctgagcaacaagcagttagagaggaatcaaagctgggagaaggtaaggaaaccatttaattgttgagctgagtcctgggcagctccttctctttctgcctagtccagtcttacatggtcttcgtatttcagcctaaaccatcacttctttaaggaagctctccctgattccccacactggactggttctagttcttaaacactctttacaactctttgtgcccttccagctatctattgttctgtttatcattctgcacttgaactcctggtctcagtcaatcctcccacctcagtctcctaagaagccgggactacaggttcataccacgataaatagagcaacaagctctatttattgtttagtacagctgcttcaggtttccctagggttatgttcttcaggatattccatataatttaaagcttacagaaataagattaatactgaaaaaggattaagactaaatttttaaaccagctgtaaagtggtacagctgtgcaccaataacataaacacagcttaaaattcattcagtcaccagctttgaaactacggttcttgcaattttttaatttggggaaagagaatttgcattgttttgcacattttgtgcacagagtggctttactaatatttttaaatatttttatatgtctttattaatatttttatgtttctatgccttatgacatgtccatataggtccaaatcagactgctctgtaattatttgtttaattaaattaactggctcccccaataaaggataagttccaggaactgtaactaccctttgttcatttcattccacccagtgcctagcaaaatggtatgtggtagacactcaagaaacctggaagggatttagaagggtagaaactgacaccttctgagaataaaggaggaaaacttttttcttctctgtgggcaggaaggacagcatgttttccatctcaaagacaggaaagagttatctcttcctctgggatccatcagcatcctgcctactcctgcgtcacagcacagatcctaactggcaaaattattaatctctcttccactgaaatagatacatcagacagattcctttctgactgaaactgttctgctgtgaaagactaacaacaaagcagatgctccttcatgcctggccagttctatcagttatcctactggccatccagggtaggaagaagactaaagccttctaacacctgacatctcccaatccaggagagaataagaggaaattcccagttactgagaagtgaattgcagctcccctttttgaggatctaataccatcagccaccccatctccttatgggcccagaaacccatgatctcttattttatctcttcctttataagaattattgagtaattgctatgctgcctatactgtgtcagttgcacatcaattaaacaattgcctaattggactatacattctctaccctactcctggtaccaaaatctgtgttagagttctccagtgggacaaaaccaataagatatatgtatataaaagggagtttattggggagaattagctcacacaattacaagatgaagtcctatgataagctagctgcctgcaagctgggaaaagagagaagctggtagcctggcccagttcaagtctaaaagcctcaaaaccaggaaatctgatagtgcagccctcattctgaggtcaaaggcccaagggctcctggaaggccactggtgcaagttgcagagcccaaaggctgaagaacctgaggtctaatgtccaaaggcaggaggagaggacgagtcttcctctcccagtccactggctcaaatccagtccactggctcaaatgtcagtttcctctggcaacaccctcacagacacatccagaaacaatattttatcagccatctaggcattcttcaatccagtcaagttgacgtctaatattcactgtcacacctgccctaggctattgtttccctgagggcagagactatgttttgttcatgactgcatcactatctcccagcctatgcaaaacaaaatagacaactagaagtatcaaatgaatgacagataacagaatggatagatgaactgggattctggggttcactccatctcttgtagtaatatcaaggaaatgtcataaaagacagaatctaaaccttctttaaaatctatattagttaaatgcattatgcttcctttaatctataagggctgcaaaaatctctcatattaccctcaacccttgggcagcaatcattagtatcttcaagataccacatatattagaaataacacgggacaaactctctatatgatgaacacatccttttccttacctttcattttctgtgtcatctttgctttttccctgcattctatgattttatggcagactctcaagaaaggcattagagttggttgggactgttactatatccccagctccagcaccatatctgatatagagttagtgctgaatacatgttactcaacgaacttgctgcaagaagtcttcacttttaagagaatatttcaattacttaaaacgatcatagaagggaggaatatgtacgtactaacaatctaataaggttactcagaattgtatacacaaaactgctgaagctaacagcatttatatgcttaagttttccaaacaatgagttgaaaatataccctgaagaattgtttatgccaaataaggctgactattcatgatcatgactggaattgctgcatgttttgtgccagccacttcattcctgccaaacatcctcccaatttgcaaggattcttgggtttcgttttgaaaataaagcagtaaaatgcttcttaagctcaacttatgtggggtcttattcttcattagtacttacttaagctatactgattagagtaacatcttaactcttttgaaatgcttattttgattgacaaagtgacatggaatttctaaagtgacaaattgaccaaggagcacagaaacaagtcaatagaattgtgatgttagcttgagttctgaacactcaacacttggaaagaacctcataccaccttttgtgccagagacaccgagaacctgaaaggctgtcagtcagatatttctattagctgaagcaagaaaacttcctcatcctggtggctcctaggccaaaatttgcaggggaaaaaaaaaaaaaggaaaaagaaaaaagctggcagaccaaagccttacattgaccaaggtcttaaacacagcaactagagattatatgcttggaaaataatttataacaaacagcgcaaaagcactcctgataagtgagcctgctgaagacccttcagactcagtccagacctaggttctaaaccagtgagtctccttatttggaagaactgcacaagagtttagcaacccagcattgtaccaattctaacaagaccattacatctaaagctttattaagcatgtagactctgcagtcagaataaatcctgcctccaccacttattacctgcaagaggctaggcaagacatttaactcctctgtgccttggttttctcatatattaaatggggataataataatactaacttcataggactaatgtgaggatgaagttaattaatttatgtaaagcgctcagaagagcgcctagcatatattcagtgttatatacttggcagctattattatgaccctttttcatgatctatttcttgccttggaccccagttctcataactgggtcttaattttcatgcatgtgtcaattccatagatagttaaggactgcctgctatccagctgactctgtcctttataaaatggcctttttccccagcaagacccatataggagccctggctttgcccttccagggatgaagtcccttccttgctccttctaattcttccaagcactagaattctgccttttattgctgccagacctgcctgatgcccagtgtctctatcaccatctgctcctaatccctgatctcgcctaacaccaggggatttctggcctgcctgctcatcccaataccgatctttctgtctagtctttaacctcagctgcctggtctggtcttgattctgacagcacccttgaaatttgttcaagcaatgaataagttattcaaatcctttatttccctccaagggagaactaggaagccagaccttataaagccaaaggaattcctgttgcccccttactgcaataatttaatctctaagaaactcaaaaaagcactaaggaaataaccctctaatcataaacaatccctctccatcaagagaaaacagacctctcctgcctggaattgcttaaacaggagtcttccatttcaccagagctccagggacaaaccagccaccagctaccacaatgggctgcaagtttcagaaacttgcaaaggggaatttttcatcctgattattgcctttgcagtgttctcagctgccagcatgtgatggagggcgtgggtatgagcctgcttttgtgttcttaaataaggctaagaggctgttctccttcgcttcttagccctagacactcatcaatcaaccagatttcctgagtgcacctactatgtgcaggtctttggaaagcaagtcacctcctatgtactttttaaattttttttttttttttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatccgcccgcctcagcctcccaaagtgctgggattacaggcgtgagccaccgcgcctggccaaatttttatttaaatgtttctgcatacagagtgggtttatatgtgtatagggtacatgagatgttttgatacaggcatgcaatgtgaaataaacacatcatgggtaatggtgtacccatcccctcaagcatttatcctttgagttacaaacaatccaattacactttttaagttattaaatatttttaaatatacaattattgaccatagtcaccctattgtgctattaaatactaggtcttattcattctttctaatttttttgtacccactaaccatccccacttcccttctgtccccctactagccttcccagcctctggtaaccatccttcaactctatgtctatgagttcaagtgttttgatttttagtccttttgtactttaaaaaatattggagggaagctaataatcaaggcaaaacaaataaagttctgatgctgccaaagcagaagggactttcccaaggtcacagagttcaaaaggagcagatccaggatttaattacatcaccctgtgtaatacagattgtttgacacatctcactcagttcactggaacttggcctgttccagcttaatctcatgccctctgcaaatcatactcttggctccacatccgtccaggttcctagagagcagcctctcattctgatctccaggcctttgcacaggctgtttcctgtgattgccaccctccatccagcctctatttcttcacttgactgtttgcttgccaccctttcattctctgcattaaccccactgcctcagaaagccgtttccaattccccagtctgtattggcggccctcctcttttctgctctgtggctatcctatcacggcactttccacactgcactgtaattgcctgtcctcacgtttaatcccctaatatgctgagagaccctcaagggcaggacccttgtctggtttctctctgaatccccaggaccatatgtaggatttagagcacaaacgtgacagtgaatttttgttaaagtaaggtggaccaaactctctctttaccaagctgcctccctgacaggtcaaatcccagactaaaaatagtagctttgcaactcctggctaatggctccaggcaggcacttctgtcccagagcacctgacctctgatctgtaaaatgttctggggtaacatgtgtcctcccacctttgcctcttacaggctcactgatcatcactgtcatttccctgataccacccccattatgggagaaggaaactttcagttttcatccaatgcagctcaagcatagggtaggccagagtgagcctggagagacaagacaagaaaagtaactctgcttctgccgtcactcagttagtttttctttattaaaagggaactttttattgaagcataacatatacacagaaaagtgggtaaattgtaagtctatagctcaaagcttcacattcatgtgaacacgttcatttcaccagcacaaaactcttaaaatgactaggactccagaagcctccgttttgtccccatccagtcactactacatcttgacttctatcatagattaatttggcctgttttaaaacattttataaaaggaattttacaatatgtactcttttgtatctggcttcttttgtttatagtatatagttaactttatagttggtgagattcatccatgtggttgcatatcattttggtatatgttctttctcatagctgtataatattccattgcatgaatctaccgcttttcatttatctatcctattatggatgaacatttgggtagtttccagtttggggctgtaatgaacagtgctgctatatgctatatccattcatgtatatgtcttttgataaatatacatttgcctttctgttggttagatactagatgtggaattgctgggttgtaatgtaagtggcttagctttaataaatacagctaaacaattttccacaccaaaagagatctaattaatctacatccttgcccatacttgatattgttgatatggttttgttttgttttgtttttccactttaactactggatgtagtagtgatatcacgttgggattttgatttgtacttttttgaattttgcctagtgtgttgtcattgaccatttggataacctgaagtatttgttcagatgttttgatcgtttttctttttctattatattctctgccattttcttattgacttgtagtaattctttatatagtctagataaaagtcctttgtcaattatatgtattgcagacatcttctcccattctatggcttgcctttttacttttctaatcttttggtaaatagaggatttaatttaaatgtggtccacattatcttttttttgttcatgattagcaccttttttgctccatttaagaagtttttgcctacctcaaagtcgtgaagatgttctcttgtatttccttccaaaagcttcatagtttttatctttcatatctagatattgaactgatctgtaattgaatttgtgtatggtgtgaggtaggagtcaatagtctttctgaatttttttttacaggactattgattgaagtgtccatctttttcccacttcattacagcattacttttgtcatacatcaagtgactgtacatctgtgggtctgtttcaggactcttctgttcttctgttccattgctgtatttgtctgccctgcaaataatacactgtctttattatggttcctttacaaaaagctttgatatctgggagtgttctctgattttttttcttcttcaagattatttggctattcttggtcatttgcatttctgcataaatgttagaatcatgatcgatttatatttttaaaaaacctgttattgagactgtttttgaactcatagaaaaacgtggggagatttgacaactttacattattaaatctttcaatcaatgaccatattattccatttatttagttttactctaagttctctcaataatgttttatagctttctgtggataagaagtcttgttcactttttcatgagatttattcctgggtattatatgttttatgctattgtgaataataactttttaaaatttcattttccagttgtttgtcactggtatataggaataaaattgacttttgtattttgaattaattttcagagactttgctaaattcacttattgcttctattactttgtatatagattattttggaatttacgtacacaataagttatgccaataattcccttctaatctttatagcttctctttttccttcttgccttattgcactggctattacctctacgatgttaaatagaagtggcaataatggacattcttgacttgttcccaatctcatggggaaagcttttaatatccatcattaagtaagattattgctatggcttttttgtaaatatttttatcacattaagaaagtttccttctattattagtttgctgatatgttttcttatgtgaatgtatatcaaatataatcagatactttttctgtgttctatgaacatattcatgtaattttttctgttaatgtgatgaattgtattgattaaattttgaatgttagactacccttgtattcttggaataaaccctacattgttattatatagcatactttttctaatttactggatatagagtttgctaatattttggggttgctacatctatggtcatgaaagagattgggcttccatcttaacttttacctcaattttgagatggatttttttctacctgggctgacccctcttttgtcctatatatagacttagttaaatagactttgcttctattattagcttaacaaacttcacccagatcctctagtttatttcttattgacagaacaaaagctttctcaacgacaaactagtcatgagccaagtcatggtccaaccactccctggcagtgtgtccactgtcacattatagatcctccctgagcctgtttccttatcaatgaaatagcattgaaaaagaagttagacaatgcataataaagcacctggtacaggcaggtgctcagtaattcccatttctcactacctcttctcttctgcttaaaaacttttcaaatacagaagagcattggcttacttatttacagggcttagccatcagagttaagattgaaatctgaaaaaatgaactaatgggggtgggagatgtccattctttttgttatactctaaaaaacaaagcgaagttgtttactgctcctgctaagcttctttaaatacaagctcctagatttttaaaattagataaacattgctagaatttatcatctgtagtgctacagttccttccctggggcttcaaactcaagtgttagtggagtattacacatttggaagttgtccaggaatatagcctctctcccacatttaacaatgtttatgtgtaaaagtcagcttggaaggacacctttaaataatgctctttctggatatataattgcagtgttacttgtcagtgcataataaaccatcaaccagcctttattgtaccagtgggaatgagagtttgagggtgccctgaaattatgttctttgtgtctgagatgagaattaggttagtagctaggctttatttatagatatccaaataaatcaggagtcagaagttcagaaagactgggctgggaaggctgagtccaaagaaggctgaagtctatgaacaccaagagtcaatacccctaatgctatcaaggacactggataggtcccatcctacttctccccattatctccaccccaagaactaatcccggtgacaggcatgagtgacatcagaatgaccttctgactaaatctgaacttggctcaagctgtggatccccagtggagtagaaagggcaaggccttaaggttggcagatcaatggcaaatctcagccctgccacctacttgcaactcagttctctcaccataacatggggatggtaactgacctacctagcaagacaactgtgagaatggaagggtattagctgatacctgtgaaggacatgatgcagggaacatgctcaataataaatggcagtgattgtgatgatagtgatactgatgaggatgagacaatgacaatgaagacaacatctctagctttgaataaaggggtggtagaggattacctatattatgcttatggaaacaggaggagcatccctaactgccttttttctaatccccacaattattttatggatctctgggcccagacacatgatcttagttggacaagccatgtctcaatttgtgttctcctaaaagcaggatctgaggcaaggactgcaggtacttcgtgtagaaggtgatagaggaagcagaagtgaaggaatagggagagagtgacaagggaggaggaagggtcaaggtaagagtgcattattcaggtcactggcatcagcgtacctctgagaggtgtatagaatgagtccagaattgtccactttccagaattttctactagcacccaccccctattgaccaagggttgtctgcagtagtgtgaacttccccacactcccaggcacttgcttgctggctaaattgactctcaaagcttcagagaaggccatgagtcagtcaacaggaagaggcccttgaggtagacactcactgatagcattagcaagtgctcactgctgcctgccatagttgtggctgaaattggaggtggatggagagtctgtgatacagggcaccaaatgtagctgctgcaggccaagtcttagttcaagtgcagactcctcctgcaagctgtctacttgccacatgtgatacacaattgtgagagtcccccgtcgtcagtagagtctttcctctcccatccccttgtgacagaaaggactacctgcacagttggttcttatatttagcagtacacaaacgtacaccaaattctagagctgtactgtccagtacagtagccactcgatacacttaaattgattagtttatttaaattaaataaaatttaaaatttatctcctcagtcacactggccacatttaagtgctcagtggccacatatgagaagtggctaccatattggacagtgaagtatagtatacttccaacttcttggaaagttaaactggacagtgccactcttgagagagtcagtctggatcctaatcctggctctaccatatactagctgggtggccctgggtgagtcatttaatctgtctgtgctttaatttgctaatctgtaacatgagtttatttccatgattaaataacaatatgtaagcatatagtaaagtctcactacatgttaatgattattatttcccaattcccagggtaatatttatgcaaggcaggaagtacttaaagagcctccaaccctgattcaggccctgggtcccttgaggctactctctgggcttctaaattatctctgtgctcaatatggccatgcccatatacctcccagtctccaaacagggatgttgctttagccctcactgccttttcagcttgtcagttccccaccctaagtccagaggctggagctggaacagtcacccccagcttatgtcaggagccctactgcctgcttctggaaacttctgtctgtgtgcctgactcattctgtcaccattttcccaccacttgcccaccctcccaatgggcctctgcactcccaatgctgactatgacctgaactgaccacctcactttaaaatgcttgctgtcctctaagaccttgtcctaccctaatggacaggtcctgtgcatgtcctggtttgctaccaatttctatctttcctagagaaataaaatattaatatttaaaataaccattattgaatgttttcttgtgtgccaggaactgtgctaagggctgtaatatggatttccttccgtaaccccatcacaaccatagaagataggtactattattatttccatttcacaggtaagaaaactggatcttagagaatttacatagtttgttcaagattgcacagcaagtatatggtgaaaacaagaatgtgatgaaatccttaagccagtaggaggtccttttcttctttcaagacaattgaaaagaaggagggactgatgcatacaacaacatggataaatctcaaatgcatgatgctaagaagtcagactcaaaaggctacatactgtgggagaccacttatatcttggaaaacttaaaactatagggacagaaaacaaaccagaggttgccaagggctgggagtggtggtggggttgttacatgggaatgtgggtaggtaatacaactattcattatcttgattatagtagttactatgtagttgcctgcatttgtcaaaacttgctagactttacattaaaaggggtgaatattactgaattcaaagcatacttttatttttaaatggaaaataaagaagatagagagtaattttcctctgaatgccccccagcaattgttcaaatgtgggaatagaggggaacaaacatcagtttaaagatttggtggagaaaataagctcgggttcagattgcaaggaagataattcaaggagaggaaatggaagcagtgggttcagactgaccttcctgaaaagcctggaggtgcaggaaaggcaaaagatgggcttttgtgagaacaaagcattgatggaagatttttttttcacccagaatgagaaaacttgaacctctttacttaaagggagaagctcttcagtgaagaagagattaaaggtgcaccttacccacatatttcccatttccagcactctttattccttcatgtagatctgtatttccatctgttttcattttccttcagcctaaagaacttcctttaatatttcatatactgcagatgtgctaataataaattcacacagctttcatttatttaaaaaaacgttttatttttaccctcatttttgaaggatatctttgcaagacacagaattctaggctgacagtttttttttttaagctttaaagttgtcatttcattgtcttctagtttgccttgtttttgaagcaagtcatcattcttatctttgtttccctcattgtgtcttttatcgctttttgttgctttgaagattttctctttttctctagttattagattatgatgtgcttaggcatcattctctttgtttttattctgtttggggtttgttgatctgggatctataggttggtatttttcttcaaatttgggagaatttcaggcattgtctcttaaaatatttttttttatttatttatttattttgagatggagtcttgctctgtcgcccaggctggagtgcagtgcacgatctcggcccactgcaagctctacctcccaggttcataccattctcctgcctcagccgcctgagtaactgggactacaggcgcccgccaccaggcctggctacttttttgtatttttagtagagacagggtttcaccgtgttagccaggatggtcttgatctcctgacctcgtgatctgcccgcctcagcctcccaaagtgctgggattacaggcgtgagccactgtgcccggcctgtctcttcaaatatttttctaactcaatctatctattctctccttctggaactccaattaccactatgttaaaccacttgtttttattccacagtcatttataccctagttcatttttttcagcccatttttctctgtgcttcattttgaattgttttcatcaccctatcttttagttcactgatcttttcctttgctgtgttcaaatacagatattatatttttcacttctgaaatttccatcagagctttttaaaatagtttttatttatctaccaaaattccctatctgttcactcattatgtccatctttaaatccttgaacatattgataatagctgttttaaagttcttgtacgttagttccacatgtcagtcatctcaggaactcctgttattgactgtggggctttttcctgatttggggttacatttcctgcctttatactgctcttgtaattttttttttttttttttgagacaggatctccttctgtcacccaggctggaatagagtggcaatcatagctcacttcaaccttgaactcctggaccaagtgatcctcccacctcagcctctggagtatctgtgactacaggcaggcaccaccatgcccagctagtttttaaaaaaattttgtagagatgaggcctcactatgttgcccaggttgatctcaaactcctgtgctcaagtgatcctctcacctaggcctcccaaagtgctgggattacaggcatgagcaccatgcccagccatgtctagaaattttttattgcatgatggacattgtaaatactacattgttgagtgtctggattttttatcttcctttaaagagtatgacaaatggttaatttactgatggatctgcttcattcctttcccaggcctgttttctaagctgtgttggggtaagtctagagtagcctttactctagggctaatgtagttttgctactaaattgtagcctttctagggtttcagttgaacatatagtgttcagcaagttctctctaacatggatgggtagatattttatatctctagcattgtgtgacctctagaatctctattcagctcttagctccccaggggctgttctctgccaggccttgtaaagtgtcaccctgcacaagtgaagcttagtgtttggtcaaagatttaaggggacttctatgcatattctgaagttccatctccatgcagcttcctcctctctggcattctagcccataaatcctatctactttaattgccccaaattcttacctctacctcctcagctcagacagtttaccatggtcagttctactccaccttcctgcaccacaaacaagaaagtgtctgtggcagaaagcctgggcaaacacgggctcatctcttgtgtttcccttctgtcagtgatcatagtcctttgcggtctgttttccaacatccgaaaactggtgcttaatatattttgcccacttatagttatttatgtccagagggctaatgcagtgccacttacttaatcagagtcagaagcagaagtcaagtgagcatatgcagatctgggagttgtctatagacaggactatcttattctcttctctgcttcacattgccttaaagataaaatgtttctattaagacagtcatatcctatcatgatctgcctggctgactgatctcatcactgatcatccagtctttatacacacacactcacacacacacacacacgcacacactaccatgacctactcgtagtcttacacatatctctagctttttcttatgcctctgcttttgcatctattattttgtctacaaaaataaccttcccccaactccctacctgccttcctaactgctacttatccttcagaatttagctcacctgccatctcctccaggacacctcctctggaaccatctgggttaagtgcccccttatttgtgctgtgacattctgtgtttgcctttatcaaagttgtatcacccacgctttattgtaattgcctgttatgacctatcttccatgcccttcacaccccaccctccagacagaacatctctaagaccgggatcaagtctgagtcatctcagtgtctctatgacctggcacaggttttgaaactttttgtatgaagggccaaacagtaaatattttagagattgtaggccagacatcttcagctgtaactactcaactctgccgttgtagcatgaaagtggccataaacaatagataatacataaaatataagactttattgaaatagaaacaggcaactgtagcttactgatccttggactagcacatagtataatcccagtaaatattcattgaatgaattaataaaatattattattggaggcctcagaagaaatagaaaataatgtaatcaattttataagtgcaagagttttcctgggaacggaaaagtggcactttccttgaggccctagggaaggaaaaaaagacagtggagtgaagaaggcaggataatagaaaactgggggatttctggcctaaatgacagacttccccatgcatggcttttgccaggaggccattctgggatgggaacctgaaaaccagaatggtctggtcagagtgagttcccaaggcagccaagaacagagaatgccaaaggacaagtacaagctgtgtcctgggcagcacccaggcgcaaacccgcagaaggcatgttttgcagccaaattcaaagtgtcagaaaccaggcaggttctagaactgcatctagcatgaaaataacaagggcaagagggatgtgagatccaaaacaacttttatgaatacaactggcaggtccacaatacttttctgttggtcactggccacattgtgcatggatgagtctgtagatgggttaaccttggctttttcagaagagttaagtgaccagttcatctactaagaaataaaaggaggaggggagcctagaacttagaggctggaggagatctgtcatatataactactatagcagattccataagggcccaatcagggctcaaaacaaagatttgctgaaaagtactatgggtgaggctgaggttagacaacagaaggttgcagcaatctaatcactaaggttgtaggacattctgtagagaagcattatgaatgagtatcaaggaaatgaataggtggcttgctgcagaattgggattggcaggggaatgcagccactggccaggagatccagatagtcactgaatacctgttgtattagtcagggttctcctaagaaataaaatcaatagggtatgtggcggggcagggcggtggtgaagagatttataaggatgtggctaacctgagtacagaggctgagaagtcccaagacaatgcagttagcaagctggagtcctaggggaaccaatggtatagttccagtctcagtgtgaaggcctgggaaccaggattgttgatggttcagttccagtcctaaggccagtaggctgaagacccaggaaaagccagtgttttagtttaagtccaaaggcagggggaaaaaagcaaggttccagcttaaaggcagttaggcagaaggcatttcctcttcctccagggagagtctgccttttatgttctattcaggtcttcagctgactagatagggcccacccacaatagggagagcagtctgttttactctaccaattcaaatattcatccagaacaccctcatagacataactactttgatcaaatgtctgccctccccatagcccagtcaggttgacatataaaattaaccatcactctgccatgtgcagaacacctcagagaatctatctaccatgcaccctgtctccttcaacactagataaaatatcagacagaattatttgattagcactggtgttttaagcatcattgtgaatgctggcaatttagtaccaatgatgacagcagaaaggatgttaggaaagaggttactacacatatactcaaaattatctccctggagtagctttttagacaaatgcacctggttggccatcagtatctcaaacttacatgtctaattatttcttcctcccagcttccccccacctctgggcctcatctaagctattgggaataaataaataaacccagagaggctacttgaactctgctggaaccagtgagggacatgcaaaatcaaaaagccatgtccttacctgaaagccaaaaaggatagtgatagtctgccgcttccccctaggtctgagttcccagtgtttcaccaaagactccagaggctctgagttttcctttaaggccacaagctttaacctcgtctcctttttcccagccctcctgatacctgagtcttttctctctcctcctctatttactagaggatgtggggcccaggtgtaaactttctcgtgtcccagctaactgagatctgcttaaccacctcattctgcaggccccagatcagagtcccatttagatgattccttgactccttttttcagattcagatccttgcatgtgacattcctgtcatctccacacccctccccaatcacccaatcagattctctttggttaccatgccttacagaaatgtgtctgcattttccctgctctatttagatttaattttactagctaatatttattgaccctattttatgcgccagccactagtcactatttcatggacttcagccttggaacaacactaggaggctgatcatattactatccctattttacagatgaagaaactgagattgagagtgactaactgatgtgtttaatgtagaaagtttcagaaccaagactagaatatacatagatctgacctccgaaaaaaaaaaaaaaacccagttttaactactttaccaaaatgcctcccaaggactgttcagtcttctgtcttattgtctcacactcctggccccttgtccccattccccctaccactgccctaagtcagacactgcatgattcatgaagggaatgtcaaagggccttctatttggtctcctcaccttcagaccctctcccttcctatccctgggtatgtcctaccaaaggtatggtaccatgcagcagagaagagctggtctttggctctttgactcaactttgaatcccagtgtcataactcgcctgcctctgcatttttgggttaactgaatgagaatagcatctgtattaacagttttctttttgagcgtttaatgagataacataggtcgagaccttggcattgtgcctgacacatagtaaagtctcgtgtattagtccattttcacatgatataaagaactacctgagactctaatgtaaaaagaggtgtaattgactcacagttccgcatggctggggaggcctcaggaaacttacagtcatggcagaaggtgaaagacaagcaagcaccttcttcacaaggtggcaggagagagcaagagtaaaggggaaactgccacacacttttaagctatcatatataataagaactcactatcatgagaacagcataagggatatcacccccatgatccaatcacctctcaccaggtccctccctcgacatgtgggaattacaacttgagatgagatttgggtggagacacagagccaaaccatatcattctgtctctggaccctcccaaatctcatgtctttctcacatttcaaaacacaatcatgccttcccaacagtcccccaaagtctcaactcattccagcactaactcaaaagtccaagtccaaagtctcatctgagacaagggaagtcccttctgcctataagcctgtaaaatcaagagcaaattagttacttccaaggtaaaatgaggatacaggaattgggtagatgctcccattccaaatgggagaaattggccaaaacaaaggggctataggccccatgcaaatccaaaacccaaggcagtcattaaatcttaaagctccaaaataatctcctttgactctgtgtctcatatccaggccacgtcgatgtaagaggtgggctcccgaggccttgggcagctccacccctgaggctctgcagggtacagcccccgcggatgctttcacaaactggtgttgactgcccatagcttttccaggtacacagtgcaagctgtcagtgaatctaccattcaggggtctgaaggatgatgaccctcttctcatacctccactagacagtgtcccagtggggactctgtgtggtgagtcttcagccccacatttcccctctgcatggccctactagaggttctccatgagggctctgcccctgcagcaggcttctgcctggacatccaggcatttccatacatcctctgaaatctaggcagaggtccccaaacctcaattcttgccatctgtgtacccacagacccccaacaccacgtagaagcagccaaggcttggggcttgcaccctctaaagcaatggctcgagctgtaccttggcaccttttagccatggctggagcttgagcagctgggacagaaggcaccatgtcccaaggctgcacagaccagcagggccttgggcctggcccagaaaaccattttccctccttggtctcccagcctgtgatagcaggggctgctgtgaagatctctgaaatgcccttggagacattttccccattgtcttgactattaacatttggctttttacttatgcaaatttctcttgaatttctccccagaaaatgttttttttttcttaccacataggctgcaaattttccaaacttttatgccctgcttcccttttaaacataagttccaatttcagaccatctctttgtgaatgcatatgactatatgcttttagaatcaaccaggtcaaatcttaaatgctttgctacttagaaatttctgctgctagataccataaatcctctctttcaagttgaaagttccacagatctctagagcagaagaaaaatgctgccgctccctttgctaaagtgtagcaaatgtaacgtttactcccgttcccaagaagtttcttacttttatctgagaccacttcaacctggacttcattgtccatatcactatcaggattttggtcaaattcactcaacaaatctccaggaagttccaatctatcccacatcttcctgtcttcttgtgagccctccaaactgctccaacctctgcctgttacctgcttccaaagttgcttccacattttcaggtatctttatagcagtgccccactttgggtaccaattttctatattagtccattttcacactgctataaagaactacctgcgactcggtaatttataaataaaagaagtttaattgactaacagttcgacatggctggggaggcctcaggaaacttacaatcatggcagaaggtgaaggagaagcaggcgccttcttcacaaggcagcaggagacagcaagaatgaagggggtactgccacacactttcaaaccatcagatctcatgagaactcactcactatcatgagaacagcataagggaaactgctttcatgacctcccaccaaatctctcctgtgacatgtgggaattacaactcgggatgaaattcaggtcaatagtcaatagtcaaatagtcaatcatcaaatagtcaatcctcactataaccttatcctcatgttacatatgaagaaactgaggcccagagagcttaaggaatcagcccaagctcacagagcaaggaaggagcaaaactgaggttcaagcccaggtctgcctgactccagaacacatgttcatctccctacatcccactgtgaggtcatgatacagaagagatgattggatggactctggaaacaaagaaattagatgaaaaagaatttcagggctaggttgtggtgggtgctgagtgcccttggtggtaaatggcattggaaaagggggaaacatgatcaaaagttcctcctgcgaagaatgacataacaatagttaacatgtattaggctgatatggtttgtctctgtgttgtgtttgttctcaaacccccttataccagttattctgacattgtgcttacataatttagttaaatcttttgaaattgatgagatatgagtgagaaaaggaaggcattttttatggctgctctgaaaggactcaacagaggcaagttgtcaaaactattgtcaaatagtttaaattaaatcagataagtgtaccttcaatcagaaatataaatcatgccaataatttatcacccctgatttccagtttaggcttcttgaaaatgaatctgtacttaaagatacttgcagaaccttctgagtatagaactcctgagttttacaacttttcccaatcttttacagatatcttgctctcacctaattatatattattttcagcaacttgcctctgttgagtcctttcagagcagtcataaaaaatgccttccttttctcactcatatctcatcaatttcaaaagatttaactaaattatgtaagcacagtgtcagaataactggtataaggaggtttgagaacaaacacaacacagagccaaaccatatcagcttaatacatgttaactattgttatgtcattcttcgcaggaggaacttttgatcatgtttcccccttttccaatgccatttaccaccatcggcactcagcacccaccacaacctagccctgaagttctttttcatctaatttctttgtttctagagtccatccaatcgtctcttctgtatcatgacctcacagtgggatgtagggagatgaacgtgtgttctggagtcaggcagacctgggcttgaacctcagttttgctccttccttgctctgtgagcttgggctgattccttaagctctctgggcctcagtttcttcgtatgtaacatgaggataaggttatggtgaggattacacataggagatcatcatcctaacacctattagatgtttgagcctagcatctgtattgttcattgaatccctgctccgactagcctgccagtcctgcgcccggcaaactatccccttttctatctatttctttacatctctaggcaccctccttccaactggaaagttcccttgctccaccaccttcttttggattggtgcttcatatctgtaataatactgagagctttgttttgtacaactctttacagctttcacaattctttcgaaaactatctcaattaatttgtacaactctgggagattctccagcttggtaattattatttctatttcttaaagggaaactgaggctctgagagattgaatgactggtttgtggttataaatggggcctggagccagagtcttctggctcctggtcaccatgcctttcttccctgcaccattttgcacctgaatgactgctgctcacctgacatcaataccctttgtaatgttgcaaattgtttttccataggtgcctgtcttgtcccccgagggcagcgacatagtcttattccttccccctggccaagtgccttacaaatatctgttatttggttgatgtcattaaatgtgttaaaaatttgaattaggtcgggcgcagtggctcacgcctgtaatcccaacactgtgggaggccaaggcgggcaaatcacaaggtcaggagtttgagaccagcctggccaacatggtgaaaccccgtctctactaacaatacaaaaaattagctgggcgtggtggcggacgcctgtaatcccagctactagggaggctgaggcaagagaatcgcttgaacctgggaggcagaggttgcagtgagctgagattctgccactacactctagcccaggcaacagtacaagactccgtctcaaaaaaaaaaaaattgaattaatatgttatgttgtaaggccattgtaggaaactaacagctgtattggctaggaggttgaacttgtgtaattaaattttatttaagagagagaaccataaagataggtcccacgcttgaggtgcctgtttctctgcactcgtgcctttggactttgattccttggatctggggaatttggagttagctgctccatcctctgtgctctgcattcttgtgctataaaaaaccctgaccacagtggattgtaattaatccgcttatccatctgtttcccctgcccccagactgtgagtcccttcagggcaacaccatatccagtcctcctcagtgtccagggcccgccactgtgcttggcacataatggaagttacaagaataagccagaaaactccatctgggtccctcccctaatcccctaggattgtacatgttcccattatcttatcatacatatttcttatctcttatactgaattaaaggcaagtttcatgttttactcagttttgtagcctccctaccaaccatgaaaggaagaaactataattattgactgtctattgtgtgccagtagtgatttcaatatattatctcacttttaaataatttaatttaattctcataataggttgataaggtaggcattatcatccctgaattacaaacgagggaactgagactcagggaaataaagtaattgaatttaaccaagtttacaaagccagtaagtggtaatgctaggatttcagtccctgtctgctggctctaagaccaatgcctttcttttttgttgttgctttttgttttttaacagcacataggatactgccttagcctagcaggtgtcaggaactctgctgaaataagacttgaatttaatcacggtgaatcaaatctgtgcaagcctgttcccaactatgtcaagtgcatatactgctgccctcccatttgattgtttggatgaaatgcttctggaaacatatactgagcactaacaacacactaggcacagcactaggtgttgggctgaagtcaggctccctcaagaaacgttcagcctagtgagataacagactgtaagagtgataataaatgtgatttgtgctatggcaagacagaagacaaaagtttaggttggcttgtggtggtcttgagtaacttctgagtattttataaaggaggaatgggagttggctaagccaaacaagaggagagtacagagcaaagagcatatggtaattctgcactaaggtacagaattgcaggcaggacacgcctagaacaaggagtattttggtggagaagggcagggagagcaagagtttctgaagctgcttcactctgtgtccacatcacgaacctaaggccattactggttaccagccattgcccctacacaagtgtactttggctttgatgacggctaggactcttcacccaggaaatgagttagagaaacggctggcagcatctctatctgtctactctagggatatgagagatgaaggataaacatggggtctgcattttcccgatgtgtaggaaataatgaacaagcaattgggcaaacccgcatggtgatgtcctctgcctggggtgggccgtggctgccctcagcaggccaggaaggtgcggcctggctttacacctatgttcttgatgtggccctggagcagagggccatggggaagcgatgtgagctgtaaacagaaccaggccatgttcagaaccactttctttctttcttttttttttttttcttttttcaagagtgtttattaaaataggcagtaatggggtgaagagttctgcccactctgggccacaggatgggaaactgaaaatgttagttgggttcacccagttcaagttttcctctttgatatgcctgaaaatgttatttaacttgagactttgtttaaccaaccaaagaatggctgagaattgagccaactgtgtgatgaactaattatatgtaacttagtcaataataaatgtatatgcatctgtattcatcacatgtaaaaaacaaatccagtaaggtgctgatactatcagttccttcttcctccaggacttaaataaaatcctcaagtcaagttctgtcttgctccagcccagatcttactctgttttcccatgctgttgtgttgtgcattaattccctcccacatcccactgcagccaccatcccatgtgatcttcaccaaaccactgtggactggtcacttccacatatccaaactgtccatcacatcctttaaatatagctaacctgcctgccccttgtactgaaatgtacatagaagtcagctgaaatcaaccatgtttacttctaaggctggtccccacacatttcttttatcttttgctccttgcttacctctccagctctccactccaactgtgctctctccaatgcattcttcacactgctgtctggatgatttatctaaaattcaaatgcaattatatcactcctctgccagaacccttcagtggttctcagatcctttcaaatgacatccaaactcctgaagcatttagagcaaggccattcatgagccagcttcttcctacctccctggcatcatctcctaactttccccttgacagtttgtgacacagcaatgctgaattagttatgactctccaaacacacaatgttatttaatgtttctgagtctggtctatggctataccaccctgaatgcacccaatcttgtctgatctcagaagctaagcagggtcaagcctggttagcacttggatgggagtctgccagaacagtcctttctactctattttgccttacaaatatgatcagcctttaacgttctctcaactatccccttctctgagaccttcctagacagaacgcatctctgggctgcctctgcgtcttgttcaacatctgctgttgacctgtctgtacattcccaagacctatttgcttataggaactcagtcttatcactgaatggcacagggcctaagacagaataggtgcttagtcagtgctctttgaatcgatgtccaattacgcatcctccccatcatttaagggactcgtgtttcagccacagccatgctgataactgcctcctgattggctttcccaggtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacaggtaagacaaaaaaatcacagaatgaccaaataacagaaatgcagtcaaagcactccttagatatctttcccaggggcttgaaatttgcagtacaatgtggtggaagaaaatctatttgctgagtttgggggttttatgttaagtagaggacagacagaggcacaaatatccattttgttgtctcagattgtccctgactgcattcatgttttcttcagcctgtgctaaatgctgctgctgtggccatattgttgggatgccttgtctctagtctcctgagagtcaaagccatgaattaaggttttcttactgtgatctttgagagggtcagaggagtaatagtcaagctgtccagccaaatccccaaaataaatgtttgagtattggcacgtgctttttgcaactatgtcttgaggtacttgataaattagtcgttcgttcatcataatcattatggactgaggcatcttctgtgtcctatgctgtgtgggcccaggagcagtcccactctctaggccttcactgatacctctgtgagataagggagaaaaagtccataattcttatcaattcatttggctgacagtgccatcgtccttcatcaaaagcctaatcaggttgacaccagagagaggctaatgagagaaccttggaagaagagccacgtggctcagtggtggtttgctgcaagacatggcagtgcagctttagccatcactacccacaaaagcctgtccagcctgagagagcacatggcagcatgtcccactgcccaccaagtgctctggaggaagtaaggaaagagcaaagcatgcttgggatgtgatcattttacaacacaggtcactgagaggctgttgccctccctgtgctcctgtcccacatctcctgaaacaatgcaggaggctaagaaaacaccagggaccccatctcacagtctgcatgtgcccagaggcctgagcagcacagcagggcaagcacagctgaggcccgcagtgttccccaccatctggactccaagctgcccacagaccctaaattggaggcaacaaaggtcactctgactcctgctataaatcccctgaggaatcagtttggactagagtcgaaaaatgccccagaatgagcttatgtttcttattaatttgatttgaagtctttcctcctttcttggaaaaaaagatgtttgaccagatgttttaagagtgcatgctattcatccaagatgagctatctaactatgctctgtttctctgactctggctgccatgcctcataattggcatcactccttcagactatggcaaagtcatgcagggctctatattggtgctagtctgtctggcctatcatgggggaaccattgtttgggatcctggaggttcacattcccagttctcaagtatggaattatgcctccctgatttgtcaagctccatggtgtggaatcttgaaaaccttttgttacaaatagtagttgaaatactaaagtttgccagttaattacatcagggtcaagggcatcttcataataatgtcagtctcacttgttggctttcttgagaggtttctggaaaagaaagaatcctgcaggaatcatacataactggaactatattgtgctggtgaacattatctgacatgtcatagcaataaaaagattgaaaactcatggatgggaccccccaccaccaccactgccagcctcagaatccctcttaggaaaaagttctttggtatgttcctaatcagcatggctgtgattggcttgtattaccacacaggcaatgtctgtctgcctatcccagctggctagtgtttcagacaaacagtcgtaataataagtttaattatgggtaccgcacatgggaatgaacatatctcagtgcctgtcaccacctttcaggccccctgggtgctggatatctacttttcgcccccctcacatctaggctgaggatgctattattatcccagttttacagataaggaaaccaaggcatggtcaacagcagagaataccaggacttaaacctaagtctgtctggctccaaagcccagacagtactagacatataatctgctccgtgtaaacctgaggccacttgtttgaaacttgttgagaatctcaagatggcagtaccgtgaatttcatagcatggggtcctgtgagcctgcatgggtcacctgcccctgaagccaggcctacctgtataatttccctgtcccacacagctgccccacagagaaattcctcttgccagcctctgaatctggcctctgctaacagtgcctcaggttccccagctcctgggaaagtcagttggatagggtgatttcaggattccaaataactcatctttctaaatattgttccccgcaagcacacaattgatttatttttttgtaagtcaggtaagaaacaacattaaaataagcaagaatatgaatcctcctagaatacaaaagtgtcctctgaataaccagaaacttgtttgaaaacatctgcaaactaacacagtgttctcgggctttaatactttatatcctaccaatcactttgtcaaagaacctgagtccagccatgatgaaaataaaaagccctcttttctcaagaaagacatttatatgcttaccagcattctcttattataaacttacggctcactgcaagtttcaagggcatgaagaatcacaatagatattcttggaggtaaattttatgctaatggctttcaagcacaaatgaacaaaaatactaatcctattaatagtggaagtattaataataataacagtatattaataataatactgttgagtataaattttaatgttactataactgcaaaacaccaagaaaattaatgaaaaattacagcagaattattggcagtagtgacactagtggctggggctggggaaggccacaatgctcaccctttcgtggaaggacaaaggcaaatgtgtcctggtggccaggacacctggggactgggaattagaaatactgagctatggctagcctggcaggtcacaaatgggtaatccaaggcaggcgggggctgtaggaaatggtagatcacacttgtaggttggtgtgggagtggaaagtgagcttatgaatactcgttatgaaaacacttcatcccactaagaccatttctacttcagtaagcccatatttctggcatgtttactaagtgtctggttctctgctggatgctggcccaaagatgatgcccctttcactcggttattcaggctagaatccttgatctctccacacccaaacttgtgccttctcttttaaattcatccagttcaatctgccctcatcaccacctccctccacttatctcttgcctaaattgctgcactagcctcctgatgcccctgcctctgattctcctcctgttgcccatgctgccccagggccatctttataaaaaacaaatcagatcatgccactcccccacttaaaatgtttaatagcttctccttgaccctaagataaagtccaaattccttatcaaagcctgaataccctttatgtcctgcccttgtcttacctctccaattttatttcttgctgcaaatctaagttttgggcatacagaacctctttcagtctatgcacaagggccatgcccttcttgtctctggaccttctctcagccagacatcttccagcagccttctaactggtgaactcctattcatcccttaggacttagcttagatgttgcctcttccaggaggctttccctgattctgtactaaattgatcttgccaggtgctctcccagcactttgtccttctcctattgttagcatcatcacacttacatatttctttgatgtctctccctcactaaacaacaaggtttaaagctgccgttcccactattatatcccctgagcttggcatagtattggatgcttcctaaatgtttcttgaatatatagtttgttcattcaataactttataaatatttattgaacttattagtttattcatttggtaattttactgaacacctactatatgctaggcattggagatgcagcagtaattaagaaaactcctttccttcatgagcctacatcctaacagtggagaaaaggaaaacatgtaaaatatatatatatatatttaagtgaaaagaaaccaacaagggtggtagtgacataaagaggattaggagtagggaggggcctgttttagataaaccggtcagggaaagtctccctaacaaatgaccatgaagcagaaacccaaaagacaagtgtaggggaaaatcattttagatgctaacaacagcacatgcaaagggcctgtgggagaacataacttattgtgcttagaactaaaaaaagactagtgtgacacaaggatagtgaggggattgtggcacaaaaggaggctggagagttgaatgccggaccactttgtctctactcagacgaaattaacaaagtgggagaggcacatacatgactatttccatagaaggtacttattccttaggggaatctgtgcatccattggggaaatgtggacacacatttgggcagggccttgttgggtttcctctctgctggagtctccttttccaatccacgtctgcttctttccactattctagtccttcattagggctacttttatgtcttcaataattttaaatatgtctaattgtctctttcagattattctattttctcataatcttagagactatttttccttttcattgaacttgctctctcagtgacattagtttcttctttggttttaaattgtttgatcatcttcagtggtatttgttttgtttttttgagatggaatttcactcttgtcaccctggctggagtgcagtggtgcaatcttagctcactgcaacctccgcctcctgggttcaagcgattctcctgcctcagcctcctgagtagctgggattacaggcgcctgccatcatgcccagctaatttttgtatttttagtagagacggggttttaccatgctggtcaggctggtctcgaaatcctgacctcaggtgatccacccaccttggcctcccaaagtgctaggattacaggcgtgagccaccacacttggcctcagtagttttttttctttttcttttttttcctgttggaggaaaaaaggttcaagtgatggtgtctttacagtgactttgtattttcttctcctggtcccacccaagtttttatgtcctttctcagattggaattgcccactgcacagctagtatacgtctggaccctgcactaacacatgagagcaattgggagttccatttcttggaggtgtcttgggcagaaacaaccttccttgccatgttcccgaatgcttgatggagggttttctcatgccctattcacaaacagggcagccctttaaaacatccactgtatgcaggcgtgccccccccatgccccacttctcactggctcaagatttccccttctctccatgcatgggcttctaaacccccgcctccagctcctggggcctgtatcccagtccagggccccaacagctcaccacgcactagctcctgcttactgttctgagttagactttcctccctatttctggcatctgggcagtttttctaaacttgtttacatatttttgtaatgtgttttgttatatttgtccagcatttctatctgtttgtagaaggagagagaactttttgtgtcagttcagttttccacattttcaggtatccagctaatatctgtagcacctaacaaatatctgaattgatgacaagcaagccatgaatggttcttgcataaaactctgagctttgaagagtcacccatttattaaaaatccattagaaaaatcattccaacttttatatttctctggattcaaggctttcctgaccataagaggtcagataatggtggaccctaatacaggcattgattatttcaccttcaggagaccttgttttggaggatgacttgaaccagcccacaggattatcacaccgcctgtggcatgagaagcaatagacaagcagatgttctttttctttaaagttgaaacagtttatatggctccaggaactggaagaaaaggtttgagaattttcttttctcatctcctttaaatcattggagatgacatatgtctactaaactattgtttttttctgatttttgattttctaaatttttaatcacttttctttaattaaagccatggcctgacttcaagtgttctctatgattcatgacatgctgcctcatccggtttggaaaaaccacacacaaacacacacacaccccaccagcttttatttataataataaagctccagtgatcttccatgcttatgagaagtagtgatgtataatgtctaaaagcattgcctctgaatcaagatttcctgagttcaaatcctggctccatcccctgccaactatgtgactttgggcaagttacttaacccctctgtgtctcagttctctcttctatgagatgaaaatggcgattgtgccaacctcatagagtcattctgaggactaagtgagctgataagtgtaaagtacttggagcagagcctgcccttagaaagagattgctggatgttagctatcattaccatgttttcattcttcagcctctgtttccttatcagtaaaatgaggggtttgtcctaagaccccctgcaggactagaaaatttaatgttcaagttcgtgtcatttctcagtgtgaaaaggtccagaggatgaggccacaactcctttaccatctacttcaactacttcagcatccccaggcactgcccaagcctgcccctcctatccccacttgacagtgtcatctcccaatttgccctaacattttttcccaaagttgatcataagcaattaagggtataaattaagccttcaaatatagaaagagctacagtaaaactccacgcccattcccaactcactgctttgcacatgctccctcccttccttggaacagcctcatcaggatgctcgctggagctagttcgatgccacctccagaacagccctagaggcagccatggagcacatcttcctgaatgtagcaagacacaagccaaggggcagaaatgtggctcccaacctaaggagagaggtggtttagtgaagtctagtttgattgtaacaggaacccactgaaactaacttaagaacaaaggaaactttattgtagaaagaaagtaggacacatgagaacacaagtttgtgcagagtacaaaaaccctcacgaaagctggaattggaaggcatcaggctgagacgaccactaactctctctccctcctccacactgcccccagtgtcaggtggtcttttccatgcccttccatgcaaatctctccccgactatttctcaacagagctgctgcctctgcttacttgggttgcacatggccccaaatggtagccataggatcttcctccttggcttctcacagctagctgagcagttttggtgactcttagtgaagcaccagaaaaacaggttgatcactggatagcctgggcaatggtgccccctgcatcagatatctacccttactccaatccagtggccacctctgtgtaaagaaccatccggcctgttattatatccagtggctgtgggcagggcagtttatactaagaagggaactgaaggcctgggtgtggtggctcatgcctgtaatcccagtattttgggaggctgaggtgggcagatcacttgagctcaggagttcaagaccagcctgggcaacacagtgagcccttatctctacaagaaataccaaaaattagccaggcatggaggtgcacgtctgtagtcccagcagttgggggactgaggtggaaggatcacttggcccaggaggcagaggctttagtgagccacgatcacaccactgcactccagcctgggcgacagagtcagaccctgtttccaaaaaaaaaaaaagggcaggggaaactgaaggtagaagataaatttatatttcagggcagcagtggatgggcaagaattagactgagttgcagggccctagccaaaggacaggagctcagggcaggatttcagtcctgtagaagagaggggcactgaagagagaagaagttcaggagcactaaagaaagaagagggaagatcagcagaaacccagagttcagagctgcaccaattgggtgacaaaatgctgggtctagagtttggtttagcaattgaggtgggatcaagggacattactaggcctaaacacaaggatatggaaaggcagaggtcagagaaagagtatggggccccaaagcactgttaaggccacttatttacccttgccacctgctgccttgcattgttacttaagaaccatgaaaacagtagagaacctgtacttcttaagtctctgacctcgagtaggtcacctaagctcactgagccttagattttacatttgaaaaacaataacaagaatatgaattacctctgttggttatgaaataatacgtgtacaaagcatggcttggagtatgagctcattattactcttattattgcaacaaaaaaattaaattggaaggacttagaacccttttttccttccatcttctaaaagggtatttcggttttactgggtgggaatacaatggaaagaagacataaattgggctaggtagaatctactagagcataaagacaaggaaaagggagaaagaaagatccaaagaagacttttagaccaggcgtggtggctcacacctgtaatcccagcattttgggaggccaaggcaggcagatcacttgagttcaggagttcgagaccaatctggccaacatggtgaaaccctgtctctactaaaaatacaaaaattagccaggcgtggcggcaggcacctgtaatcccagctactcaggaggctgaggcaggagaatcacttgaacctgggaggcagaggttgcagtgagctgagattgtgccactgcactctagcctgggtgaccgagtgagtgagactccatctccaataataataataataataataataataataataatgaaaaataaaaagtaaaaacccaaagaagactttgagtaaatttgatttctaaaagaggaaacttcaaaagagaacttttagcagtatactttgcagaatattgtgtgatgtcattttccctttgctgccttctcaagaaaacttcagcaaagacctctaatactttttcaaggcttctgggagtcagattgggtctgtttttttaggtgtgtcaccctgctgcaaatggcccccaagggtgcccaaccttatttgggttacattgatgacacacacctcctttgttctcccctacctcattcaaggcttaattccatgtagtatgggtaagtgggcacttgtggttggtagaaataaaatgacactcagagtggtgatagggtaaggagtcaaataaagattctgtcacagatactcgatacagaaattaagacattgtttgaaaggtatgatttgagtcatatgaaacctcttgtttgctttcagttgagtcttcaaacaaatccagattacagtaggacaagctgccagagtgatttcgtgatgcctgttctttaataaaactggcacaggctgcctttgctggaagggtatagagctggcctcttagcattacttcttaacctctacagttttataagacagcatcatgatccctgggaatttttctgagaatctctgtatgagagaaatgtgggacagtcttattcaagacttacagaatatttgactcactaaaatatctatttttacagtaactgagccaaaatattgcaaatagaaggcaaatttaagtgagagatcattaatatattaccttaagatttagaagacaatttagcaatatctatcaaaattatacgttttcttttttctattgtagtaaaagaaaacacataatatttaccatctgaaccatttttaagtgcacagttcaggagtgttaggtatattcacattgttgtgtgtatattttccttatacatcaacataataaaataattctatatctaggaatatgtctttctgaaatagtcttgtgcaaaagtatatgaggaagaatattcattatagtattttatttttaagagatggaacaagcaaactttcatcaataggggtcatattagaaactctggatgcatttaacgggtcaaataccatgcagctattaaaaagaataaggcagatttgtgtgtactgatacagaatgctccctggtgtatatagttagatgggaaaaaagcagaacagtgtgtatagcttgattccatatatgaaaaatggcaggttagagtgaaatgattatattcatgtataggattatatatgcatagaatatctctatgaacatacaccagaaactccttgcctctagagcacacagagagtaaggggcagaactgaaaggttcattcacattttgccatacggcctcttgtattgcttgaattttaccatgaacacaaattactatactttttttttttttttttgagacagagtctctgtctgttgcccaggctggagtgcagtggcaccgtgttggctcactgcaacctccatctctcaggttcaagcaattctcctgcctcagcttcccgagtagctgggattacaggtgcccaccaccatgcccggctaatttttacatttttagtagagacggggtttcaccatgttggccaggctggtctcgaactcctgacctcaggtgatccacctgccttggcctcccaaagttctgggattacaggcgtgagccaccacacctggcctactgtacctttttaaaagaataatatttaaatgaacaaagaaaacttggataagaaaccaaatattccccccaaaaaaaatactgcataacttaatctgtaaatttaaagtgttccctcaaaaatcccagataattttttaaaaattatacaggctgacgctatagaaatagaaaactaaacagtcaacaatagtcagaaaatgtttgaaaaagcatataatgaagggaagactggctaaaccagatataaaaacgttataaaacaacattaactaaaactgtgtgaagctagagagtgaatacacagatcaatagaatctaatagaaagtccagaaatagacacaaattctttgtaagttaagtatatgaaaaaagtataattttatatcagttggaaaaacactagatccttcaataagtggtaatggcacaactggaagccatctggaaaaaatatttttcttcataccttaatcctggaaccaatacaagctccaaatatatcaaaaatttaaatatttttaaatgaaaacataaaaacgttagaagaaaacatgaaagaaccttttttttttttttttttttttttttttttgagacggagtcttgctctgttgcccaggctggagtgcagtggtgcgatcttggctcactgcagcctccacctcccgggttcaagcaattctcctgtctcagcctcctgagtagccgggactataggcacctgccaccatgcctggctaatttttgtatttttttttagtagagacagggtttcaccttgttggtcaggctggtctcaaactcctgacctcaggtgatccacctgccttggcctcccaaagtgctgggattacaggcgtgagtcactgcgcctggctggaaccatttttataacctagaacaaagcttcttccaagcacatcacaaaacccggagatcataaaaggttaatgaagtaaactaaaaacatttctttttttgagatggagtctcactctattgcccaggctagagtgcagtggcacaaacttggctcactgcaacctctgcctccaagtttcaagtgattctcctgcttcagcctcccaagtagcttggattacaggcacccaccaccagcctggctaatttttatagttttagtagagatgggctttcaccatgttggccaggctggtctcgaactcccgaactcaactgatctgcctgccttggcctcccaaagtgctggtattataggcatgagccaccacggctggcccaaaacattttttaagtagtggaaaatactaagactttttttttttttgagaggagtctcgctaaacaaagggctaatttttttttgatatataaagagcttcttatggtcagtttttaaaagaccaacaaaccaatagatcaaaacacatggacaggtctcagaaaaggaaaatgagatggcttttagatattataaatgatgttcaacttcatttacaatcatagaaatacaaattagtttcacagagctacaatttttgatctgttagacttttgacaactatattgtcagaggtgtagggaaacacctttctacactggagagcgctttcttctgactcagcagttcagtcagaaatttatatacacagatatactcacatttaggcacattctatttattggacattgtaacacaagagtggaataaattaaatatccatgaataggggaccagttaaataaatatgagattttgatattaaacatttccaagacaaattgtttcattaaaaaagaaaatgcagcagggtactcatgattggtcccatttgtgctatctttctaaagatgtgtacttacgtctcttgaagggtatataagaatattaatagtggttgcctctggggtggagagttaagagattgcggaaaacgaagagagggacctttcactgtattccctttggtgcctttggaatgtggtaccatgtttttgtgctatctattcaaaaagtaattattttatagttgaaataaaaaaaaataagccaaccaaccaacaaacacccaagcttaggaacatttaaacgatgctgtatctgaaagcacattgtggggtcttggtagatcgttctcctcctggtgaccaagagagctacagtccacctgttattttaggtgagaaaactgaggctcagaaaatatacttcacatgtccaaatgctagtggcaacacaggacttttgacttccctcctggtacttttttctgtctctgctaaaagagaagagacataggcagccctgaaaacgtcactctggtgtatgtactcctccagtgtactgaaacatttacttttcaccagattgtgtctctgagacagtttagagctggacttttcaatgaatacttgccatctagtggtaaaaaaagatgtgtgcacctaacatagactgcattcattcattcattcatgcatcaaacaccatacagtcatgcactgcataacatttcagtcaacgacagactgcatccatgacagtggtcccttaagattataatggagctaaaaattcccattgcctagtattcactatactgtaatttctatcattattttagagggtactcctacttattttttttaagttagctataaaacagcctcaggcaagtccttcacaggtattccaaaggaaggcattgttatcctagaagctgaaagtgatgagttactgcccccgaggaccttccagtgggacaaggtgtggaagtagaagtcaatgatgttgatgatcctgaccctgtaaaggcttaagcacattttttaaaatgtgtgtgtttacatcttagcttttaacaaaaaagtttaaaaagttaaaaaaagaattaaaaaggcctgtagaataaggatataaagaatgaaaacattcttgtacaacatgcactgtgttgttgttttaagctaagtattattacagtcgttaaaaaggtaaaaaaaagtgtataaagtaaaaagttagaataagctaaggttaatttattattgaagaaaagtgtttttataaatttagtgtagcctaagtgtacagtgtttattaagtctacagtagtgtgcagtaatgtcctaggccttcacattcactcaccactcactgactgacacagagtaacttccagtcctgcaagctccatacaggtgtaccatttgttatcttttataccttattttaatggtaccttgatatgtttaaatatacaaatacttaccattgcattacaattgcctatggtattcagtacagccacatgctgtacaggtttatagcctaaaaacaataggctataccatatagcctaggtgtgtagtaggctagaccctccaagtttgtgtaagtaccctctatgatgtttgcacaatgaagaaattgcctaatgacacatttctcagagcatatccccgttgttaagtgaggcatgactgggaaatcacttgtccttaaggcactcctagtctcttgggaaagactgacagaaaaacaggtgattacaccagtatgatgaagagacaactgcactcccatgtttattgcggcattattcacaatagccaagatatggaatcaacataagtgtccatcaacaaatcaatgaataaagaaaaattggtgtatatacacaatagaatactatctagccataaaaaagaatgaaatgccatcatttgaggcaatgtagatgagcttggttgacattttgttaagtgataataagccaggcatggaaagataaatatcacatgctctcactcatatgtgggagctgaaaaagttgatctcataatagtggagtgtggaatagtggttactggagactgggagtcaggggatggtgagaggttagttaacggatgcaagattgcaactagatagaaggaataagttccaatgtcactggagcatgactgtaattaacaacaatctacagtatgttttcaaatatagctagaagagcagattttgaatgttctcaacgcaaagaaacaataaatgaggtgatatgcatgcaaattaccctttgattattttacattgtgtacatgtatcaaaatatcacactataccctgtaaatatgtacaaaactatgtgtcaactaaaaataataataaaagataaaagaatagaaaaatggggaacaaaaagacccatggtgagcgtgaaactaaaaaaatagaatagaaaatgtctcattaatgttttcgttatattgattacctgctgaaatggtaatcatttgtgaaaaagaaaaataggtgattccactacagtgcaactaaggctaggaaagtcaagtacaggacacagggagcacagtgtagggcttaaccttgccttgggaaattgcaggtatcaggagcaacactgaactcacttttctggattctcagtagatgctaaaattacctcctttcttgtcttcctcttgctggaccccatcaggaccaggatagcagtttttgttgttacgttctctgtgtctgaggatggactcattaactgatcatgttaggaaggcagccagtgtatgccctttggctacatggagtagctgttccaagagctgaatccgtgccaccgttgcatctggtctgcagatctgttttccaaagagccatatgcgaatgcattgttcatttcccacctctggtcagaacatctgtggaatgtccctcctgcccatgtagtttttcagctctgttatcctgaagctctttcaaaggttagcctttcattctccaagcaaacaagttcttgtagcccatagaagatgtcctccatagaaaccaaagcagtccacccagcttgcctagaatgaaaggtgcctaaagtggtagggggtggacctgcaaagaaaggtggagtcctttcataaatgaacttaaataccaggctggagagatgcagagattacaagtagacctaaagtaattaggaagccattgagggtttctgagcaaggaagcgaccagagaccaacgtatttgttcattcaacaaataattgtcaacatctactgtgtgcaaagctctgagtgagaccctgtgctacagaccccagcacagagatgaataagacccagggtgggagacatgtcatcctcctgggttataatgccttctacctccatgcaacagcttaaattttttgtctcagagaaggaaagaaatgtcagagcataagaaattagtgacagaaattataaactataaatcacagttctaattgttctataatcatgtaaacatagcaatttttctttaacatagaaatatacaaatcaaagataaaacaggagccccatctcatggagagatagtctgctgcctcttcagattctacctcaacattataacatgtccttttgacactgtggagccaataaggtttccatccctagaagacctttctctcccaatctgtatccatcagaattccactcaaccttccataccctccttgccagaatacctttccaactccttccaaatgcatgtcatttctgcctccttggatcttccagaccatattgtaaccccatttggcccagttcctgccttgtattatgggtgtctgctcctaaaaacaaaagtaggagtcagtctgagctggggtgtagtctggaatcacccctccatctccctagtcatgcttttcatatgtctcatagtacattgagaagtgtctgttgaattgagttgaatgctttagacctcggttcactgacagagggactcctttagcaaagttagccattttacctcctttgtctccatagctacttccagttctccaaactacaacctatttcccaacagactccagttacagtacttcttaatttatcttctattcaaaggcaaaactactgcttcattaatcaatgagtaaggaaaatcaaaagcttattaactagcaagccaatgctcttctaaagggcattgatccatgtatgttatgggcagcctgttcattgatagctacagctcttggagagcagctctctggagtagcattggggaaactgaaatcttattttgaaatagcttttaaatgcatggaaacacatctgattcttactgggaatttcttgatagggaatacagaagggaagactatttgcttgtcagtaatatgatatagagacaaatcatttcataggatttcataagtgcatatatgtaaccaagaaacacaggtactttcatattatcttgagaaaaatgaattcattctttaaaatgcaatgacttccctgcataatgcattcaagaatcaatgcaaatataaaggatgtgtttattggcttgtgatctgtattcatgactgcaagcatggttggatcttttgagatgggggtttcctctgtttcagtggccaagggatattctttctcaaatggacatggtgatcatttgaaacttatcccatgcatagtgaccccaaattcgagtaaatatatatcaagtacatataatacacaaagaagtgagtctgaagtcaacctccaagcactccaaattagggccctaagacaactgcagaatttgttgcagggcagatgtatggcctggtttagaactttattattttgacctccattcgcatgttagttttacttcttcttctatcttcaatcttttacaacatacatcctttacttattagattctaatatattagcatttaacatacttttactatttcttggacaatggaaaaaccttagaacactgtaattccctttagcccatgtattagtctgctctcacattgctataaagaactacctgagacttggtaacttataaagaaaataggtttaattggctcatggttccacaggctgtaaaggaaacatggctgtggagacctcaggaagcttgcaatcatggcagaaggtgaaggggaagccagcatgtcctataaggctggagcaggaggaagagagcagggagggccacacacttttaaacaaccaaatctctgagcactcactcactatcacaaggacagcaagaggaaagtccacccaatgattcaatcacctcccaccagaccccttctccaacactgaggattacaattcaacatgagattcatgtggggacacagagccaaaccatatcattctgcccctggccccttcgaaatctcatgtccttctcacatttcaaaacacagtcatgccttcccaacagtctcccaaagtcttaactcattccagattaattcaaatgcccaaatcccaagtctcatctgagacaaggcaagtccattctgcctatgagtgtgtaaaataaaaaaacaagttagctacttccaagatacaatgagggtaaaggcattgggtaaatgcttctgttccaaaagggataaattggcaaaaaataaaggggttacaggcgctatgcaagtttgaaacccaacagggcagtcattaaatctcaaagctccaaaataatctccttagactccatgtctcacatccaggccatactgatgcaaatgatgggctctcaaggccttgggcagctccacttctgtggctatgcagggtatagcccctgcagctgttttcacagactggcatcaagtgcctgcagcttttccaggcacatggtgcaagctgttggtagatctaccattctggggtctggagaatggtgaccctcttctcacagctccactaggcagtgccccagtaaggatactgtgtgggggctccaaccccacatttcccctctgcactgtcatagtagaggttctccatgagggctccatccctgcagcagacttctgccatgacatacaggtgtttccatacatcctctggaatatatgtcagcctcaacttttgccacctgcacactcacaggcttaacactgtgtggaagccttggtggcttccagcttgcaccctctggagctgtgacctgagacatatcttggccccgcttagccatggctggagctagagaggctaggatgcagggcatcatgtcccagggctgcacaaggcagtgggaccctgtgcctggcccacaaaaccatttttccctcttgggactctgggcctgtgatgggacaggctgctgtgaaggtttctgaaatgccttacaggcatttttcccattgtcttggctactaacatttggcttctctttacttaggcaaatttctgcagcaggcttgaattcttccccagaaaatgggtttttcttttctaccacatggccaggctgcaagttttccaaacttttatgctgtacttcccttttaagtataagttttagtgtcaggtcatttctttgtttatgcaggttagtgtaggcttttagaagcagccaggccacatcttggatgctttgctacttagaaatttctaaatttctaagataaaatttctaaattttagataccctaaatcatcactcttaagttcaaagttccacagatctctagagcagggacacaatgccgccagtctctttgctaaggcatagcaagagtgccctttactccagttcccagtaagttcctcatctccatctgagaccttagcctgggcttcactgtccatatcacttcagcttttggtcacaacaatttgacaagtctctggaaagttccaaactttccctcatcttcctatcttcttctaagccctccaaattgttccaacctctgcccattacccagttccaaagtcacttacacattttcaagtatctttgtcgcaatgccccactccaggtaccaattttctgtattagtccattctcacattgctataaagaactgtctgagactgggtaatttacaaagaaaagaggtttcattggctcacagttccacaggctatacaggaagcatggctgggaaggcctcaggaaatatacaatcatggcggcaggtgaaggggaaactgacatgtcctacatggctggagcaggaggaaggcaggggaggtgccacacacatctatttttttatttatttttattttattattattatactttaagttttagggtacatgtgcacaatgtgcagtttagttacatatgtatacatgtgccatgctggtgcgctgcacccactaactcgtcctctagcattaggtatatctcctaaagctatccctccccactccccctaccccacaacagtccccagagtgtgatgttccccttcctgtgtccatgtgttctcattgttcaattcccacctatgagtgagaatatgtggtgtttggttttttgttcttgcgatagtttactgagaataatgatttccaatttcatccatgtccctcaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctaggccaaatggtatttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatagtatctcattgtggttttgatttgcatttctctgatggccgtgatggtgagcatttttttcatgtgttttttggctgcataaatgtcttcttttgagaagtgtctgttcatgtccttcgcccacttgttgatggggttgtttgtttttttcttgtaactttgtttgagttcattgtagattctggatattagccctttgtcagatgagtaggttgcaaaaattttctcccattctgtaggttgcctgttcactctgatggtagtttcttttgctctgcagaagctcttgagtttaattagatcccatttgtcaattttggcttttgttgccattgcttttggtgttttagacatgaagtccttgcccatgcctatctcctgaatggtattgcctaggttttcttctagggtttttatggttttaggtctaacatgtaagtctttaatccatcttgaagtaatttttgtctaaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccactgatgccacacacttttaaacaaccaaatctctgagcactcactcactattacaagaacagcaaggggaagtctgcccccatgattcaatcacctctgaccagaccccttctccaacattgaagattacaattcaacatgagatttggtcgaggacggagagccaaactatatcaatccactaccatcttaagtattattgttaccaaataattaaatttcatatatattttaaccctacaacacattattagtattgctttgcccagtcaaaattcatttggctttacccatatatttattctttctgttgttcttcctttttttatgtccattttccttctgggatgatttccttctacctgaaaaactccttcagcattttttagaatttgcaggcaaagaattctcagttcttatttatctgaaaatgtctttattttgtctttatttttgaagagtatttttaaataagttgccacttattttcattcagtatttttaaggcatcacttgtctgtctgtggctttcatgatttctgttgagaagtcatctgtcagtcttatggttgcttgttagaaaataacatgtctttttacatagctgcttttaagattttgtctttatctctgattgtcagtagttttactacataggtaggcatgactttatttatatttattgtttttgagatttctagcacttcatgcatccatgtcttggtatcttttgtcagttttggaaaattctggcccttatttcttcaaacattggttctatcccaatattctttctcctttccttctggaactttaattatatatatgttcaactttatcatcattttccatatgcttcttatgctttttttgtatattatttatcattttccctccatactttagcgtggatatttcctagtcctctcctctgctagtctgaaatgctattaaacttgttcttaattctagttatatttattaatattagttctagaattttcatttgattcttttttttagaaattccagtttgttgctaaaattctccatctagatttctatttccttgaacatattaattatagtttttaagtccaagtctggtaactataatatctagatcatttgtaggtctatttctattatttgtttttcccttgcttcagtttcttggtatgtctcatcattttctattgaatgccagacatgtgtatgataaattataggggctctggatgacattatcttccttcacaaagatttgcttcttctagcaggcagttggagtatggaaaatcacctaatcaggccttgggttgggttgtttttaagctggattctgtctttgtgagggctcttttacttatggttcactcttattccatgggtgtagctcttcagggttcctcacttaaagcctgtagtgcttaccagtgtgtctcttccttatggtttccaatttccaattttaatcttccccaaatctgaggctgctaaaagctctgtttaatctcttagccactaatttctacccagagttgcaaacttccttcaccatgactcttacaaattagcaactgcctcagaagaaacagcagtgccaaacatcaggctcacttctctgtccctttctcttcagggacttgatcttagctcaagtcattttctctccccagtcttatgagactgatgaaagctgtactcagcttctcagcctcttagccttgtgtggctgatgaaaaagccagagcctgaagggaaaaaagcagtttggaatatctgactcacctccatgcatttcccttctctccaggatcttggccttcaagtcctggctgcattgagacctttccaatactttaaaccaagttactttgttttgttttattcattttttgtagttgttcttgggagattgttggcctcatataagctcgcttatcagtgttgcaggtgaaactagtatctcttctttaagtacttgggttctgtctctcctacatgcaagtctttctcttgcatctttctgatttgtgtctctaacccaatctcacttgctggtatcagttctaatatgctaggtgtggagaactgtacgtctgtctgcaattgttcaaatctttcctcttaagtaatatctcttactttgtttctattcttaatttatattgggaaatataatattacatcaagtgtgacttccttcaatgtgagtgccttggtaaaactctgcaactcttaggactgaagaaaaaaacctctatggatttaacataattaattacttatagtaattagtaagactctaattgattattacctctaagatgtcatgaattgatgccacttttttctgttttttgagttattagatgtgaaacagtcattattaaaaatttttttgatgcctttggaaagaaattacgggaaaggtgctcaacatcatgatcatcagagaaatgcaaatcaaaactgcaatgagctattatctcaccccagttaaaatggcttatatctaaaagacaggcaataaaaaatactgttgaggatgtggagaaaagggaaccctcatacactgttggtgggaatgcaaattagtacaagaactatggagaataatagtttggaggttccttaaaaaactgaaaatagggatactatatgattcagcaatcccactgctgggtatagatccaaaagaaaggaaatcagtatatcaaagagatatctgcactcccatatttgttgcagcactgttcacaatagccgcaatttggaaatgaccaaagtgtccatcaacagatgaatggataaagaaaatgtgatatatatacacaatggagtactattcagccataagaagaatgagatccagtcatctgcgacaacatggatggaactggatatcattatgttaagtgaaataagtcaggcacagaaagacaaacatcacatgttctcacttatttatgagatctaaaaatcaaaacaattgaactcctggacttagagattagaaggataatttccagaggctgggaagggtagtggggggtgggaggtgggggggatggggatggttaaccggtacaaaaacatagtgagaacgaatgagtacaacctatttgatagcataataggtgaatatagtcaataataacttaattgtacatttttaaataacttaaagagtataattggattgtttgtaactcaaaggataaatgcttgagggaatggatactccaatccccataatgtgcttattacacattgcatggatgacccaaatcatctcatgtacctcataaatatatacacccacaaaatttttttaaattttttttaaaaagaaaagaactatagatactccttgacttacagtgaggttacatcctgataaactcaggatgttttatcagttacaactgaaaaaagttgaaaatatcactaagtcaaaaatacacttaatatacctaagctactgaacattatagctcagcctaacctaccatatatgtgctcagaacacttacattatttttatatatatatttatatatatatatttatatatatatatttatatatatatttatatatatatttatatatatatatttatatatatatttatatatatatatttacatatatatatttatatatatatttacatatatatatttatatatatatttatatatatatttatatatatatttatatatatatttacatatatatatttatatatatttatatatatttatatatatatttatatatatttacatatatttatatatttatatatatatttacatatatttatatatatatttatatatttatatatatttatatatatttatatatttatatatatttaatttatatatatttatatatatttatatatttatatatatttttatatatatttatatatttttatatatatttttatatatattttatatatatttatatatttatatatttatatatatttatatatttttatatttttatatatttatatatatttatatatttatatatatatttatatatttatatatttatatatatatttatatatttatatatatttatatatatttttatatatttatatatatttttatatatttatatatttatatatctatatatatttatatatatctatatatttatatatatttatatatatctataatttttatatatttatatatatctatatattttatatatatctatatatctatatattttatatatatctatatatctatatattttatatatatctatatatctatatatttatatatctatatatatttatatatttatatatatctatatatatttatatatttatatatctatatatttatatatttatatatctgtatatctatatatatttatatatttatatatatatttttttatatctatatatttatatatatataagatggagtcttgctctgtcactcaggctggagtgcagtggtgcaatcttggctcactgcaaactccacctcccaggttcaagtgattctcttgccttagcctcccaagtagctgggactacaggtgcacaccatcacacccagataatttttatatttttagtagagacgggctttccgcgtgttgtccaggctggtctcaaactcctgacctcaggtgatccacccacctcggcctcccagtgtgccgggattacaggcatgagccactgcatccagctagagcacttacattaacccaaagttgggcaaaattatcaaacacaaagcctattttgaaataactgttgaatatctcatatagtttattgaatactatattgaaagtaaaaaatagagtggttgtatgtgtactcgaagtacagtttccactgaatgggtattgcttttataccatcataaagtcaaaaattataagttgaaccatcataagatggggactatctgtatattaaaataatgaaggttttccacaccaggtgtggtggctcatgcctgtaatcccagcactttgggaggccaaggtggggcagatcacttgaggtcaggagttcgagaccagcctggctaacatggcaaaaccccatctctactaaaaatatacaaaaaaaatggctgggcatggtggcaagcgcctgtaatcccagctactcgggaggctgaggcatgagaatcacttgaacccgggaggcagaggttgcagcgagctgagatagtgccactgcacactagcctggtcagaaaagcaagactctgtctcaaaaaaaaaaaaaaaagacaaaataatgaaggttttcttaaaatataaaatgaaatatgaacactaacccatgtatattacacatatatgtagagagaggggggaaacactaaccaatgtatatataggaatgtctagtttggtagatgccctccattccaattcaaatgagagcagaagttgattactataacctaaagaagaatgtgttaaagcagggaatttaaaaattaatacatggatatgtcaaatagtttaacttaaatcagataagtgtaccttcaatcagaaatataaatcatgccaataatttatcacccctgatttccagtttaggcttcttgaaaatgaatctgtacttaaagatacttgcagaaccatctgagtatagaactcctgagttttacaacttttcccaatcttttacagatatcttgctctcacctaattatacattattttcagcaacttgcctctgttgagtcctttcagagcagtcataaaaaatgccttccttttctcactcatatctcatcaatttcaaaagattttaccaaattatgtaagcacaatgtcagaataactggtataaggaggtttgagaacaaacacaacttactcttggtaaacatgcaagtttactgcagaagcagaagcgtgctgccacagcggagagtgggcacccagctgaatcatccggatgccctagctctgtcagtgtttataatactacagagggaatggcaagcatcggctggtcctgcaaagaggttaagtgttggctagtcaagagagcttctgcaatacagttattttgagtatagttattttgcttaatcttgggttgaatctacatctttttgaagtcaccttccttgtcaccactcatcttatcctcacattcactggcatgatttcagaatgattggagatagcttcttccaatctaaatatcacagattgcctaagtttaataataacagtgcactttttgtgtgttaacaaataccagacttctaaacactttacatgaatgtcattgaatctttagaaccctaagaagtagggctattattatccacattttgtacttgaggaaatggaggctcaaaggaatgaaatggcttgcacataggctcatagaaagtaatgataagtgcaaaattcaagtccaggtcatgagcatctacaacttacatgtgtaccacacactaagtgcatcccttgtcatagaacttgggggctggtggtgggctcccgcctgtcaggctggggccagctccccaccctgccattctccttttatttctccagtcagcctccctaaactcagcccactttgccttctttcaggaagtgattacttcttatagccccccagattctccccccatacctggcaaagggctgggttcaggcatcctccattccctctttcactgactctgaggatatttgtttgagctccttgtgatttcagaattttactgtcatcactatggagacatggggtgagagaaatacacatgcagaaaaatgacaaaggcttcagaaacttactacattcttggattctggttcctgagctaccattcttcatgcccgtgctgtggtgggaaccaaatgctcccatggactgctgtcctccatattgattcctgagagaaaggctctccaattccctcccccgctttagcaacagccctggttacccccacacccataaaggctactttgcccagcacagttgtccccttgtttatagtggagacttgtgctctaaagcccttcaaactgggaagcattcaattctggcccccacatacagcagcagtaatgacccctctgggcattacctgatggtcactatttagaactaagtatcatgacttctggaaaaactgttaaaatgccaagtatttttgcctggcacaaatcaggttgagtggccaaggcaaaagagccacagcttcagccaccgttaaccgttaaaggtgaaaagaaattcgtttatccacatagcctatatccaagatggttttactggctgtgctgaaatggcagaaactcacgggaagtccatggataaatttaaatttccactatccagtgcatctaacatgtatcccagtatcaatcctcccactccttttaatatcaggataccagttgtcagctggatacatggccacccagaataatacatttcccagcttctcttgagatagccatagttatgaaactaagttctgaccaataaggtgtaagaaaaataatgtgtgcaatttcctgaaagagtacttaaccagagggagcatgcccctctttgtcttctggactgtccacctacaaacttttttacataagacaaaaataaacccgttctaagctacgatatttgaggtttctcagttatatgcagtcaaacctaatcctaactgggttaaccacccaagaagttcatcttgcccactgcctagatagccgattcatcacgacaggggcattgcaatagagaaagagtaatttatgcagagttggccatgcaggagaccggagttttattatcacttaaatcagcctcccctagcagtcagggagcagagattttaaggataacttggtgggtggggggaagctagtgagccaggagtgctgattggtcagagatgaaatcacaggaagtcagagctgtcttcttgtgctgagtcagttcctgggtgggggccacaagatcaatgagccagtttattgatctgggtggggccagctggtccatcaagtgcatggtctgcaaaatatctcaagcactgatcttaagagcagtttagggagggtcagaaacttgtagcctccagctgcatgactcctaaaccataatttctaatcttgtggctaatgttagtcctacaaaggcaatctagtccccaggcaagaaggagacctgctttgacaaagggctgttaccatcttcctttaaactataaactaagtttctcccaaagttagttcagcctacacccaggaatgaacaaggacagcttggaggttagaagcaagatggagttagttaagttagatctgtttcactgtctcaatatgattttgcaaaggtgatttcaatccctccttttgggtttttataacaccttgatcttaaggtgtaggctatgaggatgggaaaaggccgtcgatcactctggcttctttctgctgacaggagatgtagtgggaatgggagtgacccccaaggtgagaagagtagaaccactttgcaattgtctgagtgtactcatgcaggcctggctgggttttcaaggcttgcatggcaaaaaacattagtactctcatctatagttttactacagtgtttaaagtgaccagcctactataaggtaaataacgagtccgaggatgaggagtacaattcccaattttaaaagcaaagatctgaaagcattagtttggggacttctaacccacaaagaatttagaatttagtctaaactgcagaaaaaacctcaagaacagctaacaacagtgtactatagcttttcttttgaagcataatttttctgtctccagtccccatttttattcaaaacaaatcatgatagaactgacttgtttacaaaataaactttactcttactgtacttggcctgattattggcaaaaagtgcagcaagaataattatttttcacttaggctttttaaactggctttgatagaactctgctctatgaagactctcagataagactttttaaaaggtgagcccaggcatgggtttgtatcctcaaatacctatgagttgggcaaattcctcttctcttaaggtcccaagataacttggggttcctgggcctgttagaaagtggcattctttaactttccacaggtcaggaacctggtacagggactctgtgtacacaaggtatgaggccagattccccaatggactttaattggctctataagtcaactttgattctttaaaagaagcatgccattccagtcaaagccttggtaaaataaccagtttatccaattgtgtcctgttacaaaaggaaagagattcttactgtgcttatacaattaactatactataatgccataaattgagaatattcacaaatagtttccgaattctggagaaatcaggtagaaaagaacaaatatgatccaaattttgttcacaagagtatattttactcacttgttaaaagttgcaaatagctctaaagaaattagtcctcttgtctctgaaaacaaaaggtttagcaatgtttaacacattagctctccatgagagtcctagaagtttggctttttcatgtactccaatagcacaatttttaaagttatctgagtcctgcacttaagagtcctatatctgatcataaactgccttttgaaaaggaccaaaacaagacaaaatgtctgtggatgacaaaagtctatagccactattaaagctacaattgactaggaatttgggttacttctgtggcataaaacaattttatataacaattacaattaataatgtacactaaattatactaacattatagaagtttcccataattttggaacacatactcataacatttatacaaacacagtccaaagtaaaccaaacagcatttactcttctatttgaaactttttcttctaatctcacaatctccagcattattcatcagaatcctgcatttaagagcaccttaaatagctcattataaaaccatcttttaaagaggaccgaaacaagacaaatgtctgtagatgacaaaaatattttagggcagccacagttaaagacacaattgacaaggaaatttttacctccatggcacacagtctgttaccaaaataattataatactgataacatatattaagtcatattacaattataggagttttacataattttggaacatataccaataacacatttacataaatatagaccaaagaaagccaaacaccatttcatatttgatgatgcttcctgtataatttttgtaccaaataagccaaatgtcattactggactttagaggacctaacatctaaaatattaggctagaaagagacataatttataatttttttttggaaagttgtcagatatcaaaggtttaaaacactggatatcacaaaatagaatcacaggtcatcataagtcattcatttggccaaaatgataactccaaaatcttaaaagaaaaatctttactcagataggaaacttagccaataaagatagcatgaggccagctgaatttgtctcttctctctcctcccctttttttccctgccatttacccaaaggagaaaacaaaaccattttcattatcttttaacattacttaaaaatcgtcttcaaaaaaggaaaccaaatttcatgtttgcattacagcatctttaatgttaaagctagttatttaaataaaattttatatttctatccagttttaattaatttggccataaggtaagattttcattaactttttagaacactttacaattttccatcaaatagcagattaattttctaagaaaaccctgttacttggacacatgggcccagattctggtcccacatcagtatgattttaatgtgttaacctgtggaaaaaacctaaataatttctcttaaatcttagccaccttgtttatacccacagaattttttcataaaattaaccaaacccttttcactttgcttaagacttcagttttgtcccattactcttttaggttaagacaatctataaaatcctctgaactggacaaaattacattctctttaacaaaatccatattcctatgccttcttataatcttttaccaaaaacaccttccctatacaccttgtacgtaaaactgtttctccagtggtctcaactacatattatactgttaactcttactccttttagcatagctagtaggcatggctctccatatgttcccaggccttatttataacctaatgctccaaagtaggtaaattgaacaattttcaaaagtcaaacagtttgaccttaaagcatttagcaaatctgatatctgaccttaatttagaccaaatgtctacattttcaagacattttattttaccaataatccttaaaactgtctttatttccaaaagattactaaagtcacgtgaacaaaaaggcattaaagcttcttttttctgacaaaatgtttgatttaagtgctttttctaagccaattaatcagagctcttttatagataaacatacaacacatacaaaaatgcagacagaagattcaatgcttgtaaaatttttctttttttttcttttatttttattatactttaagttttagggtacatgtgcacaacgtgcaggtttgttacctatgtatacatgagccatgttggtgtgctgcacccattaactcgtcatttagcattaggtatatctcctaatgctatccctcccccgcccccaccccacaacaggccccggtgtgtgatgttccccttcctgtgtccatgtgttctcattgttcaattcccacctatgagtgagaacatgtggtgtttggttttttgtccttgcaatagtttgctgagaatgatggtttccagcttcatccacgtccctacgaaggacatgaactcatccttttttatggctgcatagtattccatggtgtatatatgccacattttcttaatccagtctatcattgttgaacatttgggttggttccaagtcattgctatcgttaacagtgccacaaaaaacatatgtgtgcatgtgtctttatagcagcatgatttataatcctttgggtatatacccagtaatgggatggctgggtcaaatggtatttctagttctagatccctgaggaatcaccacactgacttccacaacggttgaactagtttacattctcaccaatagtgtgaaagtgttcctatttctccacgtcctctccagcacctgttgtttcctgactttttaatgattgccattctaactggtgtgagatggtatctcattgtggttttgatttgcatttctctgatggccagtcatgataagcattttttcatgtgttttttgactgcataaatgtcttcttttgagaagtgtctgttcatatccttcacccactttttgatggggttttttttttcttgtaaatttgtttgagttcattgtagattctggatattagccctttgtcagatgagtaggttgcaaaaattttctcccattctgtaggttgcctgttcactctgatggtagtttcttttgctctgcagaagctcttgagtttaattagatcccatttgtcaattttggcttttgttgccattgcttttggtgttttagacatgaagtccttgcccatgcctatctcctgaatggtattgcctaggttttcttctagggtttttatggttttaggtctaacatgtaagtctttaatccatcttgaattaatttttgtctaaggtgtaaggagatccagtttcagctttctacatatggctagccacttttcccagcacaatttattaaacagggaatcctttccccattgcttgtttttgtcaggtttgtcaaagatcagatagttgtagatatgtggcattatttctgagggctctgttctgttccattggtctatatctctgttttggtaccagtaccatgctgttttggttactgtagtcttgtagtatagcttgaagtcaggtagtgtgatgcctccagctttgttcttttggcttaggattgacttggcaatgtgagctcttttttggttccgtatgaactttaaagtagttttttccaattctgtgaagaaagtcattggtagcttgatggggatggcattgaatctataaataacttgggcagtatggccattttcatgatatttattcttcctacccatgagcatggaatattcttccatttgtttgtatcctcttttattacattgagcagtggtttgtagttctccttgaagaggtccttcacatcccttgtaagttggattcctaggtattttcttctctttgaagcaattgtgaatgggagttcactcatgatttggctctctgtttgtctgttaatggtgtataagaatgcttgtgatttttgcacattgattttgtatcctgagactttgctgaagttgcttatcagcttcaggagattttgggctgagaaggtggggttttctagatatataatcatgtcatctgcaaacagggacaatttgacttcctcttttcctaattgaatgccttttatttccttctcctgcctgattgccctggccagagcttccaacactatgttgaataggagtggtgagatagggcatccctgtcttgtgccagttttcaaagggaatgcttccagtttttgtccattcagtatgatattggctgtgggtttgtcatagatagcgcttattattgtgaggtacgtcccatcaatacctaatttattgagagtttttagcatgaagttgttgaattttgtcaaaggccttttctgcatctattgagataatcatgtggcttttgtctttggttctgtttatatgccagattacgtttattgattttcgtatgttgaatcagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgccagactttggtgtcaggatgacgctggcctcataaaatgagttagggaggattccctctttttctattgattggaatagtttcagaaggaatggtaccagctcctccttgtacctctggtagaattcagctgtgaatctatctggtcctggactttttttggttggtaagctattaattattgcctcaatttcagagcctgttattggtctattcagggattcaacttcttcctggtttagtcttgggagagtgtatgtgtccaggaatttatccatttcttctagattttctagtttatttgcgtagaggtgtttatagtattctctgatggtagtttgtatttctgtgggattggtactgatatcccctttgtcattttttattgcatctatttgattgttctctcttttctttattagtcttgctagcagtctatcgattttgttgatcttttcaaaaaaccacctcctggattcatggattttttgaagggttttttatgtctctatttccttcagttctgctctgattttagttatttcttgccttctgctagcttttgaatgtgtttgctcttgcttctctagttcttttaattgtgatgttagagtgtcaattttagatctttcctgctttctcctgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagttggattgcactgtggtctgagagacagtttgttataatttctgttcttttacatttgctgaggagtgttttacttccaactatgtggtcaattttggaataagtgtggtgtggtgctgaaaagaatgtatatcctgttgatttggggtggagagttctgtagatgtctattaggtccacttggtgcagagctgagttcaattcctggatatccttgttaactttctgtctcgttgatctgtctaatgttgacagtggagtgttaaagtctcccattattattgtgtgggagtctaagtctctttgtaggtcactaaggacttgctttatgaatctgagtgctcctgtattgggtgcatatatatttaggagagttagctcttcttgttgaattgatccctttactattatgtaatggctttctttgtctcttttgatctttgttggtttaaagtctgttttatccgatactagggttgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcatttgttgatgcagtttcttcctagcctcgatggtctttacaatttggcatatttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggttatgaaattctgggttgaaaattcttttctttaagaatgttgaatattggcccccactctcttctggcttgtagagtttctgccaagagatcagctgttagtctgatgggcttccgtttgtgggtaacctgacctttctctctggctgcccttaacattttttccttcatttcaactttggtgaatctgacaattatgtgtcttggagttgctcttctcgaggagcatctttgtggcgttctctgtatttcctgaatttgaatgttggcctgcctcgctagattggggaagttctcctggataatatcctgcagagtgttttccaacttggttccattctccccgtcactttcaggtacaccaatcagatgtagatttggtcttttcacacagtcccatatttcttggagggtttgttcgtttctttttattcttttttctctaaacttctcttctcacttcatttcattcatttcgtcttccatcgctgataccctttcttccagttgattgcattggctactgaggcttgtgcattcgtcacgtagttctagtgccatggttttcagctccatcaggtcctttaaggacttctctccattggttattctagttagccattcatctaattttttttcaaggtttttaattgctttgccattggttcgaacttcctcctttagctcggagtagttggatcttctgaagccttcttctctcaactcgtcaacatcattctctgtccagctttgttccgttgctgatgaggagctgcgttcctttggaggagaaggggtgctctgatttttagagtttccggtttttctgctctgtttttcccccatctttgtggttttatctaccttttgtctttgatgatggtgacgtacagatgggtttttggtgcagatgtcctttctgttttagttttccttctaacagtcaggaccctcagctgcaggtctgttggagtttgctggaggtccactccagaccctgtttacctgggtgtcagcagtggtggctgcagaacagcggatattggtgaaccgcaaacgtttctgcctgatcgttcttctagaagttttgtctcagaggagcacctggccgtgtgaggtgtcagttcaccccgtaggggatgcctcccagttaggctactcgggtgtcagggacccacttgaggaggcagtctgcccagtgcttgtaaaatttttcaattgccagtttcttaattggattactggcttcagggtggagcccttggaggaacagggccaggaaagcatgcatttctagggccaaataagcagctgaaggcaaagacagttccccaaaattaagggtgccattttatactggatcctggatccccaaaaggagggaaagactatgggagaagatagtgcaatgcttctaccctgcatttcagcatttcattgcaaggcaacccaaagccaatcagcccattttgtaatcaccccatctctcatgagggagtctcatctcccatttggggatgaggatgtttccttgtcttccaggtggccacgagcctgcttctctgatccaagtgtgctaagagtcaagtatccctccctaactactgttagccatcccttaaagtgtatttcctacctagttataatgtgaagtaatttgatacccccaaaactcaaaaccttcagataacacaatgcaaaacagaacacagcctttgattttgagagggatttatctgcttttaattccttgggtttcatgaggaaaacagaggggttttttttttccccaaaatggggcctgtggcacctcctctgttttcccaatgagtccgaggctaccggaagttatcttagggcctctcctgtgtgcattaagtgtggcaagacaaaaaaaagaaaaaaaagaaaaaaaaggagaaaaataattcagtcaattgagaagaaaaaacctttttccagaaaaacaagttccaagaagagaaaaacataaaggccttttaaatatatctgtagcttgtttatccacttttaattaagctgatttttaatcatagtgctctctaaaaaagaaatcctttcaaatctcttattacctgactttatccatgccaagtggccaatatttctagcttctaaactttatgaaaggtaacctcctaggtgcttcaaaggcatggtaagcagtttctttttttataggagttagaagctctacaagatagttcagagaaaggaaaattaaagagaggaaatcagaagataaccatgggtggggggagggggagactcaataaatggcaaagttacacaaataacaaaccagaaaggaatcattccagaagccaacaattgaacctaggccaccactgtcagaagataaagccttagctactgagctgtacagcattgagcagtttctattgcttttcccagaaggagcctagagaagccagtttcaagctttcaaggctttaactgctcacaaaaaatttttaggactaactatgacaagaacccccaaattcctgtcctctggatggtggaaatcaaaagaaagtattcccacatggtcactaagttaagctgttaaggacacaaaacaagacagagaaatttcctacagtattggtttcagggacccatagcaaagtttgtaactgaccagcctgccaggctggcttgaaaagcagggttataggggtcctaaacccacatgctatcctgtgatacccctgtctccattacagaacacagaaagacaaattcttattacaaagtacaccagatttgctacagcctaagactagtctcacaaatccttttttctattaatcaaacccttgcagaggacaccagtagtttactgttttactcaaacagagaaagagagagcaagcagaaacttggctggtaagaatttcttaccctttttgctggcataccaggtttctaggttccctttctctgcagtttccagaagaaccgagtggcttctggcgaccctgctcacttgtgctatagctggggattcaagccactttacaagagaaaattaccctttactgtcttacagaaccataggcaaggttcttaatttgcaagatgctgcccaatgggctgcatgggaaactgaattaacattttccgttccagcaaaacacacataacaaaacagacattacttaccttgttcagcacccactatcagcctggcaaagctcaaactttttcccattggtccctgtcatctttgatctactctatgtggggacagatgacctctgaagggtaattcatattggggtctctgggaaaggcaaagagcagacaggcactccgagacaggcctgttaagccctctttagggttcattgaatgtgaccagacgaataaggagggttctctgagttaggcctgctggacttccatcagcaacccctctgagatcccttccacatatgcaaacacacacaaagatgagacagacagaaggccttccaaatcagatccctaaccaagagctccaagaatatcccttattccaaactatcctcctattctccgtctgagaaaccgcctcaaaatctttctgattgagaagtctccaaagccaggactcttcctactagttagaaagagccaactgagacccccaggagccgaacagacaccctgcaatgaggctacaggtatcccatggtagagctacaaagagacaccccacaatggagctacagacaccccatcatagggctacagacaccccaccatagggctacagaaccagtcgggagaaggaaggtggccttggcagcaatactcaccaatccagacacccctcaatggggctacagacagatatcctgtgatggggtacagttaagggacatctcaggactatttctccattgcaattaaatccatgcacattgggtcggcagtgccccaccagtagagagagtaccagagtcagtccccagcccaagagaactaggcgactgcttgggttggcttctggatccatccataaaaggggtgccaccgaaccacaggcatgtagccacaagggcaatcccagacaagcccttaaatttgtaaccacccgaggggttcgccttgcccgctgcctagacagagccgattattcaagacagggaaattgcaacagagaaagagaaattcatgcagatcctgctgcacaggagactggagttttattattactcaaatcagtctccctgagcatctggggagcagagttttttgttgttgtttgtttgtttgttttgagatggtgtctcgctctgtcacccaggctggagtgcagtggcgccatctcagctcactgcaagctccgcttcccaggttcacgccattctcctgcctcagcctcccgagtagctgggactacaggcgcccaccaccatacgcagctaattttttgtatttttagtagagacggggtttcaccttgttagccaggatggtctcgatctcctgacctcgtgatctgcttgccttggcctcccaaagtgctgggattacggtcatgaaccactgcaaccagcccagagtttttaaggatagcttggtgggtagagggaaaccagtgagccaggagtgctgattggtcagagatgaaatcacaggaagtcagagctgtcttcttgtgctgagtcagttcctgggtgggggccacaagatcaatgagccagtttattgatctgggtggggccagctggtccatcaagtgcagggtctgcaaaatatctcaagcactgatcttaagagcagtttagggagggtcagaaacttgtagcctccagctgtatgactcctaaaccataatttctaatcttgtggctaatgttagttctacaaaggcaatctagtccctggccgtccccataggtgaccaaccatgctagtccttctctagcaagaaggaggtctgctttgggaaagggctgttatcgtctttgtttaaactatagactataagctaagtttctcccaaagttagttcagcctacacccaggaatgaacaaggacagcctgaaggttagaagcaagatggagtcagttaagttagatctgtttcactgtctcagtcataattttgcaaaggcgatttccctgacacatgtaagaattccaaaagtatttcagagattgaaagacttgtttcttattcctgttcaaagtacttgtcacatgaaatacattaaatccaagattctctgattctctcactgttgtaaaacacacacacaaacacacacacacacacacacacacacacacgctttggtctccagtgactggggaggagtcgtttgctctcacagattattgtattctacacacaattcttcaattaaatgaatgtttagaagtcacaaacactttgggaggctgaggcgggtggatcacaaggtcaggagatcaagaccatcctggctaacatggtgaaaccccatctctactaaaaatacaaaaaattagccaggcatggtggcgggcgcctgtagtcccagctactcgggagactgaggcaggagaatggcgtgaacacaggaggcagagcttgcagtgagccgagattgcaccactgcactccagcctggggaacaaagcgagactccgtctcaaaaaaaaaaaaaaaaggaagtcacaaacaacacagaatcctgcacaaacttggtctcagttttcaaccaatccctaccctcactcgcgagatgagaaaacaaaagaaatcagcctgcctttttttattccttgggctaaattgttacatactctgcaaggaaatgagcatagatatttccaagactaaaccatcatacccaagcagtcagtaataaatatgatgaatgcctaaataaattatggctagagttggtaaagtaattcttcaccatcagatgattcctgtaaaaagcactaaagtgtcaatctacatgaagcccccggccctgtttcaagttatctgttaattacacatccctcatttatccagtgactctgctattatggtaagtgtcggattcattttatcccattgctcaatagattttaattgcagctgctgcagcagacaccttgagatacatttcctattgagaccgtggcagcctgctagactggcccaatgatgattaatttcaatgacttgaatcactgagaagaagggaagccacttccattttaattacatctacaagagtgcagcacttttataccagttcattgtccttaaacaaaagaatacctgaaaggaaaacaaaattcagggtatggtggtctctatttgtactgatctccttttttcagttcattgcaccacaactcagtcagctctgtattgggaaatattggcaagccattgggatttgcacacagattagaaaccatgaagaaagcgtcattcagcttgtttttgtttatcttacttgggcaattagaatccattgagcgggttaagatatgacacagcattttgccatcatcgcagatgttccacataaaagggtcaagaataattaactctgacatgcatatgtatttatttattgttccagggagacagagccaaagacattcttgggattttacagaacactccatactcattcatacccttggatgctggcacatgctagtcccttctcttccccatccatttggataaaattttccagcaaaggccagctcaattgtcatttcctctgtcctgccttgagataggggtggagtgagggtgggggttgaaagagcagaggccttggatgagacatatctgactgggactgccagtgctgtgtgaccttgagcaagttacttaggctctctgagccacagtttcctcatctaaatgaagaaaaattaacattctcctatgttattatcatgtggattaaatgagatactttctagaaagcacccagattgatgcctggtcataaaagggtgtgatgggtataagtctactttcctcttctgcacttctcgcagtagcacttaaaaaaaaaaatctcctttatgatgctaattgatcagcaagccagaaaacaggaatttaggctctgtcctttcctccttcccctccccgcgtaaaaagatgatgaaatgtatttgtctctacttcctatttcagattcattctcttctcttcgtcctcactgctaactaccttgattcacacctggtttcttcatccctcacctgaattaatgcagaagactctttacagatccccacacctcccatctgacccttctattgcatcttccatgaggcttgcacagtgatcttccctgcccctccccataggtgaccaaccatcccagtttgtccaggacagcaggggttcccaggatgtgagacttttcagttttaaaatcaggacattcccaggcaaaccaagatgagttagtcaccctgcatcccttagttaaaatctctcaacagtttctcaaagattccaagataaacttaaatttgtcagtgtaatacacaaaactgtttgtaatctagcccttcctctctaccttcatcttcatcatgcctccgtatttcctgcacaaacacacacaccctttgctttggcaatactgggctcctagaacttcctccgcagatatttcatgctctttcttgactccttctttgtctttgcccttgcagttccttccacttgcaatgcccattcccctactcctttcatcggctagctccttcagatcctgatgcatcatctccactaataagtcacccctgagagtctaacgtagaagctcctctactgtgacttctatcgcaccctgttttaaactctgacctgacatatcttatgcttcactgtgattatgatctgcctgccctaatagactgggcagttcctgaggacagggactatgccttctttaagtcagggagttgacgcatgtctgtgctcattattggctggacgaacaaataagttgtatatatttgccttctcacctccactactaagtgacctcctcaaaggcagaaaggacacatcttgattttctttgatctcttgattttctcccccagcacctggtccacagcagggcttaattaaatgttttgaatatatgaatgaatgaataaatacatctttctttagatatgagcctagctttcctggtgaaataaacttcccttcagtttgttcactaccccctgccccagctggctgtgtgccctagacaaggaactagttgtcagaactaaacatggccccacactgtccctcaagtggccatcagcccgaagacactggggtcaggacctctcctataggcatgaactccagaaggaaaaagatttctgtccaaaggctgatttcagtcaaatctaataaaattttcaactagattccttacacaattaaatataaagaccactagcatatggggaggaaagctacaccagatggctttcccactacaaagagatgaaatatatgtcatttccacttccatagtggtttagtcttcttggagctcagcattaaacagctgggagccctttctgacagctgggagccctttctgacagtgcagattccactgctgatggcaggaagtcagtatcaggcagcatccatccattttctccaactacctttccagccaaccacctatgactttctctcctacaaaagttttatgacaagttaagtagaaagcttagcaatgaataagacctcaagggatttggcaggatggagaaaatgaggaaagtttggaataacattgattgttcctgggaataaatgtaaagtggaaaaaggtctaagggcattgtggtcgcacagaccagggatcaaagcctcactcttccatgtagaagccacctgaccccagttcactgggcctgggcttcagttttctaatctcaacagggagaagaatgacaagacctagttggcacagagtatgttcagtacattttagctctcttcccctctcttgactcctattgtatttgctaaaatgacacttctggtctgaaatggattttttcttttcctcatgtgtgggttttttgttttttgtttttagtaatgataacgcccataaatattgttttaaatgaaatcagatttagatatgcatttttaaattacttacttttgaatagaaggacaagactatgctgaacagaataaaattagaattgtcaaggggtacctgggaaatgtgacagctctatccatgaggcaaccatgacagctaaaaaaattggtaacttgtaattggctttgggtctccagtatattctgctgtgagtctcacatttgctctcctaagtctcccaaatggagaggggtctctaacactcttaagctccctgatataccccttgatacctgtccctgagactacttgtttccatacactattgttcctgatattcattcacctccaagtccactcatcttttaaaatcacatttgaataggcatgtgtgagagaggctaacacacctgtaagtcaaaatcccatggcgcgctgtagaagacatcccagtaaggctaaatgagcaagggtttcagaatcagaggcctaaattctaaccttggccccttcatctttgtacaagagcagcgcttatgtctgtgggctgttatataaaatctacaaatacctgtcattcagtccagtttcccattcaatgagaagcccctttcatcacattcctagcagatagtcaccccatctctgcttcagttcctccagtgacagagacctcccttttctgaactgccatataagtttgtgcaatttgggtattgcacaaaagcaccaacctgaagaggcaaatgggagctaaaatcgagtccccattctgcatgtaaagcttgttgcctaaaagggatgcctttttcttatttgacggtccataaaaggctcctttttctaacctcacaaaggcaccatatagactatcagtgaccctgccaggtcaacacactccagcgctcactgaaaaatagaaggaacttcaacctctgccatgaaggatgttgtttcagatgccaagtggacaatgagactgtgtcctttggctcctcttagcaagggccacgaccccaaatgagcccaggtgttgagagaccagcaattagttgccgtccaagctagtgtctctgcaagagaagaatataacaaaataaataaagacctgcagcagcacaccatgcttgatcatttatcaaattgcaaaatcttatccatgactgtgaaatggctttatagttaggaaaatgtactaataatgttattaggcagcaattaaacttaaattccttttaactgtatttgatgtcattctttttctgggcccattagactaacattaaggtgtttgtgcagatagctcagtcatttcaaattactttcttgtctaatgtgggagcctttaatagcatactcttaggttgaattcaattttggagacaccaggcatgctaattagattgtctcagtgttccttgcagaagaagccaaagaagagctatttttctccctcttctgcttagcaatgttcatggaacacaactttctgtgcaattagaggtatagaccctttaccacacaaaatctcacttgaaccgtaagtattgctagcagacacaatgtctggttaatatgccaccattgttgaaatgtttttaagttctcattagagccagtaagttttctcccctattattctgagtatcgtagccagtgtttgttctgtctcagcatgttagagttggaagagagggagaaataagtgaacatttattaggcacctaccatctgccaagttctgggtgagatgtttaatgcctccaacagccctgtgagctgtgggtcattatctccatttacagatggggaaactttgactcagagagggtaagtaaagtgcccaaggtctcacagctggcaggttatggagttgggatttaaacagatctgactctaaagatatggtcttccccttctcttagctcctctgcttactggtttggaaacttagaaagtcactttaacatcttgatcatcaagatcacatctataaaatatgataataatattcaccccctcacagtacattgtatttatcaaatatagtaataaacgtaaatggcccttggagaaagtgaaatgctatacatatgttgatgaaaagcaactcctgagggaccttagtttccccaggctgatatatggatcagatgggatagtattatgtcaaacatccagcccacggcccagaactcaaacattcaaccgaacaataatttcatcatcatttcaaccagccttagtccctggaagccttccaactatgtaatctctgctcatttacagattcccttttctaagtctcctttttcattgatctattaacataaattctttcttcaagtagtcattgcacttggcattgatctactaacttatagctattacaatcatgattgcaattaccatttggctccctgcaatgctatcatcattttctcttggttaccatgataaatcttactaataactcctgcctcagatcctttgtggaatgaggcaagagattaatttattaattgatggattaatgactcataacagttacagtcatcattaattgctattacctctgaagcatcaaatggttgagggggaataagagtaaggctaagtggagtgtttcttcctctcagagggccagcctggtagagaaggtgaaagctgtcaccagccaggcagagaaagtaaatgtcaccttgggagtatgagtgtattaaaactgttatggcacaaaccaccgctgttccaacccattcctttgtcttccctggctctgacttggctttccccataactactgtgattctttcaacattagacatccagctctgggctgctggcccttccctcatcccaaggtcattctccacccaggaattcctgagagccagccaggcaagataagaaaacaacaggcctatttgcccctccagcctttgggatccctgaaagctctggtgagtgcagcaagtagctacaaacttgtcaccctgtctttgagagatcactcatccttgagccctcagattccgtggaacccatggaagaccagagctcaaagtcagaagaagggtacaccatgaagaacccaaacttttcatcagtccacactaccccatctccattcatacccagctctcctgtgtaagaaaggtaacccttccagagccacatgaatctcttgtgcaaccctcttagccatgcagcatttctgcttagatacaagagtggtgccaatgcaatgcacatgcttttgctaaattattcccatcaaggaaacagtattatacattctgcttatcacagggtctacctgtaatgaccccccaccatcagcaaagccaatcattttcccttaaatattatagctattgttcattactattggctatagagtttagtttgaaggtttgcccatagcatatcccccatcctttaccatccaagatctatatgtatgaactgtttttcctctatttactatcaactttgaatgtatgtgccccccgctcctttctcctagagagcctttctcatatagacctgacctctctcataactcatctatagaatcttgcaaccattttcctgaaaaaacaatggaaacagaccaggggcttggttcagtgaaaatgttagttaaacctgagtctacatggtaaaatggattatacatagtttaccaaacagatgaaatgtatacacagctaccccaaatagcacacaggcatcactgcagagtaaagttgggttaatgatcaatccctccaaaacagggcattaggaaagcccttggcctaggccagttgaatggatttttcttgggcttctccagactccttttgtctttgtgatggttctgtagtttctgctgattgacctctgaacccaagatgagcagcgccccttctcatcagactggccacttccttatatcagaactgatcagaacattgcaaagagttatttaatatgcccgtctaactgatctggcaaagtggaaggaagactgggcaacctttcaatgccagactttgcatttgatctcatagtcagtaaagattattgagctgaggagtacatcttggtaataacaatatgcatctccctgagttgtctgaggatcaaatgaaataatatatgcaaaatgaatttgaaacctatataggcctgatgattgttattatttctttctgaaggagttcttccccattagtgattcctggcttgtctttggactcctctttcagaaaagcaagccagacacatgtgacaagttaaacaggcatagaagatatttttatctgctcaagccaacaacagtaaatgcatccaacacagtgtgtgattaattgccaaatgaattgtgaaaagaataattgccagaagagtttgaacaagggagggctcagctctaacaagtgggcaagggaagaaggaggatcaggagaggctgtatagaagaacagagattttgtttttggtcttgtgggccagataggatttggattggcagggagaggacattccagggaagataagttatgtatggttgggtggacatgctagggattggagtgttcagggagctgggagtgggggagatgcatttgatgtagtgggaaattgtgaatggtattttctttgactctgtacctttaaccatgccctacataattgtgccacccactccaaccagcctctccaatcctggctgtcccatttatccaacactcactcctgcttatgctgtacccaccctttgccatcctggctcatcttcatacctaatcttgactacatttcccatttatatccttgtgcagggccctgtgaacttgattcaaatttttgacctcagaggtttcttcctcaattcccactcaagcctacagaagtaaagctaacactaagccagatcttcgtgtgagatcttgaaatcttctatctccttaaagtaatcctgtgaagtgaaatttcttttacccccattttgcaggagaggaaactgaggcttgagatgttaattgtgagcactgtgtattattagtccactttgcattgctataaaggaatacctgagactgggtaatttataaagaaaagatatttatttggctcatggctctgcaggccatacgagcacagcactggcatctgctcggcttccggtgaggtctcaggaagcttttactcatgacggaaggcaagggggagcaggcatgtcacaagatgagagaaggggcaagagagatgccaggctcttttaaacaaccagctgtcctgtgaactaataaggtgagaactcactcattacctcagggaaggcactaagccatttatgagggatccacctgcatgacccaaacacctcccaccagacccaactccaacattgagggtcacatttcaacatgagatttggaggggacaaatatccaaaccatatcagggtgagatttgaaccccaacctgtctgaccccatagcctaactcccaccactaggcagatgacaaagcctcttattgccttggcccaccatattggtttttttcatcgttagtacccttggataggatattttactctaggcaacccttggaacttagaccctgcctcatattgccatcctgccgcaaatccttgggtagcaaggacatgtcataggtaggaattctcagtgcagcagttagtttggggtcctaaaagactttattttctttttgttgttgttgttttttgagtcagagtctcgatctgttgcccgggctggagtgcagtggtgcaatctcggcacactgcaacctccacctcccagattcaagcaattctcctgcctcagcctcctgagtagctgagattacaggagtgtgccaccatgcccagctaacttttttttttgtttgagatggagtttcgctcttgttgcccaggcctggagtgtaatggcgcaatctcagctcaccacaacctccaccttcttgggttcaagcaattctcctgcctcagcctcctgagtagctgggattacaggcatgtgccaccacgcctggctaattttgtattattagtagagacagggttttgccatgttggtcagactggtcttgaactttcaacctcaggtggtctgcctgcctcagcctcccaaagtgccaggattacaggccactgtgcttggccaatttttgtatttttagcagacggggtttcagcatgttggccacgctggtctcaaactcctgacctcaggtgacccacccacctcagtatcccaaagtgctgggattacaggtctgagccactgtgcccggcccgtaaaagactttcaacaccagcatttatatttgattctattgacagtgcaagccagtgaaggttttaagatggttataaacatgaggataacatgatcaaatgccatattttcagaagataagtcctggacacagtccaggactatcctgcctcttccctcctatacaatgaagaggtggcaggaagacacaatttgcaccctattttgtggtttaagttaaggttataagagtctgaattaggtagtggtggtagaaatggacagaatatgataataagtaattgactcattttactctgaaataaatgtatttcttctgaaaataaactttctcaccaatagcatcatctggaaagaataagctcatagcttcataactctcggggacccaggatgtatctcaggtgtatcattgttccttggttcatattcttgaaacttttggcaacagcatgatgtggagggaagcttagggggttgaagtcaggcccgctttctagtagtgactctgccactcaactaaccatgtgaccttgggaaagtccttaatctctctgagcctgtcttctcatctgtaaaatggggttaatgtctgtcacacagggtagttgtgaggcttaaatacaacagaagatagaaaagctatgatgagcacagaataaatgtcagtttttatactatcttttcttagccaaacatctcattaaaagccctgagtaatcacccttaaagtcatgtttgaaagaaaagtgattgggtttaaccaaccttttagaaagaaatttggctttccaaatgttttccactgtgtattaagacacataaaaatgttcatatcttttgacccagttgttccacttctcagaatctattgttaggaaattgtcctcaatacagaaagagtggaatgcacaaagaggttcaatgcacagatggctacaatagtgaaaaatcagaagcaatttgaatgtccagaagccaatgattgcagagtcccactgcagtctgctgatactttaaacatgctttaaatcagtataaaatacacagctcaaaacaatatgaaaacgggcaaagtaaatcaaggatcaaacattcttttcttcgattcatcacctcccacctctgatgtccaaccccactcttctgcagggcttccctgtgtggcccatataccaacaattctctttttctgccatctgggtactaccagggctcatttgcacagcattaagcttcccacccagctgcctaagccccctcggaggcaaatctcagctctttcccctgcagacacagaggttctctccaagcttggcagttttttggcacagctctctctctgtctcccaaggcttccttgctctggccccaccccatatccctattaccttcccacttccaacttctttcccgattgtctccaacgcagttcgctgtgcccttctaagttagagaaagtattttctcaggtgtccaaaatttgttcatctacataaacttaaggaagagggaaaaaagatagattttgatgtcaaagtttatttagaagccagtttacactcagtctccaagtctttcagtcttgactgcttcgtggaatccctcaagagaagactaaaatgttattaaactacatcatttcaaagctggaattcatgaagttagaaacacagacagttagctggtcaaaaataaaaataaaaatcacataaagtcatgtggtgctacctgtattttgtaagcgggcacttcctcttttggtaactccttgaatgaagagcatttggtttctcttgagtttgtataattatatgcattgtgcaatttcttagctttggcaggcgctgggtagcatttggcttcagcactttcaactctaaggacaatttcacaattgggcttttcctgtcagctccaacatctggacccaggggagactgggtccaccatgcgatgaaaccctatgtgaacttcctcagccaagcaagaacaagctgtacaagggcaggtccttccctcactccaggagcctgaaagcaggtctttcactgtggctgccaggttatggccattttttaaaagaaaataagctgatcattttttaaaatgctgctttactggttgaacaataatcactatttcaaatcaatatttattcagcacctactgcatgccatgagttccaccctgtgtgctggaatacagagacagctcctgctaatccatcctgcctcttctatcttccttcttctttcctccttcttccttccttccttccttctttacttccttccttctttagttccttccttccatccttcttccttcctccttccttccttctttacttccttccttctttggttcctttcttccatccttcttccttcctccttcctcccttgcttcttttcttttctttttctttttcttttttttttttttgagacagagtcttgctctgtcacccaggctagagtgcagtggcatgatctcggctcactgcaacctccacctcccagattcaagtgattctcctgcctcagtgccccgagtagctaggattaaaggggcccgccaccgtgcccagctgatttttgtatttttagtagaggtggggtttcaccaccttgaccaggctgttctggaactcctgacctcatgatctacccacctcggcctcccaaagtgctgggattacaggcatgagccaccacgcccagcttcctttcttaaatattgtttaaataatgctgaaaacaaaaaagaaaaaagcacttacaatcccatcacttggtatataaagaataaaaaagagcattgttctaaagcttatttagaagcccatttacacttagacctcaagtcttttagccttgaatactttgtgaagttcctcaaaagaagagtgaaatgttattttaaaccacatcatttaaaaaatacattgctcatcctaccctctctgagtccgctgctgcctctggtggcctggggcagggaatccaatgcctgccccaactggccacggcagtgatggaaggtggaccaatgagaactagtctctgcctaggaagcactcgtaggttatgttatatacaaaggatgatgccttcacagtttaaactctccccttaatttataaccttgtgctgagctttctgcctctcccacagatcttccagtcccacctcctctcaagtagaactccttaaatgtagagttgtttccttcttccttccccacacacttaaaacaggcaggcacattttgttcttcatgaacgttcaggacccgcacactgtgaaacaatgagtgaaaggagtagacagcacggactctgacttcctggctctagaaaattccttccagagtaagtttgcatgcagttcactgttgcacacagtcctgggccaaaggatcccaaatgaaagcaaaaacccatcaagagaattgtgatttaaaagttaagaaaacagcctgtgcatatttttagaacagcccagaaaagaatacatctgtgacttgaaacagctggaaatctactttctgccaaaattatgctgattatgaaagctgtaatggtcagacaagagacagtcagaatccaaggagtcctgtattttcatgtattcaactttcaaataatctttactttcatacattaaacattgacccctctacactgcctttcaaacaccaaatgccagccagccatgaagtttttacagccatgtttgtataattgaggattttattgtattttgcccttatcagtttagtagtaagaatgatcaaccaaaagaacaaaagtaatcagaagcgtgggttttataaactcataatatacttcagaaaataaagaaaattatgaggcatcctgaaaacagaataacattagccctggatagtcattgggttacaccagtcaaccatgtgttcaattctgaaggaaaacaaaattttaaaatatgtgtgaaatgttaaaaatattggtaacaacttatggctaaaagacaaggtatcattagggatatatatatatatatatatatattaggattactgaaaatgaagtcttctcctacttggcactctgctagggtatgtctgtcattcactgttatgtcctcagtgccttgcacataatagatgctccataaatatttgttgaataaatgaataagtcatttgtagctttgacattttaaagaatttattatgcataaaagtagagatatatttgcctgtctctaaatatagaaagagaagtagaaaaaggatttctgaagctgccccgtcaatgtgcgtagagatggatcaatctcttacaggggtacaaaaggtgaatttaagcagaaagggtgacagtgagctgtttgtcagactattgtccaaatgccctccctcacggtacaccctcctccaagccacacatacccctgactgaaatcaggcaaaaaaacagacctggtaaggccaggacaaagacaaggcttaggagtgaggtgccccaccccccgcccccatcacaggatgcaacgtctggaaagaggtgggacaggaagttgtgcccgggggagaacatcaaattctagtccaatatagtccaaactgaggaataaaatgaaaatgtacaaccaaggtaaagaaccaaaccagagatgctggtgagtgaagagcattcaaatggacatttctagaggaattctcggggtagagtgcaggcatccaaactggtgtttcccaccaacttgctgtgtgcatttgaagaaaccagagcagaatgcatgcagctcctatgcaaaagacggataaattacaacacagaaaagacagtctaaactcgtgcaccagcagagcaagtctctgatgtatttgctccaaaatgtaaatgatgaagccaaatattggacacagttgagatcaggcactggaaaattatttcaatggtgccaaggccacacgcatggaggaaaagcagtgtcagcagcaagtgtggtgagaaacagggtaaaagcaggatggtcctgagattctaagatcagaaccaggaagtgttggcaggaaggcctgggagatgatcagaacagttctccctccagagaggacccaagcctcactcgcactgccacgccaccccaatcttgaaggtaccccatgccgaacctcatcactgacagcttgtgaaggtgtataacgcccaggaggagttgtggtaaacgtatgcacacatatatataaatatcatcttgctccaaggtttttgaggatggtgagctctgcttgtcacaaaggtaacaggggtggtcattggtttcactttatgtgaccttaaagtgcattttaagtgaactcacattcaatgtcactttgtgggatgcttggggaagagggtctcctttagtgtccagtcttctgaggctctgccttttccctctctggccctcctcagacaagcagagctgagactctgccttcaaagctcgggtattgcctggaatccctgaggcagtgctagctggggaatccagtcagctaacacatgcctctcagacagtctatactctctcctctgacatccaggagggctcatggcagggccacacggtgagaccttgcccatcacacagccattacagaggattcccacagagccttttgacagtggtggccactcatggctttcagagtatgctgcttccctgaggagctcaccaagggctgtgatactctcagaagtgcctctgaaaggcagcagtttacagaaggacccctgctgagcccctggtgaagctgagctgctgcacagcttgcccaaggaacacgttttagaaatatcttcagatccactgggactgccagaggctcctcatcctgtgcccagcacaggccagtggttctagcccttttggttcaggataaaacttcacccttcctaggtttttgtctttccactcatccctcactggtgaggtaaaatatgcctattaaatcttcccattggtgtgcgagagtcaatatttagggtacttgacaaaagctctagattcctcttcctctgagtccttacacagcatacacctatgggcatggaattgaataatctgccagtcctccatttccttcagctccctaaacagcaaatacaaactgaacttcattagcaactccaacttgaatggcaaatgccagccactgggtcagctcaaagctcaaggataaatttcagtggtgaaacatccacagaaaaccctcaagtgggagaatgctaagaaacagtgggaaagaactaatgggaatctaggcctacttcacacacacacacacacacacacacacacacacacacacggactgcctgcgtggctggtacaataaaagtgtgtatttacactcgctcatctatttcattacaagggaccaatcacaaagacatttattttgtcttctttcctgctctggtaagctaattacaaagtaattgaattagctacagaataaattagttgttatcaaactgcaagtaaagggattcttctaaaaatgattttagggtaaaacactggcttgcacaattattccaggttaggaaatatttttaaaatttattttattaatatgtttattgtaggaggaaatcctaaatttaaaggtaaacctaaagtaaatatttattctacctttaatgaatgacaaagaaaggaaagcatgggtaaattcttgaaaatgctagagggggcagtctacgtgaaatgtttacatgataatctttgttggttgaagtcactgaaatattgaaacgtctttagtggtgagcaagtggggtggaatggtgcttactctacataatgttcgatttagcacccttaccacatgtaattactaagtagccagaaagaatgtctttttcaaaagtacatactctgccctcttaaaaatctcaaaaatagcatgttttcttttcaacttctaaattacacttctattaaatgctatgcagagttcagaaaatggctgcctctgatcaatctggtgtgcaaagcccttcatgaagtcatatccatttgatcataaataagctcaaagataccttgcaataaaagtgtcaggctttcagctctctggcaaagtagaagttatttatacattgaaagggtgtgggatattaatggcaaagacaaaaatgattggaaaaggcctggaatcaaaggacaaaagctggaattattaaacacaatacaacataatgccacaatcagaaacactgtaataccatggaattcttacagtgccggtcaaattatgcccatgagcataatacttgagacttgagggtgaaatgtcaggtcctatacttgggcctggaagcaacagcacaattacaagatcaaataacagtattgggaataaaaatagtttgcaggttttagtgggcagtgaactcagagttcatggcatgcagaggctgcagaaaggccaatttgaggatggacagtcctacaaggcatagtctggaagcagggttcttaactggggctctgttggtggggagtggatttgggagtcacagcctctattgtcagacatttatttcacagtttcatagcaacattgtcatgattagctatgtacatataactttgcaaccatccttaatgaatacctaaggatcatcctagaagtgaaatttctgggtctgagggtgtatacattcttagtgcttttaatacatactaccatgtgcctctagaaacattttctgtttctaataagagcagttgaaaattcctgtttccccagctatccaccatttgcctcatgattttctctaggactaaattttaaagtagagtctttaaagtagaagggagtccaaattccatccctttcattttataggagaaaaaaaattgaagcccatgaaggataggcgatgtgtcctctaataccagagcttctcagggggagagaagatgggggtggctatagctcccttctcctggccttaggcctgatatagaacaggtgcatggaaacgtccagcatagagaaatctacagaaacagaaagtagattagtggttgcctaggcttgtggatgggagggaagatggggagtgacaactaacgagtatggatgggtgttttggtggggccattgaaaatgttctaaatctattgcggtgatgtttacacaacactgtgacgatactaaaaattattgagttactttaaagaggtaaattgtatgttatataaaatatatcccaataaagctgctattttaaaaaaaaatgtgctcagtaaacatttgtagaaggacagaatagagggaggaaaacagatcaaacatccttgttccttcatttccaaccagtggtctttccactttctcactttcactgaagtagaacatgtctaaaattgtccccagctcagtgctgggtttcccctaggtgtttccctgtgtttcaggaatgtgtttttttagtaaacactaacctgcctcttccagaacttttgagtagagaattttttaaatctgagcttcaggccaggcatggcagctcatgcctgtaatcccagccctttgggaggctgaggtgagtggatcacttgagatcaggagtttgagaccagactggccaacatggcgaaactctgtctctactaaaaatacaaaaattagccagatgtagtggtgcatgcctttagtcccagctacttgggaggctgaggcaggagaatctcttgaacccgggaggctggggttgcagtgaacagagatggcaccactgcactctaatctgggtgacagagtgaggctctgtctcaaaaataactaaataaaatctgagcttcagccttttatattttcctgagaatctagctcagggctggtcacaaagtaggcacttgatagatgcttatttactgaaatactggtgaactgtatgtacattaaatattaagtaataaggcagtaatatagcattattttctaatattgatgcctaatttctccagctgtcagttcaagctctgtcaattcagttggcagttaacactctggcatttcagagattctgatctccccccttacatttcactgtgcatagtgagttgttacgggccccactttgccctcagtgcccgaaagcacaggactaaatttaaggctcagaagtattgactgcagcatctggggggcaaatctagaatccatgaagcttaaactttattcactttggaaggaggaaaggtcctctttaaaaataaataaataaataaataaataaataaataaacaagtgggggctgcgcatggtggctcacgcctgtaatcccagcactttggggcagtatcacctgaggtcaggagatcaagaccattctggctaatgcagtggaaccgcacctctactaaatatacaaaaaaaaaaaaaaaaaattagctgggcatggtggcacgcacctgtagtcccagctactcgggaggctgaggcaggagaatcgcttgaacctggaggcagaagttgcagagagctgagatcacaccactgcactccagcctgggtgacagagcgagacttccatctcaataaataaacaaataataaaaataaaaacacaaaattataaatgctaagtacagcaccttggaaggggcctgaccaaagaagcttcctcagcttcctgataagtctgcttgtggctttgttcgtttctctctccttttcattggatttaattttgtttttatgtttaaaagtccattgttagtagcaatttagcatcataagcctcctaattcttcttaaaaatacagtgcatttaagtaattgtgtaattaactacccacaccatctagacgataactagaatggtggggcatcccatctggagtggaggatgggctctcaaatcggtgcctaatgtgaaaatcacacatagtcctaattgtctttaaaatctcttaaattgcctgttaagtacagaatgtgtggttttatgtgtctgaccttgtcagtagttcttagacatactcaagtttgaaaatcactaagccagaccaaaggaaggaaaatccaaatgcaggtgcctggaggtaagaacctctttgccttatgaccgctctcaaatctctagcttgaacaaaggtaggtgctcacctgggatgttgactgcctcttgtttttgatactgagcccttataaacttaataaatgttaccagcttggtttgttgctatggaatttgaaaagatgatatatttgaaagctgatagactgggacttggcacaagaggtgctctgtgaatgtcagttggatttaaatctcatttgatcaggtctccatacacactgctctgctaaagatggtgtcttccaagctggtgtttctgtttgtggcctcactacatgacaatcccactcattcagggcgtgggccctggactcagcacctctttcggggtaaataaaggattccttttacctgagggagggttctcaagtctcccatttgaaaacatttcttcatgacaactacatgatgtaactttgtataaacaaaagttatttgaaatgaacttacttaataatttacttgctacatttgcttttttacttctttgtaaagcttaagcttagaaaaggtgcttctgttgtatttgcatttttttaaactgactcgagtaaggcaatgaatgaggtttccgaaagatgaccagagataaatctagctaaaatcagtctcaggacttgagttagttttgttcctacccttatacttatttcactgacataagtaatagtgtttcctactatctactactttgggggaagaaaagagagtccctttggtacagagttactaagcacctaaatatcagccctgtttgctgggcatgtgggattcggaaatgaataaatagtgcacagccttgacctgaaggtcacatatgtctgaagatatttagtcccctagatactttcttaaggagatgtaagggcactagctttcaatgtacttttgagggaagtaaccatattcctccaatgtcttcatagttacattgctttatacaaaaactctcttcgtaatagcaccaacgtctgcctaggtgttcaatccagacaccatgagtcacccagaccactccttcccttcacccccacaacagttgaccaccaagacatagtagctctaagtcccaaaatatccatctctccctcttactcctctatctctttcctggttcaggcctcatcacctcttgccttgactatcaccacttcctaaacttttctccctgtctcccattcccacttcctgccttttcccaatctccctgccttacccagcccatgttccatactataactagaaagggctttttaaacacaaagctaacaatggcaccctcctgcttaaattcctctgtgcttccccgttactctcagctgtggtcctgcacctttttctcctgctaatgtgcatgctcatatgtatgtgcattcagaggttcattcgctcatgcacggttctgagcatgccagctataatcttgccccatcactctggagggtgcaagccctcagtggggaacccctgccttagagcatgaagctcaagttccttggccttgcctaaaggttctttctgatctggcctattcacatctgcaacctcatttcctcccagccacgcatatgtgccctgttcatcagcctattccaaaccgcttacagtaccctcaaagagaccatgccccatgcgtttttacacattgctctcttttccttgaatactttccccccacccctcatccacccatttagcaactactaaccctccaagacacaacttaagaaccaccacctccaggaagccttccatgctccatttatgtccctattctctatgttatatgtccctcccctataagatcatttatggcttcatgcttatctgtaattaatagagtgttcaagtttatagcttgtcttgtgtgctagggaataagctccttgagaccaagaactttgggttatcaattgttaagatctcagttctttgcacagtgcttttcatcctaggaatccgctaacatttgatatttgtgggaggaaggaaagaagtaagagaaggtggaactttgaagctgtgatcattttctttccatcaaagccatagcaaaaagaacaatatttttaacatccatttaattaacttctataaagattttttgttgacttcatgaatcttaaaattctttattaaaagatcttttggctggtttcttcattctcacttttgaggatttgtcttaaagttatataaaggattcataggagagaggcagaggtggacagattacttggggccaggtttgagaccagcctggccaacatggggaaaccccgtctctgctaaaaatacaaaaaattagctgggcatggtggtgcatgcctgtaatcccagctactcaggtggctgaagcacaagaatagcttgaacccgggaggtggaggttgcagtgagccaagatcacgccactgcactccagcctgggtgacagagcaagaccctgtcttaaaaaaaaaaaaaaaaaaaaaaaaaaaaaaaaagatttatgggaacattcaatggtcccaggtttcaacaaaaactctgtagctctagaggatggtggccggaagttgggctttgaagtgaaacagacctgtgtttgaatccctcttggccacttagtatctgcatggctttggcaagttacctacctctctgagcctcagtttccatatctgtaaaatagggatactaaaactaccaactcctggccaggtgcggtggctcacacctgtaatcccagcactttgggaggccagggcgggtagatcacaaggtcaggaggtcgagaccatcctggctaatatggtgaaaccccatctctactaaaaatacaaaaaattagccaggcgtggtggcgggcacctgtagtcccagctacttgggaggctgaggcaggagaatggcgtgaacccaggaggcagagcttgcaatgagccaagatcacgccactgcactctagcctgggtgacagagcgagaccccatttaaccaaaacaaaaaaacaaaaaaacaaaaaaaactaccaacttcatagcattagtttgatttttttttttttctttttgagacaaagtcttgctctatcacccaggctggagtgcagtggcacagtctcagctcagtgcagcctcaacctcccgggctcaatcaatcctcccacctcagcctcccaggtaggtgagatcagaggcctctgccaccacacctggctattttcttatttttagaagagatgaggtctcactatgttgcctggtctggtctcaaactcctgggctcaagtgatcctccctcctcagcctcccaaagtgttgatgttataggtatgagccacctcacccagcctagtttgaaatttaaatgataaaatacatacaattgagtatatacacataagtatttaatgtatgatgatgattattattattacaaggacaaaatctagtgcatctgatcttaagctatggtttcatagtaggtgactgtgaagtggtggggggagtccttgaaaggagaaacaaaaaattcagtgggaacttagataaggagaagatggagaagtcattttttttcctaatctgtttagctcattctcttataattaaactgcaagattattccttcaactacaaaatggataaattattcattatattgacttgtttgaaaagatatcatagtttaaaattgaatgaatttctctttaatatgattttctggcaagattagattctaatgtggattaatatcctaaattgagagctctaattgaacactgtgggaaccaagcatgagtcaaagacatcgtccctttacaagtggcagtcaccgaggaaacgttcacttgtgtgtcagagggacacctaacatcagcaagagtaacagtagctgaggctgaatgaaggcttgctgtgttgggtacgcatgtcaagggagacgcaggacgctatttgcctcacatctccctcatcttgcagtcatcgccgtcctgtgccttggtggagtttttagtgtatgcagcttctgtgaacacaaggacctccccatcatgtccattgcactccctccatacctagcacaagtgcatggtccggagtagtgcccagtgaatatgtgtcaggacagtggggaagggaggaggacaataccctctaacggccccagagtctgtgccttctggcccagattcagtcagactccaccaaagtcagtctccaggactctgttttccaagtttgttcagcccttccccctcagctaacctgttcgtccctttgagccaaactcactgattagcattcagcttctttcactttcaatcatgccagacccggtgtttcatgcttaaccgttagggaaacatcctgtcttttaccatgatttttgcaggtggctaatatcatcaattattttactcactcaactctcagagggtaatcacttctttgattcaagtttcaaggccatctcactgtgggctcctatacatcaccgattacaccgggcagagtcaagcagaggtgctggccctgttctttacagattcatctggaaactatggtgctgttaatctgctctgtgttcatgctaatagtgtctgtctataatcaacctcaatctaccattcaccacgccaaaaagataaatgccagacttcagaaaatgaactaaaggcagccctcaaaccccagaaaatctcctgtccacccctgccagggcgcaagatgtcctgatttaggaggttgatccctcctctaattcctccttagaatgtatttcaaaatcaaaagccaatagttacatttctaagcaacggagcagaccaaaaatgttttgtttgacacagaagcaatagaagcaagaccatgtttctattttatgaaacctctgagggtaattcactgaaatcttgacatttaatatcacccaatcacctctctagcaagctattttctttggctccattaaccccacacacacagactgggctgctggcacttactgggtcttgtcgttaggtgggctgcttttaataccagggcaggatttggcaggaagaagtggcacctgctttattgaaagacatcttcatattttagcctctgaaagagaaatgtgcaacataaatgtccttaagagacgattatcgtacatcaagatgtccattccaaaaggcattgtaccagatgcccaatcacacacagtcacccagaacagacgtgacagatggagactttgagcttttaaagaaaacaaatgtgcaaattccaaagtgtctgtgtgctccaggccagcacatgcccaggtaatttgagttgtgcccattggctgaaagataagattcaggcctcagagagggtttggggagaggatgagtacaggtttcttgttgcccagagtctccaaatagatacacacaggatacaccacctcagcccagagatatttaagcactgagttaaaagaaaggattgagcatgcagcatcaattgatacattaatgctggttctctggcatcagggaagacattaacatacagaacttgtcttctccactgttcaaaaatgggaagaatcattccaacagggagagcagggaagtccaaaatccataatgctcaggtacaaagtaatgaaaccagaaatccagggtatttttgctattactaccaagggcctatcttcggtgtaatggcaatcttctaaatctctgcatagtttgacacctgcaaatctgattgagtctgattgaaccatttgctgtctaaaatccttgggagaccccgataacctagagctgtagctttcaaattgctccatgggctcgggccaaggcttccacagggactgagggaggaagggtacagctcttgggcacatccccttggctccagtcagaaaagttatttcctctgttttacaaattgagcttccaagtaagattttcttcttttctctttttatctgtctctgaggttgggtacagtggcatgatcgcagctgactgcagtcttgacctccctggctcaagtgatcctcctacctcagcctcccaagtagctatgaccacaggtgtgcatcacctgtggtctaatttttttattttttaattttttgtagggacaaggtctcactatgttgcccagactggtctcaaactcctgggctcaagtgatcctcccgcctcagcttctctaagtgctgggattacaggcgtgagtcaccatgcccagctccaagtaagattttcaacaaagagtcttgaggcttaaaaacaaagtatgtttgaaaagaaggggtctgcaggattaaattcagataagatcctccccattcttttttgtttgtttgtttttggttttttttttgtttgccaggctgcagtgcagtggcgcagtctcggcttactgcaagctccgcctcccgggttcacgccattctcctgcctcagcctcctcaatagctgggattacaggtgcccgccaccacccccggctaattttttttgtattttttagtagacacggggtttcaccgtgttagccaggatggtcttgatctcctgacctcgtgatccacctgcctcagcctcccaaagtgctgggattacaggcgtgagccaccgcgcctggccgatcctccctattctttatcctgtcttcctcttagacgttccccagcacacccagataatccagtcatgtccagtgacttccttctctctatatcaaagtttccttccgttccatttgcctggaatgttctcccttttctcttctctgcatggtaaatctgtattcttgttttaagattcagttcaaattttgccttcggagtactaccattcctgcttagcagcaattatccatattcccactgcatttgtgcatgtgttgacgcatatcgtattattacatgtgtctgaatcttggatcagtctgcacactcatagaatatagagtccctgtcttattctgtcctcctccatcttcctccagggcctggtatgctgtgggcactcaataaatatttgatggatggatgcttagctatttaattcaccactagatagcaatttggcatattcccaaacaattttattcagaaggaattcaaagaaataggcccacattctcataaccaactcaagcagctctatgttaacaaagaatataactacttctaactacttctgtttaggtcggagttttatttttttaataaaatttatgattgcaacaacattaaaagagatattgtatagaggtcacatgctgaaagcccatggacaacaacagtcttttaaattggcatggtttgaccctgccaatctgattgggtcatttcttcacttaaaattctcacgagacttcctgttgtctgtggagttcagaggtttctaggacacctccaatgctaaggcctccacatggaggcctgaatggaaaggaagtggctcagggtctcacaccttttgcttcagtcaaagaggttctacagaatcaaagtgttttttgtcttaatttctttttattggaatggctatggctgagcctgactctccaggtttccatagttcccaacacttgctactttccccatccatcttcacctgcttgattcctgatatttgagtttgcaactcaaaactcacccctaaccccagccctctaaaaccgttttcatttttatgaacctatttccaggcccagagcactatgcctatttttatatatacttgcaattgtattgcatatacaattttatattctgttttcttcacttaacactgtatcataaatatttttccagtatgtgagatgtgagacacagcctctgatggttactttttcttttttgagactgagtcttgctctgtcacccaggctggaatgcagtggcacgatcttggctcactgcaacctccgcctcccaggttcaagcgattcttctgcctcagcctcccaagaagctgggactacaggtgcacactaccacacctgggtaatttttgtaattttagtagagatgggtttcaccatattggtcaggctggtctcgaactcctgacctcgtgatccgcccacctcagcctcccatggttacctttttaaatgacaagtttttaagttggttggctctaatttatttaggtcttctgttattgttgtatcaactttttatttttttgctcttagaagtaataattgtgttgaaaatcttcatacatatgaattttttctaacaataaaagtgttcctcatattcccattcacaattgccacaaaaaataaaataaaatacctaggaatacagctaactatggaggtgaagaaactctacaaggataactacaaaatactactcaaagaaatcacagatgacacaaacaaatggaaaaacattccatgcccgtggatagggaagagtcattattgtgaaaacagccacactgcccaaagcaatttatagattcaatgcaattcctattaaactaccactgagactcttcacagaactagaaaaaaactattttaaaattcatgtgaaaccaaaaaagagcccaaatagcaaaggcaattctaagcaaaaagaacaaagctggaggcatcatgctacctgacttcaaactgtactacagggctacagaaaccaaaaaaacatggtactggtacaaaaacaggcacatagaccagtggaagagaatagagaattcagaaataagaccacatgcctacaaccatctgattttcaacaaccctgacaaaaacaagcaatggggaaaggatttcctgttcaataaatggtgctaggataattggatagccatatgcagaagattgaaactggacctcttcattacaccatatacaaaaattaactcaagatggataaaagacttaaatgtaaagcccaaaactaacctaggcaataccatttaggacataggcacagtcaaagatttcatgacaaagaagccaaaagcaattgcaacaaaagcaaaaattgacaaatggtttctaattagagcttctgcacaggagaggaaagtatcaacagagtaaacagacaacctacggaataggagaaaaattttgcaaactgtgcatccaacaaaggtctaatatccagcgtctataaggaacttaaacaaatttacaagaaaaaaaccaaacaacctcatttaaaagtgggcaaatgacatgaacagatactcttcaaaagaagacatatgcgactaacaaccatatgaaaaaaaacctcaacctcactgatcattagagaaatgcaaatcaaaaccacagtgagataccatctcacaccactcagaatagctattattaaaaagtcaaaacataacacatgctggcaaggttgtgggacgcttatacactattggtgggagtgtaaatttgttcaaccattgtggaagacagtgtggcaattcctcaaagacctagagacagaaatgccattcagcccagcaatcccattactgggtatatacccaaaagaatataaatcattctattataaagacacacgtacacgtatgttcactgtagcactattaacaatagcaaagacatggaatcaacctaaatgcccatcagtggtagactggataaggaaagtgtggtacatatgtaccatagaatactatgcatccataaaaaagaatgagatcatgtcctttgcagggacatggatggagctggaggccattatccatagcaaactaacacaggaacagaaaaccaaatatcacatgttctcccttataaatgggaactaagtgatgagaacacatggacacatagaggggaacaatgcatgctggggcctattggaaggtgaaaggtgggaggagggagagtatcaggaaaaataactaatgggtactgggcttaatacctggttgatgaaataatctgtataacaaacgccagtgacacaagtttacctatgtaacaaacctgcacatgtacccctgaacttaaaagttaaaaaaaaaaagttgttcctcattttagcacattccttatacgttattgattgtattattttgatgcaaatatatttcaatatgtttttcttttcacttctcatatttttatgattaaaatatgttaaatgttacccagatgaatcttttgatcacttccattgttatttcttctattgcttcaagctagtgagagttcttcatagttcattactaatagctcccaagatctcatgcaatcttcattctcttttcctttgattgctctatgtatttaaaaagtatgcatttaactctttaactcatctgagcatatttggcacatgtttaataaatggtttttacattgatcatatcattattattaaataacttctcctttgcccattgtttattgtacttcatataaccaaattgtcatgtataaataggtgtatttcagtgctgctaattctcctctactgttctatatgcctggttttgtgagtactttattaattattattgcttcataatatgtatagaatttatagtactgtagtactagtcttccccaattgaaggtcttcatttttcaaaatatcattttatattcttggcattttgtttgcctcataagtgttaaaattgctttgtcaagttataaaaataagtggcgattctgatttaaaatatatcagcttcttaagtcattgcatacattctaagcatcttatttttgttgttgttgttgttttcgttttcttatggagagagagagaaagggagaagttacccatagttgcatagttgcaccattgcctgagatatcctgatgcaactttgttattgacagctcacagaatggagcaaggttttttgaggcccaaagcttatatgagtgagaggagacttctttaagaaaaataatttttttattatactttaagttcttggatacatgtgcagaacgttcaggtttgttacataggtatacatgtgccatggcggtttgctgcacccatcaacccatcatctacattaggtatttctcctaatgctatccctcccctagccccccacaccccgacaggccccggtgtgtgatgctcccctccctgtgtccatgtgttctcattgttcaattcccacttatgaatgagaacatacggtctttggttttctgttcctgtgttagtttgctgagaataatggtttccagcttcaaccatgtccctgcaaaggacatgaactcatccttttttatggctgcatagtattccatggtgtatatgtgccacattttcttcatccagtctatcattgatgggcatttgggttggttccaagtctttgctatcataaatagtgctgcaataaacatgtgtgtgcatgtgtctttatagtagaatgatttataatcctttgggtatatacccagtaatggattgctgggtcaaatggtatttctagttctaggtccttgaggaattgccacactgtgttccacaatagttgaactaatttatactcccaccaacactgtaaaagcattcctatttctccacatcctctccagcatctgttgtttcctgactttttaatgatcaccattctaactggcatgagatggtatctcattgtggttttgatttgcatttctctaatgaccagcgatgatgggctttttttcgtatgtttgttggccatgtaaatgtcttcttctgagaagtgtctgttcatattctttgcccactttttgatggggttgtttgtatttttcttgtaaatttgtttaaattccttgtagattctggatattagacctttgtcagatggatagattgcaaaaattctctcccattctgtaggttgcctgttcactctgatggtagtttcttttgctgtgcagaagctctttagtttaattagatctcatttgtcagttttggcttttgttgccattgcttttggtgtttttctcatgaagtctttgcccatgcctatgtcctgaatagtataggttttctttttcctttttttttttttttgttttttgttttttgtgtttgtttttgtcgaagtctcactctgttgcccaagcaagctggagtgcagtggcacaatctcagctcactgcaacctccaccacccgggttcaagcgattctcctgcctcagcctcccgagtagctgggacttacaggcacaagccaccatgcctggctaatttttatagttttagtagagatgaggtttcactatgttgaccaagctggtctcaatctcctgacctcgtgatccacccaccttggcctcccaaagtgctaggaggattacaggcatgagccaccgcacccgggcatctaggttttcttctagggttttgatggttttaggtcttatatttaagtctttgatctatcttgagttaatttttgtataaggtgtaaggaaggggtccagtttcagttttctgcatatggctagccagttttcccaacaccatttattaaataggaaatcctttccccgttgcttgtttttgtcaggtttgtcaaagatcagattgttgtagatgtgtggcattatttctgaggcctctgttctgttccattggtctatatatctgttttgataccagtaccatgctgttttggttactgtagacttgtagtatagtttgaagtcaggtagtgtgatgcctctggctttgttctttttccttaggattgtcttggctatacgggctctttttaggttccatatgaaatttaaagaagttctggccagggcaatcaggcaagagaaagaaataaagggtattcaactaggaaaagaggaagtcaaattgtctgtgtttgcagatgacatgattgtgtatttagaaaaccccatcgtctcagcccaaaatctccttaaactgagaagcaacttcagcaaagtctcaggatacaaaatcagtgtgcaaaaatcacaagcattcctgtacaccaataacagacaaacagaaagccaaatcatgagcgaactcccattcacaattgctacaaagagaataaaatacctaggaatacaacttacaagggatgtgaaggacctcttcaaggagaactacaaaccactgctcaaggaaataagagaggacacaaacaagtggaaaaacattccatgctcatggataggaagaatcaatatcatgaaaatggccatactgcccaaagtaatttgtagattcagtgctatccccatcaagctaccactgactttcttcacagaattagcatcttatattcttatattattatacgtgtagttttctaggggtttactgcttgtgtataataatgtatatagtaatgtagtatatatgaaaacatggtgtatagtaatatattgggcatagtaatgctactgacctttgaattttaataccaaactgtcctctttctaaactggttgatttagttccaggtgtacagcaaattctttgtaaatattttttcttctttcccagtaattattgtcctttaagtcttttgcagtttgtctaaagcaatattatgttataatagtagctatattattttcaggggccaatttttgaaaaaaaaagcttttaatcttaatccattattgattcattatttaaaataggtatctttatcaagttaaggtagtaaatagtatcactccaagtaaaggttttatcaatttttcttttgacatatattgaaatagattatgtcatctaatgttaatataatgttagtcttttattgattttttttttttgcatttctttagtaaccttccttaagatcaaatttgtcacacagaataattagatggagtccggccttgtctgtgctttgatgcagtcagcatagcttgggaattatctgttccttgtgagcttggaggaatccattagatctgtatgccttgctttttggggatattctgaatttttaaaaaatttctacctccattactgctttaatagggtttcctacctcattgcgtcatttttaaatataagattgaattaaaatcatatatgtttattataaaatatcatccatttgttcaggttttcagtcagttagcatataattagacatagtattccatataagtggtttaattccttttgctactgaatatattgagtcagacctgaattctcatccaggttccaccactgattcatgtgactttaaccaagtaacttgacttctatcatcatttccctataaataggggtcatattacttagagtataggattgctgtgaggattacagatgatgtatatgaagttcttagcacagtgcctgtcctcactaagtagaagatattacactgttctctttcctaatgctgtttgtctccttttttgctgttctttaattatatttgcatgggttgtctatttttcatagtctttccagtattttcagaagcaacatataagcaatggggagccactgaaggaaagagtaccaactctgataatcgaatgtctgagcatcatttgtgggtggatcatcaaaagatgggtctatgctgtgagaaatgacagaattgacaagaggccatctagactcttcttgccaagcaaaatgtggaagtgtagtccttatattcatagtcagtaaacacagtctccagagcttgggagagactcttttaagggcttctgagagtgggaaattgaccaggcccccagttgtcctgtgcctgcatccaagcctttagggcctggaaacagagatgctgacaaacaccatgacccagactgaacccagcttttcaatgggacaacaaaatgagctttgttcatccttttgaaatggagcccaattatgtttgattaataaatgaaactctgtgtccaaataggagagacactgtagaaaaaatggtcagaaaacactttgtgtaagaaaaggctgatgaagttttcatcagagggctttcatttgcctggagctagtctcagacagagagaaatgttcagcttccaaatccttctcttgtttctcattccttttttttttttcttaaatatgtttaactctcctgcttaagatttattttgggctccttagcgatggatttgtgtttattgtgtcatttaaagaaaaatgcactattaaaaacactcctaatccatttataaatgtcaacagaaaaacaagtcaaaggttgacaatagtaattaatcaaacgatatttattgagcactttctatgtacaaagcactttctatgtacaaagctatatgctattaagtaagaataggaaacagtctccagcctcaagagtccttcagttgagctgaggaaatagccaaataattgactagctataatacaagggaaatggaaataaatattaaagtcagtacataagccacgctgtactgaagtacatatcccagggatggattagcaaggacttcatgagcaagttgcatttgggttgcatcttgaaatgtaagcaggcttttttataaggatgtgttctcttagatttttaggtgagccagccaatgcacctatgtattatgccccagatgtcagcaaacacaagcaactattctaagctagtccatcaaacccatgtgtgcacacaagcacacaatcatgttgttcccaggtcacctatggttactttcctattcctcattgcatttgtcccatccaaatgcttactcccaaacatgcctctgaacctcttcaatttgatgacctccaaagcttagcttcttaaatctggtcctttttacatggtttttggttttgcttccttccttaagttttagcctttcactccatgttgtcctggggaaagaactctcggctctggtcctctgcgcgtagggcccccatccctagccggatcaaatcttggaatgaggaagcgttggaagaattccctgtgttatccacccaggagttgtgtaggtaatacaggttctcctccactccctggccccaagtaagatgatgcttcagaataaaaacatgcccttgcatagataggtggttcccttcacagctggctccttaccagaatggagaacagtcctgctagcatggggttcagagtcttcctgtgtgtgcatctttccaaagatattaagaggagaaaaagatccaagtgaatttccaggtttctccaacactttaaactatacatttgatattcttaaccaacttgatgaacatgttggcctgtctgttccacacaccaaggaggtaaagagaaggcaagtgagatgatgagccatggaattccaactgctatgtcagtcatcaggctagaaaaatgggaggctgtgcattaatttcaagagagcctcggagaactgtctcaggataaatcagccagagtgactggaacattgtaccattttcaactggcaaatttattaatgaagtaagagtacagtctcaagccaactcctcttgcccctgtaacaaactccccctgtgagagaggatgaaggggatgtgtttgttagaatacttagaggccatgagtaacacaaagcctaaccaacagtgctttaaattttgtggacttttactatttcattaagtgaaaagtttggagataggtaattccaaggttagtagagtggctcattcatgtcatcagggactaagacatttccatctttctactctgccttttttatgtttttgtttttgtttttttaagagatgagagtctcaccatgttattcaggctggagtggctattcacaagcaggattatagcacactacagccaagaactcttgggctaaagcagtcctcccacctcagcctcccaagtagctgggactacaggtatgcaccacacccagcccactctgccatttgtaatatgtcatcagtggctccctttatggccacaagatcagtattagcatagtagttccacacattgcctccttaggtgacctgggttatttcttcttctcagagtgctattggccaggttacttgtggtattcaaatacaaatgggctggtgtaaagggtctgagatggtattattcatatgactggaaacttcaaggggtatcttgaaggcagggactggcaactgaagtgtctgcatgactcttcagcatggtggtctcagggagtcagactttctacatgatggcttggggtcctcaaaggcagtattacaaaaggcagaaagtggaagctgccagtgtcttaaggccggggcccagaaactggccaaagcagtcacaaagccccccacattcaaggggagataacatagacccccatctcctaatgggaggagtgtccaagaatttagttatctttgggtcacatgtaggttataagttaagctgttgtaataaagagaccaaaaatatgccgacttaagatagaagtatatttccccttgtacatcacagtttagaggtgagcaacacaggctggtggtctatttctgccagaaagttcccatatctggatccagcatgctttgtctactacttcttctcaagtggtgggaaagggaaaatgagaattgcagacaaacagcttccttgtaaaagataatccaaaatttctacacatcccttctgtttgcatcacattggctaaatgttagtcacatggccacacctgtctgtaagttattgccaaatagaacgtagggaaaatgggtattgaggacaattgttcatcaaggtggttaagaatatcaaatgtatagtttgaagtgttggagaaaattggaaattcacttggatctttttctcctcttaatatctttggaaagatgcacatacaggaagcctctgaaccccatgctacaaaagaaataggtagtgttggaggagattcaactctagacaatgaagttggcatctgtggtggtttatgaatcaaccctgtacctgcaaagggttttcacatctggggctgggtggtaaatcatagggtgctctgaacagatctttaagtattgggctattcacaaaacagaagcaaacaatgtgcagatgcctccccccatgaggagtagctgcctatttgaatctctcactggatggtaatggaaatgatcagttgggttcacttggtagggtactccttagaaatagctaatgaggtttcttattgtcttagtctgttttttgtttctataacagaataccacagttagcttcatagttctggaggctgggaataccaagagcatggtgccagtatctgaggaaggtcatcccatggcagaaggcagaaggcagaagtgattgattacatgaaacatagaggcaccaggggctgaacttactctacaacaacccactcttcaaataactagcccactcctacaataacaacattaatccattcacaacccaaattacctgttattggaccccacctcccaacaaggttgcattggaaattaagtttccaacacatgaattttgggggaacacattcaaaccataacatttactctgaacttcacaaagaccacaaaagaattagttgataaagaatgagctaaatagttgactaaatggtttagcaatcataaatataaagcagcataactattgtgttaaaagcattactatgaggcagatatagcaacagcatcagcctgatctaaccaaacaatgccatctcagtaggatactggtgaagccattccctaggagaaggtggcgtgcgtcataggtgtttgctggactttcttctgccttattcctggttcagagaaactcagtgatccatttttcatcccactccaaagcagatcagatggttgtcttgcttgtatcagagctaatgcttccgtggggagagctctctgtttctgcctgcaagtgctcacagttcggttgtttcagccagcaccaacatttgtttcttagatctaaaagtagccctattcctgtctgctttatatattggagttctgagtatacttttgtttaacaaaatgtgttctattacgtaaagaaaaaaaaagattgatagctattagcttaggaggcttctagaactcagtgcacagccagctcttgctctctcatatatttttacaaatatcttcaagaaacaaatggcctttccactggctcttgagggataattttaataatatatttgcagaaatatttgaaatggaataagggtattatgactgtagacttcacttatttattgttgaatcttgtagcttctgtattaaaaagaaagaaaaaacacttttattgaagacagtatgtcagaaaaaacatggattttttttttttactcaaaaagacttgtgtttaaatataatttgtgccacttattagctctgtgatcttaggcaaaatattgagatctctgagtctccattttttcatgtataaaataaaaataataacaattcctgtaatatactgctattataaggatagttagctaatttatgtgaagtgccaagcacagtgcctaatagtatttgtaactactatttattgaacccttactatgtggcagacactgtctaggtcaatggttctcccttggggacttgttagaactgcaaattctttatcaggccccagcctacacctactgaatcagaaaccctgggggtagggctcagccgtctgttttataagccctcctggtgattctgatacacactaaagtttgcaaaccactgttctgagtgtccaagaaattgaatgtatgattatcatattcatattacactacagctaataatttgtgctgaaacaaatatagatatgtcctcttctattttgtttgatgacagccctagatttttcccaccttagtcatatctgtgaccattccttacaaggagataggcgacctggaaaacccaaatatcatacctccttctccctcccgagtcctctcttcctcccctagcgggtctgcatcctgtctgtgtcaagcagtttatgaaatacctggtgagaactcagccactccagaaagaatgaatagctcctcctgaatgcagctccagcacctggagtcagtatctccctgacttgccattatgtgttcccattggtccccctgataaaatatgatctccctgagggcaggaacaacatcctaatgatttctgtgtccccagcacccagtacacttaatagacacctaataaatgagtggtgaatgaatgaagtgtcagccccaaatcagagggacatttgttcctggagcattcaggtgttaggcataccctagcagccagtatatttctagtcatggtgacaagtaggcaacgggattgcctagagacccatgaaatgttatctgagccatgtcttcattcatccataggatcagttctgtgccacaaggaaagctgtgtgacagtctcatggcagatcagacccacattaggaacagcctagaaaagcaaactgcaaatatccatttcttttctctgtcataatttgttttcccagttgctggcgaggttgaaattagctctgtctgttgacaatttggatacaataacctttctgtttcgtgaattctgaacagtgaaggactgaattctgctctgggctgcagaaaaataacaaagcactcagtaggatagatgggaatggagcacggacttagctgaggaagaatttggccctgctctggagctctctttgaatttattattcctgccttccatgtcttttcatgctaggtgggtgtagaaagccatcctgctcaccactttgtcccccacccactgccacctatgctgtcagccattcatctaacccacttagaagaaccagaatgaatatagatttcttctttcacacattaatttatggagccttcctatttcttctcattgcaatgttcctacctgctgcagtcacattcaattttattgaaaagcagcagggaattcatcctttgctggaaaactttgacaattaaattcaaactataaggaaaaagttatcctagtttcagtctctctttaaatcaaagtgtagacagtatgtagtgggttatggtgaaaggcccccataatgaggagagcaggtaccctctaagagttgaggggaaaaatcgatgcagatgatatgagttaaaccacatacagaagtgaccctgagatctggattttaagtggatgatggccaaattccaatcacaactggtatgaatcctctaaagttgaatgtttgtcataaaactgccacctatttgggtcatattgtagcctgcttgaagaaagatctaactaggagagggtggtctgcatgacctctagaaagacaggagtttgtcggggtcttctgtgcagtccaagaagatagcatgaccagatgacatgatgtgtttatctgcaagccagatctattcccataatgggaggtaaatgcatttgacttagatagctccatgatgtccataaaaaccattcagctaaatacctttgcttcaactctgtgcttcccaggcaatattccattaagattatggcttatcatgaagactttcctccaacccaggcaacatggtgaaaccccatctctacaaaaagtacaaaaattagctgggcgtgatggtgtgcatctgaagtcccagctactcaggaggctgaggtgggaggattgcttgagcccaagaggtggaggttgcggtgagccgagattgtaccactgcactccagcctgggcaacagagtgagcacttggatcaaaaaaaaaaaaaaaaaaaactttcctacatatggaggctgtgttgccccacgcccataagtttacataaagtccacttggcattcctgtttctcactgttgggcatgtcttctacatcttgaaagtttgggtagtgtgagccagttcctctggttgaacccttctgcacataccatcaaattcaagatctggaccaggaaataataggaccacactccggacatggttcagtaaacatcctaggtaacaaaactcttgaattcaactgtgagaaggtgatttttcttccctatctctgtcttcagaagaccagcgttaaagttgactgataatcacagccttttttaaaaaaattcttactaaggtgacattgttaggctgttttgggcaatcctttgaagtggtttttcctcccaaattttctaatttttgttcattatatatttgaaaagaaattcaaattgcctgataatagaaaatgaaaacatgacaagctataaactctgaccttaaaagcatctctaatatagcatcataaaatataattagaaatccatttcaacatcacattacagatctatgacttacaggtaatttctgtcatttaaatatgagggtgagctgatggctgaattggattcttaggagaaaaacaatttcttctgcattaggagttattagtttaattgaataatatctggatcatactggtggtaatgttaatgttattacccattatcttggtgatggtcacaccactgtttccaggaaaaatatagcccattaactgaacagaaggattaaaataggaacaaagtggcaagcttttcatggcttattatgccagggtcaggacaaaggaatggccctgaccttgaaatgggacagaggacccagcctgagctaaatgcctcaaagaattccaagggaagtcctttcaggcatgacagagtgcatttggtttcctcagcatgtcgttctgaacatttctactcattaatttattcatttattcacttactcgttcattcattcaaccagcccattcatttattcaaccaacatattttgtgcatcctcctgaaaccatgaatggtgatagatcatggagagacaaagatgacttagtcaaggagagagggtcaaggcttattgagaacctgctgtatctcagacattataatgggagatttcagacaatatctgttttattcttctcgagaattcagaaggtaggtagagttgttatacccattttatacatgaagaaactgaggttcagacaggtaaaatgacttgtccaaggcctagaaagggaaggagtcagaactcaaacctaggcctgtcttaattcaaggcctaggctatttctactacacctggaatttggacttagaacataaacacatttttaaaacattataatacagtgtgatgaatgggatacacagtcatataaagcaagacagctgccacggcgaaagccagatttccactctaagtgactcatccgacgtttttaggtaataggaaatgtctaggtggccctaatatgtcctccaaatctcttcttcatcctcagccccacacccagctctccctccatctccttcttatcaatggggggttctctgctccccccatcttcacaagcgaagggcatttgttcttccacaccccacatgatgcagggcaagaggaaaggtcaggctccacctcattctcatcacctcctcacctctcattagaaccgtgatcctgtgagcctcctaatgcccagccattaactagcatctgtcctcctggtctctgctacctaccagccttctggtcactcccagccctcagtgaagatgttggccctgggatcactgtcttatccaacccaagtagctcttcctgggactaggaccactttcagctgctgtgaatactggagtcatgttggcaccatgagatattttatcatcctatgaactcatttgggaactcaatgacaggtgatacaatggcctaagcccatttcaaagagtatttctgacaaagctttgtgtaagtacaaaaaaaattttcagaccatgctttttcccattataacatttcataatctcttccttgttttgtccctgcacctctacctccattaaccaggtctcatcaagttgtgacataagccaggtttcatcaagttgtgacaggtgacagaggcgtcacatgacaggggacctgattaggaaatccatatcctcataggatgcactttaacatcttcttgagctgtcttgatattttgagacatacggcaaagattccatatactgttccagtgaccagtgaccttgagaacatatttaaaactatagatttctgtgccccacccagagatcccaattcagtagcgctgaggtgggatctgaacatgagtagacttagaaagcctctagctgattctgaagcacagctagtttggggagcactgacatatagccactgcccatgaacctggatgttcctaaatcttgataccaattgagtgacttgaatcctccctcatctgtatgtataccatcatcaggtcggaaaaatacctccagcttccagcttaaggttgccctctcctttcccaccaccagtaacatgctagtaaacatttaacaataggctctcagaaagaaaaaaaattaagccctgatttataatgtttgccagtttccatggtgtaaatactctcaccagggccaatttccagctaccaatgtgatgccactgaacgtagaggtgggaaaagatgcatgtaattaacattccttagacagaagtcagctccagcacatcactgtcccacccatcctttactgattcccaaagatcaaacaaactacacccaagaaacagaggggtctctctcagatcctacagcacagccagagcctctcagaagtaaggttgtctccattttttaaaaagctctggcatattaaaaagtggaaaagtgggccgagcatggtggctcatgcctataatcccagcactttgggaggctgaggcgggtggatcacttgaggttaggagttcgagaccagcctgcccaacatggtgaaaccccttctctactaaaaatacaaaaattagccagtgtggtggcacatgcctgtgatcccagctacttaggaggctgaagtaggagaattgcttaaacccagaaggcggaggttgcagtgagccaagattacaccactgcactccagcctgggcgatagagtaagaccctgtctcataaataaataaatagtggaaaaagtgctactgcaagattggcaaaattggggtaacgctttaacaccaaaatacgatgcaataaaattgtattaatctcaagattatttataagaattataaaaatattcatttatacttcaccataaatggggtcaattggtagcaggacatgtggaaagccgtaagatgaatgtcattcggttctgtcggtgtatctctgtgactctggagaaaatgccagactctttatctgaggcttttgtgagtgtgaaaactggggcataccccctcaccactccgaatcctgtctccacccttctacctcccaccctcacgccctccccttcaatccatgagagaccctggacatagttttctccctcctaccttctgttctttgcctctcaagaatttccaaagctaggtgccctgccactgggtcttatctgggtcacaaaatagccaagtgacaagaattaaatgtaacaagaaaacactggggggtccaggtcccttctgcaccactgaggacctgcagttagttactgatgacgggctcttttatctggctccagtctggcaagagatctggtggagaattctttctggctttcattttccttatttctctgagccatttctggcaggaatgttataagcaaatcaaattttgatcagttgaagactatttgaagactctaggagctgctgctgattcattcatttattaaacaaacatttatttaatacctcccttgtgccaaatcctgtactagacagtggggaagagggatagagagaggagatgaagagcacacagttcctccccttgaagcacggagagtggaggaaatggatacatgatatgtaagggggtaacagcagtccctgaggcagatcccatgacagggtgcaacgtagggtaccttggaagcacagaggaagggtggctaagctaaaccaagcggtcaggaaagccttgaactgcattctcaaggacaagtaggcattacctaggtgagaaagggttaaaaggattaaaagggagatggtagtttatgcaaagaagcttaaaaaaaacaaaagctatgtggttcgggaaactgcaagtagaatatctttgatatggaggaccctgggttcagaggctggttcctttgcttattagctgcatgaatgggactgaatttagcttctctaagctgcagtttcctcagcaggaaaccccaccttaaaggactgttagtatgcagatgagataatgcatgtagcactctcatatctagcatagaggccatacccagtacttgacagcttggtgatgaggatgaagatgaggatggtggtggctggcataaaggatacacataagggtgaaagactgagggagatatgaggccggagaagtaggtggggccaaagggtgagcccttgggctccatgctgaacaaaattgggctttacccctaaagccaaaggaagaatttcaagagtggagtagcctgatcaagtgtctgttttagaaagttctgtctgatggactgggtgcagggagtaaaacgggaggcaggaactgattttggaggctcttgcactaatgtaaagacagtgaaggcaatagacatggcacggatggagtgacggaagcctctccagggtgtggctgagggcgccattcctttatgatttctcaggctatggatgtgaattttcctaagccaggtctgctcactcacagcagggcccagctgcatggaggaatatagaatccagggtattatcattagaattaagctgcttcgttgagtccataaatgtcacactcgggcataccagcatgtctttttttctggcttacaatgtaaaaagtaacaatggttatctgtgggtagtgggattatgaattgtttttatattattccttttgcctgtgtctattttctaagtgttctacaaagaacatattttgtatacggaaaaatttattataaaaatgtttttttaaaaaaacaaaactatacatagtttcgatccaaacagcatcctctctccttactgcctgagtaaggaaatgcttgattgaattagaaatgggaggggaggttgttgataggatccaacttcaaacttctaagctatttattttcttccttttgctttggagattgtgctgtgccaatgaagatagactgaagacgtgaatagtcttgagtttgaaaaataatcgtcgtttttattgttacagcttcaggcatggattatttccatcatttatatttcaggaaacctcaagtacagcaaaattgcccaatagttagagaagatcggattattgatactctctttttaaagaaaataaaatatcttatcagagagaagtccaagtgacaataatatcaccatacgtctacagggttgcaaaagtaaggagttgaaaggaagctctggtttaagtacgtgatgtttaagagaactgcagacaggggtctaacagctgagatttttcagcaccatgttctaaagcactttcttgctgggcctaaatcaaatgtttgtctatataatgtcttagacattgtatgcatcatcgggccatcttcctaaaaggtggcattttgattacaatcttcaatttggatttttaaaaatttgtaataccagtaatgataaatagtgcacatagttgtatggttcataaagtgttctaacatttaatctttacaactctaagtgtttgagttcactttagtccattttagagatgaagaaggtaaggctcatagaagcttactgactggcctgagatcacacagctaggaagtagagagagaggattcagatcaagctcttcggacttgaataggaatgccctttacactgctcccttctaatgacaggttttagttacagatgcctctttacccaccatggggttacttcccagtgaacccactggaagctgaaaatatcctaagtggaaaactgacattttttaaaacataatgggatgtgaaaacacaaaatacaatatccaaaaaatgctggcaacacagtacactgtacagtatcggttgtttacccttgtgatcgagtggttgactgggagctgtggttcactgttgctgtccagcaccacaagagtatcatatcacaaattgctagcctcagaaaaggtcaaaattcgacgtacaatttttactgaatgcatatagctttcacatcatcataaagtcaaaaaattgttaagccaaactatcttaagtcagggactgtctgccttttattttcattagactcactaatcaaaaaggcaagcagggcccataggaattatatccattcctgttgctgttgtaacaaattacccacaaatctggtgccttggggtaacacaaattggttctcttacagttctggaggttagaagtccaaaatgagtcttacagggctgaagtcaagatacaagcagcgctggttccttcgggaggctccattgcacagtcagtggctgccagtcttccttggcttgtggccacatcattccaatctctgcttccattatcacagtaccttcccctctcctttagtcaaatctccctgtgcctctgtcttgtaaagacacttatatttagggcctaccctgataatccaggacaatctccccatctcaagatcattaacaatatctgcaaggcctttgtggacatataatgaagcattcacaggatccagggatcaggatgtagatattttggggggccgttactcagcttaccatggcaatattcgtttcattcatttatttagttattatttagttatttttgtagagacgcagtgtcactatgttgcccaggctggtctcaatctcctggcctcaagtgatccatctactcagcctcccaaatagcagggacttcaggcacaagccactacacccagctttatttcatttattaagtggtccctaaatgtaagattccctgaatttaaatttaggccatagctcttcacagttttctattttaacctttcacttttgtgtgccttgaggccttagtatttgtttgcttgcttgctggctggcttttaagcaaatttaactctgactttctattgaaaataactcacccaaaacccctcctcctgctctctgtcagggatggatgcagaccactgactttttccaggccaggcttggaaagggcttacagagaggtgcattctttattgttcggcctctcctaactactgccatttattgagcacttaatatgtgtcagaaactttgaaatcattctacatttatttacagctcatttgtaccttggaacaggcctgtaaggtagattattatccccattttaccaatgagaaaatcaaggctcaaagagttaagtaacattcccagggttacacagttaagccacagaccctccaaaacccagcctcttaataccatgcttttgcaaaattaaataattcccaaacctgcgtaatgtatagatctcttttaaagggcaaatacaagctcacaaacacccaaggttgagttataaggattttcattatcatattatttaaatatgtgcaaagataaccagatatgaactccttatgcttatagctctcttaagatgataaaaacaaaatagtgatactaataataacacaaataaaactgcaaacactttaaatgctaattaagaacattgctttaatgtgatgggtgatgctgttttgctgaaattaaatgactgctcacaatctcgatgcaatgctgaccctcgtagcctgggtccttccgagtttggtatgcatacaccagggccctttgggctaactcagttctcccactgttcttccaaccactgacaacacattgttcaggcagcagcacacgtatcctttgggctttacctagtcaaaatgtctttgatttgttaactctgctttccttttagaacccactctctttagcagctgggttctctgggaaggagacctgcatcaagattagagtgcaggaagttaccaaagaatgttcttgggaaccacagctgtgggaggcaggggaaggaagcaggatgtgcagagggagaagttgagctgtgtcgcaggcccaacaaagacctctaccaaccaactcactgggctgggtggctcttcagagttgtcctgccttggggacaagagcactgacctttgtgcccctggaggatcactggatgagggtcaccctggaaggaagtttgacctcacattaggctgtgttatctagccaatgccaaagaactgacagctaagagcaaccttttaccatcatccctgcagctgggaagtaagtccttcactcctgaagagagatctggacagagcgtcacattgtcttccacactaacgcacaataaagttgtatagggcaaccgtgagatgtgaaaacaaatgcatcccagccactgaactgcctggtgatgcttgactagatctttgagatgatccttaatatgtacacaatctattattttattctcacaaaaatataaatataaatgtttaaattcccacagagaactaagaagactctaacaacatatttacaggcccctagaggtcttcagaacctactccaagaaagaggaaggttaggaagcttccaccccagttacctctgctgggaattgctgcatatacctgtgatatctccgtggtgtgacaatcacaaagttttacgaatacttctttgggtggcagtaatcatgatggacagatcctctcacaattcacatgtaatatttgggaataaaaacttgattgaacattcattcaacatatttgatcaggcacatactatgacgtgggtactttgctagacacctggtggggaagatacctttatacgagtgaacaaataatcatggacaaagaggatctgagagtcttgggtcatcagtaagccttttcagaagaggagtggcttgaggggacaagggcaggagcattccagacagaaggatccaatgcaaaagcatgagcctttggtgcgtgggcatgacaggtgatgtaggagatttggtcaaaaggtgggtcaggcagtagtgagaggtcgcactgacagaagcggagtggagagcctgccagtatgattaagtcatcagaggcacccccttcattactattcacctggccctgactgataccgtctcatttaacctccatgcactgtgattaacccagtagggaacaagctccacaagggcagtctgtctggtctactgccctgtgacgggagcccagcacagtgtccgacccagaaaggagctcattaacatgtgttttacagacaaagagtcaggttcagagaggacagcactttccccaaacttgcgcagcatataagtgaccaagccaagagctgaaccctcggtctgcctattccaccataccgctcttcaattcctgctccgtgagccacgaaaataactaaaagagcgttttcacagtcagagaaacttctgttaccatgggaaacctggaagagaggccagcctgtgtgtgtgtgtctgtctgtctgtctgtgtgtccgtgtgtgtgtgtgtgtgtgtgtgtgtgtgtgtgtgtgttctcaaattcctagaacggacaccctttagtgtctgccacaacacaaaatttctcctgtcatctcccaagtctctccccaaacctcaaatatgtggggtactcgagaatgaaaagggttaacctttcacagcttaggagagctgttactttgcatttaaatagccgcatttaagaaagcagcattcccaggatccttatttgatactaatgtgctgaacaccttaaagcacacttacttctcccccattcgggtcacttggagcttcattacttaataatttgaaagctttttatggaaatcagttgataaagggagatgatgaagtgaaatgttattacatttaaagacccagcaaactaggctgccagaataacacctgcgtcagacatttctaagtaaagaaagagaaggagaaggagatattggtgtgtggatgaattctcatttcttttgaaactgccgttactttaaagatactccttgcctaacaaagcctaacactctttaaaattgtcaagtgaagaactcatcagctatcttatgaattctacccctgccatggcgctctgtccccctgcccaccttcccagccgctgccttggcttcaagcccattgggtctagaggtccgccctactctcctccacaggcagggtcagcctcacacagtgcccacctcaaaagccttcatgactaaccagttgagaaaaccctgggaaacaggcttggatgcgaccttttctttttactttccatttttctttctctctctctttccttccttccttccttccttcattttttcgtggtggtggtgagacagggtctcactctgtcacccagactagggtgcagtggcacaatcacagctcactgcagccttgacttcctgagctcaagcgatcctcccacctcagcctcctgagtagctgagtagctgggactacaggcatgtgccaccacacccagctaatttattttttatgttttatttgtattatttgtagagatgaagtctcactctgttgcccaggctggtctcgaattcttggattcaagcagtcttcttgccttagccttccaaagtgctgggattacaggcatgagccactgtgcccagccgccactttttttcttttttttctttttttttttttatttgagatggagtctcactctgtcacccaggcttgagagcagtggcatgatcacagctcactgcaaccttcacctcccaggttcaagcaattctcctgcctcagcctccggagtagctgggactacaggcgcatgccaccacgcctggctaattttttgtatttttagtagagacagggttttaccgtgttagccaggatggtctcgatctcctgaccgcgtgatccacctgccttggcctcccaaagtgctgggattacaggtgtaagccaccacacctggccccagcctccatttttttaatggcaatatattcacatggtttgaaaatcaaaagatatataataaggttacacagtgacaatcctcagccttttgcttgctccctggttacctagttcccttctcctgaggcaactgatttttgtaatgttcttatatatccttccagagatactttatgcaactagaaatatatacacacacaattttctttatccttaccacccctctccacaaaggtaaatagattacacaaatagattactatacaaactgtactgtagtttgcttttaacatttaatatatcttacagatactcttacttgtgacatgacttttttaatggtgaatccaaagactatacagcaatgtctaaaaaaaaaagattcaaaagtatatacgtgtgtgtgtgtgtgagttttgtgcataagttatgatgtcaactatgacaaacaaatgaatattgcaattgatgaaagctgctgggtaaggatggtgggattatagggtcattctttttgtttctctctcctcctacgccgtgtgtgtgtgtgtgtgtttgtctctgtgtgtgtggccaaaacatggttatgtttttaaattctaaagaccttatttcagtatgtgaggtatattttcattttggtagagttctttcctggccctttcatatgcatcagcatctgtttcttaaaatacttgagtcactttattggtgaaggcttcctccaccactctaaaattgcagcataactctctcaccccatcctggccctccccctcacccttcccggctatattttccccggagagctaatcagcactggacacactgtgtagctgttatgtctgcctcctcctccggaatgtaagctccttgaggacaaggatgggtgtgtcttctgttcagggctcattctccagcacgtggaataggcctggcacagactaggggctccatctatcattgctggatgaatgagtcctcaccatcagccccagcaacccaacccacatgctctctggctcatgcctgtaaccactaaccagagcacctgcagataaccagtaaccagagcatctgcagctctgtcctctgcttcccttttccctccccactctggcaactctggaagaccactcctccctcccaggtctggatctcaccttagggatccattcctgcaagtgcaccctccctctctcctgcaatatgagcttatcttctatattggattatacacttggacatacaaacttgccctcatatcacacatctttcaaaaaataatcacatgtccttcctgctactgccatttttctcaactccacagccgacttctcaaaaagcgctgtctgggcttgctggttccgctaattcacctctgtctttcctgaacctgcttccattgtattttcagtagtggccagtggggcagcggcggcagcagtgagcacatggcagggggggcagtagggcagcagtaaacagaggccgcagaggtagtggggtaagcacagggtttctgaagaggccctgggcaggtcctggtgtcctcctatctctctggccattataccttagtctgctttgctctcccccatcctctcctctgcctccattcactccccaggtaatctatcctgtggttttaactaccagtctctatgctgatgacttggagtttacgtctccagcctggacttctccgttgagctccggcctcatatatctaccttcctacatgacacctccttttggagtcatccttgacccctctttgttttatacctcacatccaatccatcagcagataacgctgagccgacctgtaaaatatatctgcatcccatgccttgaaccccttccattgctcttccctggccctatgtcgccagacacagcaatggcctcctgcctggggtccttgctccccagcttgccccactccagttactttccctgagcagccagcaggatcctttaaaaatatgaatcaggtcataccactcttctgctcacaaacccctcagccatgttccagtcccatcacactctgaacaacagcccctaaaccctctgggagggcagccaaggccagagacttcctctagcttattattaactaattgtttaattaactaattcattatttatcccttaaatattccctgcatacctctcacaagccaggctggtgctgaggatatagaagggatgcaatgcggcccctgctctaatgctggcttctgggacgggacctgccctgggatggcagtggggatgggaatcatggttgaggagtgtccaacactgtttctttttctttttttttttttttttttttgagatggagttctgccctcgtcgcccagtctggagtgcaatggtacaatctcagctcactgcgacctctgcctcctgagttcaagcaattcccctgcctcagcctcccaagtagctgggattacaggtgcccgccaccatgcccagctaatttttgtacttttagagatggggtttcaccatgttggccaggctggtctcaaactcctgacctcaggtgatccatcaaccttggcctcccaaagtgctgggattacagtgtgagccaaagcacccgacccccagtgctgtttcttgaagactacaggatgtgttcccatggggtagggttaggggtgctgaaaggggcactacccttacaggttgaggcacctccagtcagatctggcctggatcatgggctgggcttcctcacagccctttctgtttgaaggcagacagcccttgcttgatgttctctcctgtttggatttggcatcacctacgtgatgttcgaataccttctgctgtggcccccttttcccttctttgctctggccttggcactaaggtttttctgactgctgaaggtcaggtagaagatggggaggcggaccacggaagagcaggtcctgggggctggtgggatgggaggcaggcatgccccatcagcctcttctgctcctttgctcactgattttactcaggggagcagcagacttgtgtgagcactaaaaagaacataataaaaatgcagaaaatgaggttaaatccaggatggtacttcagttaccaaaggacaagctaagtaaatgccgatggccagtgccagcacacagaaggtcatagggtgatgtgagtcctcagagctcccacccaccggaggcagcccttgggcggaggggcagtggggcaggcccggaacagctctgatggtcccttcctctctggcttcagaaatgccaagctgcttccacaaaaccatctcaggggaaaatcattatctacggacattatgcaattttcccatcgaaattacaagctgtgtttgaaaagaaataaaaagaaattgaatttgaaatgcttctgtgcaaacgcatcatcttctagtggatctgctaatgggcttcagatactttctcttgctctaaaatagttgatcagacagcagcttgtgatggtggctgcttcccggggaacggggcatagaatgagcacttatgaacggccagccagcccacctgagccaggttcagaacctgtgagctctgaccacggttcccaaagtggtcactgtatgctgtcccttcccctcctctacctggcagtgctggcacggctctatgctgggactctcactgctcctccagcgcctccagctgacacccaggtcgatgagtgtcacttcacactgcgctggctccatcctaggtccagggagtgcccacggactgggcctcggaggacaccagccccttcctcatcacagcctctcattcacccaacaagtattagttaagcgtgttcccaacacagatctaaacactgatagtacagcagtgagcaaaacagacaaacaccctcgccctcttggagcttccattctagcagggggagatagacaataaaaagtaaataaggcaggacatggtggctcacgcctgtaatcccaacactttgggaggctgaggcaagcagatggcttgagcccaggagtgtgaggccagcctgagcaacaaagcaagaccccatctctacaactaattttaaaactaactgggcatggtggtaggcacctgtagtcccagctatttggtatgctgagggtagaaggatggcttgagcccaggaggtcattctacagtgagccatgattatgcccctgtactccagcctaggcaacagagaaagaccctgcctcaaaaaaaaaaaaaaaaaaaaaaaaaaaaagtaagcaaaatgcacagtcaactggacaatggcaaatgttatgaagaaaagatagtgggataaaggaatagggatgctgagtcaaaaagggggcagggacctgccatggacatcaaagtcctcactgagaagttgacatttgagcaaagacctggaggaaacaaaggagagagtgctctggtatctgggagaacagcattccaggcacagggaacagcaagtgcaaggtgtgcctggcatgtttaaagatacataagaagtccaggatgccgaaacccaggttgtggaagagtagtaagagatgaggctcaggaggacaggcagaccatggagggtgtgggggaccagagcaaggtcctgtctgctgtgagatgcaaagccactggaggattttggccagaggaatggcatgatatgactgctgcacgaacaagagtctggaggaagggaggggaggtagagagacctgctaggaagcaactgcactcatctagctgagcgatgatggtggcttggatcaggatggaggcaggcaggagacggaaagtggttggatcatgaagatattttggaagtggagttgacagggtgtgccgatggatcagttgcagggtgggagagaaagaggcatccagggtggatggaactgaaagtacggcattgccatgtaatgggatgggaagaatgaaggaggctgggcttagggaggggaagatcaggagtttggtttcaggcacgttgttgagtttgagatgccacttagatacccagatgaaaatgttgagtggctgatatgcaagtctagagtcagaggctagtttgcaatagaagattacagcttaggaatcatcagcatatacacagttggctttttaaggcaggggactaaatgaaatcaccaagggagtgtggataaaagagaagaccaaaggcttgagccctggggcacttcaagctttagaggaaagtgaataggagtcagcgagggagactgagaaggaagagttgatgaagtggaaagaaaatcagaggcagcaagtcccagagccaaggagaaagcttttcaaggcagagggagtgagtgaccagctgtgtcaaatactgctgaggggtcacaagagctgagagctgggcactgactttggctttggcacggagaggtcactggtgaccttgacgggagcagtgagtctgctgtcagaggagaggtgagtctcagttgcctcacctgagaaatggggacaccctcctgccttcctcagagagcagcagtgcagaccatgggcaaactgcaaagtgccaccaaatatgagctgttttatttatgacctgagaagcccagaggctgttgaaatgaggggaggctactgttgggcacaattggttttaaagatgcttacagccccgttatcacctcataaaatggctcatttcttgctactcatcaccagaacactcacccaggcatgaaaaagttaccttcagaggtagaagctgtcaggatggatattttttgtgcatggcaactgggaaagagaaaaagcaaataatggggccaaatagtgctcaccggggtctccacgcaagattccagacactgctctcccagagggaaccccagtgatcctgtgcctcaaagcaagggctccttggagaaagccaccaaccagggtcagctgtgctctcactgcaaaatgagcaacatgggggagggaggagagaaggatggagaagaaggacagtcagggaaagtggaaagaatgtgagtttggagtcagatacacatgcgttggaatcgtggttcctgtgtggtcagcaaatgacctgactcctctgagccacagcttcctcatctgcagtggacagcgtgatagctatttccaaagctttctgtaagaaacaagctgttgaatgggggaatgcacactgtgtgtgtggctgcgtatcactgcatttgcaattagtggcactgggttttcccctgtttagtagcagacagtttttcttcagcccaaggagcctgtgccttcccggcttcatcaaaccggtcgtcagaacagcagtaactttcagtgttgtgaacatggtctgatattcttccacgtgtggctgtgatatgcagaactgaaagtaggctaggacatgcccttaagagcagcagaagtaggaggggtgggcctggttctcctgggccacagtgtgcactttcaggccccatctgcctgggttcatggtggcaacgggtgtggcctctagaatcagactgaggtctaaactctagctcagccagttaactaactgtgaaactaatttggccaaataaatgtgtttctgaggattaaaacgtatatatccaccttgcaaatgtgttgtaaggattaaatcagatgctgtctattaggcaatttgcaaggttagcaagatgcttagcacataaaaaataaataattattgttttattattgttgctgtttccacctgtttctattcctttccctctctgatcatggattgcatcccatttctcttcctgtggggaggagagatggtaggggcatcaggcaagttggccaggctgactccacactgaggtctgagcctcagtgctaccagcagcaaaggaatgtttaggatgaggaaatggcttgtggttcaggactggaagacaaagtcaaaaagttaggaagaaaggggcagggggatgtgacagactctggccttctgctgtgggcacagctgggatgtgtggagctcttcctcattgggtggctggctctggagtgcagaggagggtcagcgtggggtaagattggttcagacaccagccccgaccctagactcacagtcttactttctgttctgctcagaccaccctgtttatctcctggtattgatgtaattgctgcctccagaacagatctgtcccagatctgttttcattccacatgaacccgcttccctccagacctgacctcagcccatggcctgttaggggatatgctcttcccatttggtaccagtaactgtgaggtacaagtacagctgttgtatccccacaatatgcttacaaaagcaaaatggaagatgaatatgagtgacctgtagtatctttgggttttttcctattttaattggtatgtctttagaaaagtgttggcatcatccaaatgaaccatgaacgatggatgccctgagacactttgtttgaaaagggtcctgtgggagctgagaaggggctctaagtattcttgaaagttcctgtctgtgccttagagacttgttaaaataagcttttcatttaagtctgaagtgtgggttgcttactctgaatttaagtccttcattcttcagaatgtgaaatgcccagggccctagtgcccccatccaagctacataagccttccatcatatgctccctgggactcagagcttggctttcaatggaggcaagttctcctgaggctttgtgggtttgtacctgcaactgtgtgctccagtctctgtactcaggcagcgcaagtcaattctgatatgaacttaccctgaatgtaagtaaaaataagaatgatcagtaatttttgtggagcacctgctatgtgccaggcacttcattgccacattacatgagttgtcatttagtccccctaacaagcacatgcagaagatcctctttttaccctatttcacagatgagaaaactaagagaggtcacaagacttgccaaaaaacagagtttggcagggcacggtggctcacacctgtaatcccagcactttgggaggccgaggcgggcagatcacttgagctcaggagtttaagaccaacatgggcaatgtggcgaaaccccatctctacaaaaatacaaaaattagccatgagtagtggtgcacacctgtagtcctagctactcaggaggctgaggtgggaggattgcttgagcccgggaggctgagcctgcagtgagctgagatcgtgccactgcactacaacctgggtgacaaagtgagaccctgtctcaaaaacaaaacaaaaacacagagctagtaaatggtaccattagcatatgacctcaggtatgattccagagcttatgcttctcaactatgctactttcctgcctgctggattcataaacattaaaaagatggatagtatcccgtgtgccctaaattgagaacatgggcacatacacatccttgctgggagtagaaattagtacagacatttggagggcaatttggtagggcagaccacagttttaaatttgcttcacattttgatcactcctatgactcaatgatacaggaatccttggatgtatgagcaaataaatacgtacatgagtcttcatcacagcatcatttatgaaaacaactaaatatttactaatggtgccagtggaatcaattagagaacatcccctgctacataactctctgcatacatcaaagagaatggtgtggctttgctttttcaacaatctactgagcggccgtaggcatggtgatatggccatgaatgagcaagattctctctgatccttatagaagttaagttctaccagataacttgctgcttcaacaaaaatatttagctttttaaataaatgtggtagaatgctcctgctttcttgtttcatttaactcaaatgatcaccaaaaaagagaacaataagctgttgaccctgcagatgttgtgtaaccactagatgaaaagatttacagcaggaagctgtcatgcccacacatatggtcccaccatccttggagcctccataggtctaaatggagtttcatcaccataaataaatggtaatgtaggttccaaactatacttgtggagttatacatttgatcttggccaaaaggccaagaagcaatattgtgtgtgtgtgtgtgtgtgtgtgtgtgtgtgtgtgtgtgtgtgtgtagttatatattacaaaagcaaaatcactatatcagctgggacctgtaaaccagaatttaactgtaaagcaaggtgaatctgcatggccagctaacttggcagccaccttcactccacccacattgattttattttctagtgaaatatttcttcaagagcaaacagactgtcatcagacagtatctcattaccaggatctgatatcttggatttcctttttctaagtcttgacctggcttgccataatttgaagatatccaacactttaaaaatcaaaaaagagagctaagatatatagtatatagtgtacatagtatgtagtacgtactgatggaaagtttcccgtgatatgatattaaggaaatattttaaagtcatggtacagaacaagatattcagtatgacacagatttggtgggaaagctaaatataatgcctgcacacacacacacacatccttacatgtgcatcgtagaagatctggaaagatacacaccatgctgtaatattctggaaacggagaaggagacagaaggcagggttgctgttgaagtagactgtgttcaacatttacattgtgagtttctgtgatgctaaaattttccacaatgtgtgtattattctggaattaaaaatcaaagaaaaaaaagtggagcagaactagatgatgaggaccccataagcaaaactcaggaagtaagaaattgtcatggaagttgtgaggagcctttgaagggttttggcaggagacagataccgtcagatttgcagcaagtggaggatgaattgggggaagcaagaagatactggagatggggtggccagaggggagactgtggaaggaggtgaacacaggaatcctcagcctgactggtgtcgggggtgaagggagctgctggtgtttggcacccggctcaggcacgcctgagctgtgccttcaacccaggctgggctgctggaggaggagcaggactctgaggtcagaggaagggctcagccatgaggcatatgagatgactggaggaaaaccaggtctggggagacatggagctggcactcaggagacagataggttgtgttccatatatgacttcaagataaacaacttctcggtcattcaacagatatttcttaggagggaagaagggatacactgtaaacaaataaatatatttctcagagcatgagaaatgtaactgctctgttgggaaatgctttgcctgcagacatgtgaatgttggggtgtctgtgcatcccaagatttttttcatctgatggaaagagggtaccccggggagcctgagcctaggaggaggctgcaagcttcctgggtggctcaccgccgctgccctgtccttgtgggcccttcccctcacccaggactgtctgtaggagcccagaccacgctgggtctggctaagccaacttcctctgcaccaccaccacccagcagccccttcctgcatggtaaatgggaagccatggaccagaaagctttttataacctctgggcctgagcctcagagacaccactgtcctccttcctttcagtttccatggggctgtgggattttctaggcaaggtacccaaccagggagaaggtcacaatgcattctaactgcattctaggcgcctgctgccaggcacgactctaaggactgtagccttgtcgctatgagccagccaagcaagtctcttcccctggaactcagggatctgttcagttggcaacaaagcccttccttccccagctggtgacattctggagttttccacacacaatggactattgtgtctgagcactgctgggcccaggccagggaaaggggccatacaggaccagctgactccactctagggaaagccccccaccagagctgaacttggacctgtggaggcctccagccttgcaaagatcatggcacccctcacccgcagtgtgtaattgaaaataaaaacccaaccaaacctcaaagttgagcaaaatcaacaaagttctgatttttgccctatgaagaccattcagtgctttccttcaaaatgttaattatcaaattattcctcaaaaaattactttagtttccccagttatccctaaaataactttatggtgctttattcaccatccaaagcaaaacagagccagagaacctgaggggcaccacgggtatggggccttggctttgtgctggcctcctcgtccaagggagtctgatccagcgcatgggtctcaccagcaggacaggcgttgaggggacagtcctcagggccaggtgttagccacattgcaactcctgctgacccagctggcctggagcaggccccactcagttgctggacacagagcatggctctgccctctgaaatggacatgacatgggagtctggccaaccaaggcagaatccaggccagatctctgctctagtggggaagggatgggctgagctggaaaccaaaggtgtgactcagtggcccttcagtgtccaggacatacctggacactcagtcccctctcccggtatcactgaggccccagggttcccccatcccagagagaggtggctgtacacccaggcaggaaaagccccaacagcaggtgagggagtgggggtgaatggtgtcaccaggtcaaagccctattgttcccatgagcccagctctgttcactaaatatttgtggtccttttttgcagagtgatgaggtcctcaccgtcatcaaagccaaagcccaatggccagcctggcagcctctcaacgtgtaagtaacacaagtcccttgcctggcctgtcttatcctagccccttctcaaagccacctacctaatggccaccacataccagttatgctgttgaagttagcactacttctcagttaacaagcaggcaagatgctttctatgtgcagagcatcacacctgccccatcttctcaaggatgcaggctcaggctctgttttcccccaatggctttaataccacagccagatgtgatggctttaataccaactcagatgggatgattaactgttctgtgttcactcatgctctcagccacaacagaccaaacatgccctcaccctcagagcacacaggtgtactcatgcttagccagtctgatgtgtggaaagccagatttaccctgggttccattctcagtcccgtttcttttctgtctcctctatcccagagagattttatctgcccttgagtcaggtgaccaagggtatgctgacagtccccaaaactacctcctgccaaatggatggatacagtggtatatccgtcaggtttttggacagctctccatggatggtccacctggaccttaaactcatcatgtccaaaatgggtcccatcaccttcaaacaaacctgctgttctccatgtggagaaatattgaaagtacagtgagtgtcaaaaccctgtggattctgccttctgggcagctcacaaatcagtccttacttgattctcctccccttccttcaagccatcaccctttctcacctggaccacgtcacctttttcctttgctgtagtctccctcagtccaattcctcatccacagttactagagtgatcttttaagaatccaaataccggccaggcgcagtggcttacgctgtaatctcagcattttaggaagccaaggcgggcagatcacgaggtcaggagatcgagaccatgctggccaacatggtgaaactcagtctctactaaaaatacaaaaattagctgggtgtggtggcacgtgtctgtaatcccagctatttgggaggctgaggcaggagaatcacttgaaccaggtaatcagaggttgcagtgagctgagatcgcaccactgcactccagcctggtgacagagcaagaatccatctcaaaaaaaaaaaaaaagaatccaaatcctccagctagcctgggcaacatggcaaaaccctgcttctactaaaaatacaaaaatctaactgggtgtggtggcgcatgcctgtagtcccacctactcaggaggctgaagtaggagcatcgcccgggtccagggagtcaagcagcagtgagccgtgatcgcaccactgcactccagcctaggtgatgggaataagactctgtctcaacaacaacaaaaaagaatccaaatctgttgtgtcctctccttcttcatccctctgtgacttcgcttagtctcaagatcaagtccacactccttagtttagcgtgcgcaggtgggcggaacacacgtcggggttcatctcttgtcctccccatgctgcacctcatacaggccaccccgaatcctgggcagttccttgaacaagctttgattttgctcatcctttaaagacgcaaggcctggagactgaccccaagaagatggtttacgaagaagccttggccagcccctctagggagtagtctacatccattaacacccgtattgaagacagcaacaatgtgaggaatgtgtgagatgctgctcagtgggagaaaaggcgaaatccacaggataggaagggaggaaagtgctggacattcaaaaggaagacgccccaggatagggcagtgggagtgagggaggaggcacactcatagctgactgcctgggagcagggaagctacggcgaggcacctgatacctgctcatttaaccattcagcaaactaatggctcatcccctactgtgcgccagccctgcacatgcagtcctagctctctggaacactcagccagagaggagacagacaacagaccaagttgggccactccaggttttccctttgcacaagtccaggcagcaccatataacctgaatatataaaatataatgtcatcatggcagccttgtatactccaaggggataaatgttagggtgaggaatggctctggagccccagagcaggggcagaaccctctcctgctgtgtggaggagggacatggggctgtgcctggaaggtgttccttgtgctggtcaggactggcccaggcttgggtggagctgaggctctgagtggaggcctgaggagggaaagagagactagcactcagacagctggcccagcgcagcccagctggctgcatggaggccttttctagcctgctgtgagctctaagccttgctctggatcctccctaaggaagctcacaccagggcaggagaaaacccacccagcccaggaaatgccttgccctccaaggagaagcaacacgaggcagggcctacccagggcactctcctggcaggtgcacctttgcccatctcatccctgtcctaccaaaaaacaaggatgtgaattcacaaaagcccttggtgccctttgcataattaacatcagttaccagtcaggtcaccctgaatctccttactctgctgtctcttcagattctcccagttccttggctcccagaacctatgtgtgaagaacccctcacttctggtcctctaagtgggcaggggatgaaaggcaggtaggggtggggagagtttgtgggtaccaatttttacaccattaaggagtctttataccagttttctcttgaggagcctgggcttaaacagatgtaaactgcaaatcaaagcacattcaggaaagagataggaagggagggagagaggaaagagagagcagtcctttttaccttcagcatccccttgggtccaagtaggcgctgacatttattatcccttttaatcctaataaccatgaggtaggtattgcaatgtccattttaccaatgaccaaactgagactcagaggtcctatgacagcaagggtggatatagaatgccaacagtacccagctgattctaatgcctgtgcttttcactataacacgatccttccaattaagtaacaattcattcattttcccatgtctaaattaatcaagacatatatacctgccaatgagccttctgattggcatgaaattaacaatgtgaccacaccaaatggtctcacacctaccccaaaacaaacaaaatcttactttcacttaccctgtatcctatcaaggaggactgaaacatccttgataggagggtccccccaaaaaaagtcctgtgaaaggtgcttagggcaactgtggtgagcacagcacagttccttatggagattacaattcagtggggagagatatttactaaatgatcacacaaataaatgtgacatgtctatgaaggaaaggcataaagtgccattaggggggttagagatagcttccccctaaaaaggcaatgaagctaagatctaaggaagcagtaggagttaactaagcaaagaagaaaacaaaggggagaacattttagaaaatctggagagaccatcatgtatctgcaaaggccctgtatgaggagggagtagagtatgtctaaggcactaaaaggctttggtctaactagatccagaaatcaaagatgagtttggtgtggggccaagccatgtaacatttgaaattttttatttgaatttttgcattaaaagtcatgagtaagaccaggtgtactggctcacacctgtaatcttaacattttgggaggtggaagcaggaggctcactcgagcccaggagtttgagaacagcctgggcaacaaagcaagacccccatctctacaaaaaattttaaaaactagccaggcgtggtggcttgtgcctgtggtctcagctacctgggaggctgaggcaggaggatcactttagccgaggaggctgaggctgcagtgaaccatgcactccagtctgggtgacagagcgagaccctgtctcaaataataatggtaaatcattgaagggttttaagcaaaagggtgacatgatcatatttgcattaaaaaataaaaagcaataacagcactcggcccctgtgtgaaagggtagatgcgggagcccagtgaggggggctacttcagaaaaccggagagaattaactgtgacttcactaggatggtggtggtggtggaaaaggagagaggtacagagatgtgtgaggcacgtaggaggtaaaatcaacaggctgtggcgataggtggagtaagggggtggagaaagagcagtcaagatgtttcccatgtgtctggctggcataatgaaagagtggtgaagccactcacaaggctgaaaacgttagatgaagttcagtgggaaagatcatgggatcagttctaagtgtaagttgttaagatgtattcaagatttccagttagaggtgttaagtacatggttggctagatagctctggaactcagggcaagaattctgcactgagatctaaaattgggagccctcaaggaatgggagacaatgccaagggcataagaataggaatcaagggcttaggactgagttccaaagatctctactattgaatgttgaggaatcttgcctgcaaaggacacagcaaaggagcagcaaagaaattggtaaggaagcttggtaccgagaaagccaggggaagaaagtgtttgaggcgggtggttggctgtgcccagtgcagccgagaaaacaagaaagatcaaggctacaggaagccctttgggtttatcgacaggaaggtcatcagtgaccttacggagaatcctttctgctgagtgatgagggggaaaaacagcccggagcaggtgagctgtgaacagagcatgaggttatggagtcagcaagtacagaccactcttctgtgaagtttgctatgaaagaagagaacctggctccaaggggatgaaagagtcaaaggagcattttttttttcttttttaagatgggagagactttctgaaaaactgaaatgaatattttgggacaccttcccacatttcacctacccctcagacttcctgaggcctccgtggaacaaaattaattgatggcaaacactcagacctcccaaacacccaaaacctctgcactcggcgctactggcttgttaagggaaaagaattttcctttgattttcccataccccagtctcccctttcctcttccaaatctcattaggaagtcaaattaggaagcctacatgcagccaagttttgttttgcagaaacagccttgcctctctttgctgagcctgcctgattgaggttaatgggattccagcctccctcgccgcccagtggaaagccagggtgacctactttgcaaggtcctgcccgttgaaactgacttgtttttcaatgatctgcatctttatccccaggaccacttctcaaaggacagccatgaatgagcaaattagctgctgacttgtttagctcaataaatcaagctgtggctccgacagcccagggtgcaggtagagacaggaaaggcagactctgaacaaaacccacatcctttcctagttcctccggtgcctaagtagaaaatgcccagatttcctacaaatcaattctgaatgtccatcatccagttcctccaattgcatctgaatgctaagaattactgggacttttacaaataacttttatttccttccttaaaatgaatcctgcaaaccactgtcaccaccttaaattattcccagccactctgccggattaacattgattagataaaggtcgtgtttgtgaggccagtggagtagagacatggtcaccttctccagaaatccaaagccatgctccccaggaggccagagatttcccttaaattgggccggaagagtcagggctctccctgcctcctgcaacacctgcacaggtccaccgatgtcctcgggatgctaaaggaagatgggctttggacagagaagcaggtggtaggtctaagcatccagatggacctggagtcctagatgcctcctggttataaacacagcgttttccaacgttgcaggaacctccctcaaacctttctccacacacacccctgcagaacttcagcctagtgaatggcttgggcgccctctcgtggccaaattgagtttttgcaactctgaaaattcagattattgaaaactcaggatgagagacaacacagcatatgagtgttttaggaaaccctcctgagtctcactggtgtggatctgtaatttaggaggggatggtaagtctctagaagcagtatcaaaatcctttcttacctcttttcttttatggtgttttggaacattttgtttggaaaagttgaatgagaagaaaatcaacctctaccaagccctgttatgtgtccctcacaatgataagcagttttctcacaataaaaccttggggtaggatgatgatgctcccatttggcagatgtagtaattgcaaagaaaggtgaggtggaagccctcatcacatagctattaaataaacagctgattcgaatccagctctgactgtcaccaatgccctgggttctttcctccacaccatgctgcctctccaaatgtagaaaaaggaaacatttctctgggtcttcatatctgatgtgaattgtctgttcataacttttctttatctagtgggatcattgtctttttctacatatttggattaactctgtagataatatagatattaacactttgtcagtcacactcaatggagacattttttgccagcatgtcatttttctctccaattcagtactgctgttttcattttacagaaggtcttcgttgatagataattcaattcttttctttataattgcttttattgtttcaaagttgaaaaaattaatatttctctagtagatctgaaagctttatttttttctatgatctggttattttctatttgactctgggtctgttttttttttttcttgtgtggtatattaaatgtgaatccagttttttttttattacagttaacttagcccaaccccacttgtcgcacaatctttcctttccccctaatttgaaaagcctattttgtatagtccttatctatagtttctgggatctccagtctgtattgctgatttatatttctatcttacctgaatatcacgctattttgtctatcatgctttatcatatactctggtatatggtatggctagatcaactctctgctagaaaacggatacaaatctaagtcccaggtagaaagatgaaaccaaattaacaaaatatatcttggaagacatggcatatacaaaagcataaaaatttttatgacagtttgaacaaattaaagcactccagtcctatctagcattttctaaggaaaactcatatagattcttattcatttaattatttttattatagaataaatactttgaagtgatgcttaattaaatttgaaggtcaaaggaaatacaagagctccatgttcatttcttagattaagtcatttacttcaacaaacatttgaagagaatccatggcatgccaagttctaagccagacattgggatatagctatgagcacggcagaaatggtcctcactctattggaacctgatgggaaaggcagatattaacaaaaaattccaaagcaagagtgagttcagcatgctatggggaggtagaataggagttctaagcaatttggggagaggtcaggaaatacctcctccaggaaatgttacataaatggggtcaaggagggattctccagtcaaggataagagaaagctgcagggcatatctgaaaatgctatcaaattgttctcaggcccttatagattcagatttactctatcacccaagataagtcagccatgtgacctcatagtcaggaattggccgccccacgtttcccacaccttgaaacacttaccagggtctagagggtatctcgcttcagctacagatttggatacaacagattgggccaaaatgcatttactgagaatgatttccacaaggccttggtctcagatggttacacccattggctgggcaggttccagggtaatgtgttagggtggcagttggtttggtttctacagctctggattagaactggttttgtccccttagattgtcattatgaatagtcacccatggggtacaggatatgaatgactaatctggccccaaatcacctacttaggaagacaggaaggcaatagatggagcggtcagtctctatgacaatggaagaggaaacctgcctcccaggggactgctggaccaccccagaggacagctgcacccaggtgccagtgctgtctgctcagcagttactagaaggcagaccagaaccccgtcctgtgagtccctaggcgaggtaatgccacacctccatagactgcaatccttgtgtgaaccaggtctttaaagaagctgctaaaatcactgacctacatgccagaaaatgcacacgtgggaaaaggaaattaaatcccctgatttgtgcctaagtagctgatgatgtcattgcaatactttagcagtttataaagacttcctaataaagcatctcatttgatcctgacagcaacactgcaggtatgtattgctagatgaagatattgagacttgaagagggtgagcaacttgcccaagatctaaagctagaagtggaggagttcaagtcatcatacgcatatttgttcagtcggcccactggacacctaggtcctggggtacagctatgaaacacagagttccttcaaggaactcccggtctaagctggggagagggaacagtgaggaagtgattacattcatggggtctggctatggagacctgcgcagagtgggaatccagcgctatgtatctgcctcagccgaaggcaagacctgcgcagagtgtgggaatccagcgctatgtatctgcctcagccgaaggcaagacctgcgcagagtgtgggaatccagcgctatgtatctgcctcagccgaaggcaagacctgcgcagagtgtgggaatccagcgctatgtacttgcctcagccgaaggcaagacctgcgcagagtgtgggaatccagcgctatgtacttgcctcagccgaaggcaagacctgcgcagagtgtgggaatccagcgctatgtacttgcctcagccgaaggcaagacctgcgcagagtgtgggaatccaacgctatgtacttgcctcagccgaaggcaagacctgcgcagagtgtgggaatccagcgctatgtacttgcctcagctgaaggcaagacctgcgcagagtgtgggaatccagcgctatgtatctgcctcagctgaaggcaggcagaaaggctgctggaagaggtgacatgacctgaggcttgaaagatgagtgggcccagcattctcaagcttgaggtgtattacaatctggagggattattaaaacaaattgctgggtcctaccccaagtctctaattcagcaaatatagggtggggctcaagaatctgtatttctaacaagttcctagaggttgctgatgctgctggtccaaggaccacacttttccaatcactgaagagcttgcccaatagatgcaagtacaagtggaacctgcagctaacctgcaggtagactggcctgtcagggcccagggagcttcttaggtagcaggtagtgtgggataagggagggggtgcatgggaggcagcaccaggaccttgtcaatcgacggatgccaaagccaaggctcaggccaggttcttctccactcctgtggcagaacctagactggcatcaggctaaaatggaaagtccattcaggaaggcttttcctcccacctgtcccctttctgatctccatacgatcctacagtacttctctcagtaacactaatggtaataagagctctagggccaggcaatgggctaagtactgtctgcaagctagctcatttgaaattcacaggaaccctttggagtagacgtatgtgatcaccattttaaagatttggacactgagacgcagaaaggtttgataatctgcccaaggacacacagctgtaacaggtgataccagagcccaaggggcccagttccccaggccccagtcgggtctgcagtcattgctttctggtgccaggtgagggcagccagaagcagctggtcccaacagagggcacagggacttccagacagctgaggcagaccagctgccagctggactgaacagaacagttggtctctggccaaggattccccatgattagcagccttggggtgcagagtcaggccaagctgccttcaagcctcagccccctcctagctgtgtctattagttcattaaccacttattcactttcatggcctctctatgagacaggataataattctaaccccacaggattgtcatgaggggaaaatgaaataatatgggactgccacccgctgtgtgctttgcgaatgtgactctttcctttccagccactctgagtggttgctgccatgtatctcacatggtcccagccactcctgagaatctgtgtgacacaaagagagaggttgaagagcggcctctgatagcttagactcaggatgttattcccagcaactgggggtgtcggccaaaggtctctgactctacagctggtccctgcttcccagctgtgagctgatgggtacagtctggcgctggacagtgcctgctattggcagccttctgagggcaatagaaacaggaagctgggggagatgacccctctgatgggaggttgaggtgcaaggatcacttgagcccagaagtttgaggcaacagtgagccatgatcacaccactgcactccagcctgggtgacagagcaagactctgtctctgaaagaaaaacaaaaagagaaactggatagggtggtagtatatggttctctccacatttgttcaatggatgggctcaggacagagaagggtataaacccacagtggccaaaggcagaattcagtgggagaccacgaatgtggatactctctgtccctctcattcttcataatccaggcagatttccctcagagtgaggaccaacccccagaactctaatataatggtctctgtatttcgtttccaggagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgaggtgtgtgtgtgtgcctggagtggtgagtggctccttgcctacccgcttcctgagtgtcctggacacagaggggatctgtcccaggctctgtcctaggtgaactttcagtctggctggggaggctggcatggtcgcatcatcacatatggtgtaatttgggctctgggaactgtctgtgcagtggccaggagagcacggagagggaactgctaaagagcagttcccaggtgagcaggggacagcattccaaagccatgactgcaagagcgaaggtttctggacagctgggctaaggagtttgcattctgtcctgaatgtcatatttctctgatatgatctattgcattgaaatctggagccatcagaaaaccaatgggagaacaatctagaacagacatctgcaaactatggtttggaagacaaatctgccctacaatgtgatttgtcaataaagttttcaaagccagttacactcctccaagtacatattatctgcggctgttttctcactaccacagctgagttgaatattagcaacagacacaatatggttcacaaagcctaaaatatttagcatctggccctttactaaaaaagttttccaatgccgggtctattagaaagagtttgggattcaggccaacctggctcagccgtttcctagctgggatggcctctctgaaacttggcttcttcatcttagcacaatcctaccatggacatggaagaattttaaaatatagttctagaaatttctcagcacagtatgtggcatgaacacaattccataaatataaatagtagttatgcttgttaaattcctatcaaggactttgctctgatccatataacaaatggcttttgtgggttttcccaattttatttcttactctctacctctgtatgttttcttgcagtcacccaacaaacccaccattccccaggagaaaatccggcccctgaccagcctggaccatcctcagagtcctttctatgacccagagggtgggtccatcactcaagtagccagagttgtcatcgagagaatcgcacggaaggtactgggttagaacccactctggcatcgacctttcccggtaggagtgccagggagattgtacacccttctgctctagaatcatagagtcactggcagaaagcacctcaggatatggaattcctgggcctccccaggtttctaacatgcaaattatttcataagatgaaaataagcaggccaggcactgtagcccatgcctgtaatcccagccctttgggagtccaaggtgggcagatcacccgaggtcaggaattcaagaccagcctggccaacatggtgaaaccccatctctactaaaaatacaaaaattggctgggcatggtggcagggacctgtaattccagctactcgggaggctaaggcaggagaattgcttgaaccctggaggtggaggttacagtgagccaagattgcgccattgcgctccagtctgggtgacaagagcaaaactccatctcaaaaagaaaaaagaaaaaaaaagaaaatgagcaaaattaactcagcagtgaggcccagtgctcaaatgaacaatttgatccaggcaaattgctttcattgtgagttctgcaattgattactaatatctgccatgggccaggaactggggagtggtggtacccaagttatgtatttatcatccctggttagccattcctgctttcttggcatttctttctcaggcagattgtaaatgttggtccagaactttgccatggcatacgatttgtatacagaatggcgattagattttagtcctctttcaccttccccctacacattcccttctttctctcatgtgagccctccaagtaaaattcctttttcagggtgaacaatgcaatattgtacctgacaatgtcgatgatattgtagctgacctggctccagaagagaaagatgaaggtacgttgttttcttttgttgcaggtggcaacataaattgacataaccctttgagaaagcaatttgctaacctgttttaagaaccataaaccatgtgctttgacttggtaatcatatctctgaggatttctcctcaagaaataatcaaaaacaaggccaaggttaggcccaaagcataagggaattggtgaagatatgacatcagaatatatactcaacaacatcaggcctttaaaacaatcatgtaaatctcattttaatgggcttcgcaggattcagaccactctctgcttcgattctcaggccagcctatgaggcaggtgtggatacattcactttcctagcaagcaaagaaaggcccagatcctacaatcaggagggagcgacagagtcatggttcaagctcaagttttcttatgggatctggagccagacaacctggactctcagtagacatgtgatcttgggcaagaagctaacctttctgtctcagtttcctcaacagtcaaatggggataataaaagaacttgcttcatacagttgtcagaattaaatgggataaaacatgtaaggctcttagaatggtgctggtacatgatgagtactcaatgaatagcagctgctcttattcttaccatgacaactgtgtatgggatcattgggaagatgaagccatggcatgtaaataagccttgagcttttcaaaattacctacaatgagcctgcatgtgtctggaaacaatgccaagatgagggactgaaaatgagaagacgttcatgtgttgagaggaagggataataagaatcattctgcttatttagattagatatttattagcaagatgttaaactattatctttaaagggaagtggatggctgcttccatcccaggagcacccaggctcactgaagtcagtctggcagcatggcttttcttgtccccagataagctggtatggggagagggccagtggcagctcccataggttcccagggaaaacatgtcaaacactctttccagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaaggtgaggagacaacccagaccagccaggggctggcaggagttcaggaagggagggtctgcctagcagtcagacagtgtccctggtgagggcacaaggaccctgacagtagatgtcagtggggtccaccttgggcaaactcctatctgcaacagtgtcttgagggctctgaacacagaatctctcttatatcaaaggaattcttgagattgaccaccccctccttcttttactgaagagctaacaaacatagatacaacttatgacaagttacagataacacatagcctgcttctgggccttaactccaatctcttcttaaggagcctgttaacagtcagcccagattgaatctagatccattgccctaattctgtcatttacagcccctcatctgtgttccacctcagcgtgagtcagagcactctcacttctttgtgtcaggacctttgggctgattgcagaaattctcagtctatttgcaacagtgcaaaggtcagcctttaagtataatcttgcaacacctatatcatgatggctcaagcttcaagattgcactaagctgattgctgtgcaaaggtcagctatctgcttcccaagccatgacccctttctctgcctgatagatctacgctattctgccctgatcttataggatgccataaggcaatgggaaggcactgtataggctggactggtgtatggcagggaaaaaaaccacttccaagccgaggataaagaaagcaagcttatcccatgcaggtcattaattccttggctctgcctagagggaggctcttaaacacctctcccagtgttgcactttcacgatggtttattgctagctcattttgcccacaataagcactttggaggggagtaaaccctccccgtagactaagtcattcctacaaacaggcgggaggaaagctgggactggcctgtcaacattgaagcctctttcttggggctgggactggggagctaagctgaggagctgaggtccttaacctccccttccacagggaaggattgttcctcatacaaatggattatgatttatcttaaattatatgtagattaaattatatcttatcttagatatatgcgtgtacattttttaaacaccatcctttccatacaagcatctttcgaatgtattttcatgagataaagagtaattctgagtgtcccatgcacctggaaaagaggcatttcctcttagagaactttgccagtttaaggatttagacctcttaggtgtgcagacaacctcaactgcctgactcctcttgattcccgctggcgggaagttcccaccgcgcagcctggcaggcgcccctgccaccgtgcactgctgcagcgttcactcggtgtgttgcagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctgtgagtgggggccccgggcgggcaggcgggcaagtaggtcggggaggcagcaggtgcgactccaatgccgctggcctccccagctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccgtgagtgagagcgggggtggacttggaggaggccactggggacaggcgtggagggccatggcatccactattaccaccataaaggtcggaggctgagcagaggaaagcatggcccatggtccttgctgggcactgctgggagccagatgagagacataggtgtgtagacatcaaccagacccagagagagtaacctccactgggggacattctaagcaatgctggggtggcaaactggtggcctctggatagagaattcacctgcagctgtgttttataggagtgtctttcttgcagtggtggggaggagggccaatacatttaggcgggacatacattacccaggtccagcccactcctcccactcctgttgtacattggacttggctgatcccataaagcatgacctcccctgctctgtgcacaaatgcatatgggcctgcccacacattagtatgcagatgtatacaggcacacaagtatatacacattctagggaattcaggacaatgtccaaaaatgcatccctgagcctctcctttagtgcctgattcttagtgagtgtgggatgtttctgtctctaggaagaccctgctaagatcctcagtggcctttctagtggggacttatgtagtcatattgctaccctcatgtcataaccatcggggggggtcagcagggagatgaaagagagtgaaaagaagagcagtaggctgctgagccacttcttgctccatagatttcactcttatttgaacccatgggccaattccactttattccaggggccaaagcaggggactcggtgtggaacactgtggggtcagggagatcaacgaaaacaaaaggaacctgttctcagtggcaaacctggttcttgatctagacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccgtaagtcctggagctcctcaaggcccatcacttctatgttcctgagtccagggagccccgaaccagccagtgctaatactgctagatcctagaataacatggtttgctggggaagagtttggggtttggctttcagtgtttgcagttacttaaacactgcagtcagtttcattaataaagtgagaatcccactaccgtctacagaacacccaaagttaaggttcctgtgaagtctaaatgacagacacatacgaaaaacagcacaaagctcaataaaccttagttctttccctcctctcccccaacaattataggcttgcctgacccatggattttccaagcattttaattctattttccctgtgaccattttaattccccatgaccagaggctggacattaaatcaatgactcctgcagactggtaagaaaaccagcaagaaaacaagccaagttctcaaaaactcaccccaccccgctccactcccagtcctgttttccaaagtctctgcgatcagctgtttatattacatgggactaatctccaagcagagcaagccagtttccttggctggtcttccaagagctgcttttttgggtggtaaaagggcaggcacactggctgtggctctggccccctccagcatgtacttgcagtcgttcatcctccctcccctagctagtaaccttcagccgatgactcagcacctctgttcctcagtttctccatctgtaaaatagcaggaaatacttcctaggttgctctgaggatgaaaccaagtaattggtccaaagtatgagcactggacatggcaaggataggccttacttaatccctgctccatgctccagctcctgggttgttttaggagactcagccatgggtggaggtaacttggaccacccactagagaaagcctggggttttcagtaactaagattggcccatggttcaggccagctcaccagagttggggccccatagccttctgacttagagtgcctggggtccactgaagtaagggagaagaaaatgaaaatttatggagcacttacagggctgggagcatctcatttaatccttacaacctaatgaaaaaaaaaataccatgatccccattttgcagataagaaagctgcctgagcttccacaggcgggataaaagaactgaaactgttgaactaaatgaggacatctaagtccaccaccctgactttggccttgcaagaccaacagagagcttggaataatttacctccctgggacacatcctgacagtcaaactgatgtgttattttcctttcacatttatgagatgctggcttagtaagaatttactggatctcgataaaccataaagcaccacttgctcctgaccctcttctctactgaatgtcccatttctggctcctgtgttttttgcatagaccaccatatatagaacacaggatgatgttgagaatgaaaagctgccagggtgtgttagaaccacaatgtccttggtattggtccacaagggtcagccgcctttagcttgttgacttgttctctccaaagagcagcagggggcttgctggccttgctctgaaaaatatcaccagtgagtttgggactgtgggaagctattctgtacttgaggctgatctgacaatattctagttcacagagcagggcaagaggctctgaacacatcctgaaagtcctccaaagccttcttgagtcatagagggagcatagaatgggtgatgacctggcaccaatcctgcctctgctgcttaccaaccacacgggctgaagtcagcctgcctctttggagcctcagtttcttcttctgtaaaatagcatgacacagcacctgctttgcatccctcataggcttgttgagatgttcaaaggagagcgtgaccatatcttgtttcagacatgtgatacactcatgcccatctgtgtcttgccagccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggtatggctcccaagtgtcagcctgggtggtctccaggacaggcagggttctgcactgggctaagtcttggacctgtttaaaaaaaaaaaaaaaaaaaaagtcggggagagtctgcatcttctggagtcttcaggccacattttgattctttagatccaagtttgttcccaaatattgagcaagcataatttataaaggagattggcggtgggggtcatttatcaaagaacatttagataacctaattacctgccaaaaataaattttcaagcaaagaatctttaggaattacagttccttctttacacacatataaaaccaataatgtgtccaactttgctcaaagtcagttatgacttagcaacaccattcactccttgcaaagagggaaaatgatacagatgtgtcaaaggagtcttgtcttgttcatcatttagggaatgttcctgagaacctcccagaacacatcatcttccattttaagggtgtggctcagacaaggcagccgtggcctgagactttatgatttttttttgcaaggctaaccagaagtttatcagcagtgtcatgtcagccttgagttttatttccccaaataatattgatccaagctgacaaataactaatagaacaatgcaccaagtgctcagggagctgaggaatgagcatcatcttacattgactggagttcagggagatgtcagagcagggaaaactagagtgggtcttgaaaaatctagaggagtttgccacttagaaaagtacattccaggccgggcacggtggctcatgcctgtaatcccagcaccttggtaggccaaggcaggccaatcacttgaggtcaggagtttgagaccagcctggccaatatggtgaaaccccatctctactaaaagtacaaaaattagccgggcatggtggcgcacacctgtaatcccagctactcaggaggctgaagcaggagaatcacttgaactggggaggcagaggttgcagtgagccaagagcacaccattgcactccagtctgggcaacaagagtgaaactccgtctcaaattaaaaaaaaaaaaaaagaaaagtacattccaggcagcaagaatagtcattacaaaggcacagagatgccaaagaccatgataggtccaagtgataggtccaagtgataaatgggatgcagatgaagcacagaggacaaggcaggcaggaaaccaggctgggaaggcagggaccagaccacacaaggccagtggcccaccaaggattttgggacctgattctgtaggtggttttaagcaagagggtgactgtatcagacctgtgttgactgatttggggatggcaaacagacacagaggccagataggttttatttgtaacccaagagaaagattatacatccccaaactccagcttaacttcagagttccaggacttcagaagaaaaagaaaatgcctgccagggacttcagtgctgaaggtgcccatgtaaaaaagtgaagattaacatgtacatcaagttttctgatttttaaaggcctattctttttgaagcatgaggatctccttgatggttcaggatccttatgattagggagctgtttgcatatcaaagtgctgtctgttctacatggtagtcagccagtcaacaaacattcattaaagcctactatgtggcaggtacatagttgtacggtacattcctccatgactcttagctgtagtgtggttaacaaatatctcatgtgtaaccataaatgtggtgggttctataaaagaggaatctagagtgctatggaagcagtaatcaaaagatctaacctaattaatctctggggtcagggaagttttcttggagagcagcatgtttatgctgagtaggaagaacaaaaattgtacttctctatacttagcatttgggagccaagtacttggggagtaaggcataagagaaagtggtttagtgttccttatatggctgctgcataagccatcccaaaacagtctttttaaacaatcacttagcaagattctgtggatcagtgatgtgaactgggtccactggatggttcttcttgggtctagtttggactcattcatgtggctactactagctggtggcacaattggaccagaccagcctcacctgcgtatctggggcctcatgagatggctggggcttctctgcacatggtctctccagtggtctagccaggcttgcttacatggtagtagaagggtcctagcagcttttaggcctgtttttgctcatgtcccattggccatggcaaatcatgtagtcaagcccagattcaagaggtggagaaacagagtctgccttttgatgagaagaaccgtgaagcatttgtggccatttttttgcagtcagtcacatacgacctaactgtccctaataacgactctaaccaatcattacatacttgagcagaggaggagcccagacaagcacatttcacagttctactagagttcagcatccctgttccgtcccgtttctgcgggcctaacaaggcattctcatgctttcaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaagttgtaattgtttgttgtgtatgtatttttttcaatgccaaaccagctgtgatccaatttacatccacattttaggtccaacagcaagaagttcagagagagatttcccaaccagacattgggtcactcactggtcaccttgccagtgcattttattagaagggaatctgttgtagcaaatgggaataaacctgggtttctatagacccagaactgaaaaaataaacatcgtgctgtttttaatttgaa
